United States Patent 6,812,339 (POLYMORPHISMS IN KNOWN GENES ASSOCIATED WITH HUMAN DISEASE, METHODS OF DETECTION AND USES THEREOF) - sequence listing, part 19

SEQ ID NO: 12494 - DNA, 49212 bp, Human
catataccacagtctattgcatcatgaaaaaccagtgtgcaataggtctttttgttcttagcaaggtaaagacatttgcaatactgacaggagaaatgtcacctacaaatactctaaagtgtgaagtgacataaatgtttctgcacagctaaaactttggtatatgtggaacagtatggaaaatgaggccagaaaggtaaaatagtaagctgctttttgtcataaagagagaaatggaacactcattgttcaaaaataggtacataattgagagattttattcagaataatgcctgattaatataaatttagtcactgtaataatgtagctacataatttatatatatgtatatatattcgcacattttttgctttatcaggaatttttgtatattctactaatgacttttctgtatgatagcacaaattacaattgttggccactgccacaaagtgggggaaaatgcacatttttaagcatttctttgcttcatctatgaaaatttcatctttgtggtatgaattatggagcattgtcctgagttgcccttataggtgaccgcagtttgtgtgttgtatgctggagtcccaattgaggacattactgcatataaaatgattataagtaaaaggcagaaaatgttctgaagggtcataacttccaagggttctctaccctttgacctctggattggggttcccagtgactgccttaatatccttctctacctactgccttaaggccaactcaatgtatccacgtaaagagtaccctaaagccagtaaaagattatcacgaacacccagagatgtttatggccatcattccagatcctctttgctttttcttgacttactccttttttgataaagttattcatatggtttcaaatccagaattcagctattcacttcatggccctagtttggattaaaacaatcagctttcttttgctctgtagatggccttggacagtacatattaacagtctatggggccccttttccactcatgaccacatcctgcttgcagatctgctgctgggttaacaccacatcatctgctagttgatgccatttatttgacatcctggggttacagcacgctaaagggcacccactgtccttaacagagaaaaatacactgctgagcagaggattaaacagactcctcacactaccggaagttcagtgcattttccaggattttcaagtcttcgatgctgtcatgttgagagtccactatccacgtttgtttatccaggaataatgcagaaaatctgagcattcgtgaatctaatcattgaggtaaagtaacctagtcatggtcaagaggacagctagtgttaaactccttcatataaatttaaggaaggatttacatattcataatgactttctgatctggaaagcccaggcttgtcagttattaataattggatgaatacttcaggtagtatttaaacaaatagcgatttcatagcagacatttccccaaccaggagatgcagtaaagtattggtagcaatagatgctcctaccaagatctcctcctgccactgccactctgtgcacaggaaaggaggggagaagaagccatgttgcttctcttatatttgagcatcatttaagggaatataagtctctaatgactcacatgtaagtctgctgggtaagaaagttctaatgttggaactcctttcagctatcgaattttgtaagaaaaaaaacttatttgtgtttatatacatttatgagatacaagtgtaatttcgttacatggatatatgccatattggtgaagtcagagatttcagtgtgcacatcacccgaaaaatgttaactgtacccattaaagtaatttctcatcccccatttcccctcaccacatgctccagcccttgccaggaaactgttcattttctctgactaacagaaacgaaagctaaaaacactggtgggaggagtctccacattgtttcctactccattttctctggggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggtgagtactgttcctgattttgtaaatatgatcttgttccttccttgaagtccccagaatcacaaggggacaatcagtattggttattcagggtcatgggatgatgggagtagggctgagtattcagaaaagtgaaaactgagttgcttgatatgaatccttcatttacttaggaagataacaggcatcttctattccaccacaactgaggactgaacaagagaaaatgcattttgaccgttgcagattttaaaattaattatccgagtgtatattggcataagttggtacttagaagagggcttctgttattttggctggaagaagtgttggaaactcggtagctgtggtgggttctcaagatagtgacatgaaaaaagtatcatgaaagaatattaagtaaaaaacatatctgagcatagagatgtattatatgacatcatcccaattttacaaaacataagaacaaatgtacacagagtagaaaatttttttcagtttcacaaacacagttactcaagcacatggtgtcttaatattttcataagtatattgatcctttactttagctccattctacactgggtgctagcggcagaatttcaatcattttggaattactctctgccctcctgaaagttaatgattttttttttccttgtggcaaggtataggggagtggaggggaaggcaattaggaaaaggttactattgtttacttttcaaatttttaaaagatgttttctatagcctggtacaatatttcatgtgtgcttaaatggaatgtgagattcttaaatgttgttttcagaattttattagataaatgttgttaattacgttgttcaaatttattatatcattacagattttttcaccttgttcatttagtaattgaagcataaactgaaatctcctattataaagtttgcttttttggccgggcacagaggttcatgcctgtaatcccagtacttttgggggagaccaaggcgagcggatcacttgacgtcaggagttccagaccagcctggccagcatggcgaaaccctgtctctattaaaaatacaataattagccgggtatggtcatgtgtgcctgtaatcccagctactcaggagactgaggcaggagaatcgcttgaaccaggaggcagaggttgcagtgagccgagactgtgccactacactccagcctgggtgacagagcaaggctctgtctcaaaaaaaaaaaaaattttttttctttgtagtgctctcacaatcacatacatgttatgtgtatatataatatacattcacacacaaatatatgtatatataatcatgtatacaaacaggtacacacatatatgtgtgtagtgatgtctgtacatgtgtgtatatgaagagaaatatatactaattatagtaccatgaagcactataaaataataaataatatcattagataaattagataaattcataactaaaacataattttctaggagttgaaacttttatcattatgtggtatctgaagttacttttgggcttaaggtatatttaaaattacacaaacatagataaactggctttctttagttattccttgcaagataatttttaacaatttttttcaccttttgttaacaatatatatgtagatttcttaaatcaaatttgatgaaagttgtcacttaacaggtcagaccttttaggtatatgctggtaattaacaatctgctgtctttacttcaatttatgacacttctatatcatctcactatctaagacaattgctttagtgaattgtcatgttctttttcttccctccctttaccatgctgttgtaatttctgtttctcttatctttgatcagggttttctttgtaagacattaggaacacctaaaaaagtttatttttcactcttcttatcttttggctggcagaatttttaattttattcattgttttcctattaaatattattttcaatagatgttttcttgtggtatgagtctttgtcttgcaaaaagactgaggccctgagtatcacaaaatagtttttgagactcttctatttaaatatcattttgcctaaattaaaactctaaaatgtaaaattatattttcccttaagacaagatgaaagcacctcttctgtgctgtggagctagatacattttgaagttaagaatctggaggcttcagaaaggctatttagtgtatatattctaaatagtgtcttactagaaactccattgggatataaataattactccaaaatcaaaagcactaatattgcaaaacaaaacatgtgagtgttcacatttcagtgaaataaagattatacatagcctactgtcatcccaaatctggttttattttgcaaataaattgtgctgtcacacttgttggaaacaagtgctcagtgccacaaagaaaaaccagcacttaaacaggaaatttctcagcaaagcatatttgcttctacagaagggtgctgcctgcgtcagtcacaatgcacattctaagctgaccggattggctactgctttaaattctataggggtaattaggcgggaaggaagacactgtcctgtaccaattaggcgggaaggcatgtctggggcggcaaaggaaggaagggttgtttacagaacaggaaagaacaggaaagtttgaagacgaacttattgtttctagcacactcacaaaataagtcaaaactttccattgaaaattttttttggttttgcaattgatatggaactttggaccaacattatataaaaataactccattgtcctgcttcaggcagttttgatatagagattcactttcaatttgattcttgaatctttgtaggtgatctattcctcattaccgaaggcttacagagtatttttgttcattatattcttcagtttcactataatgtgtttttgtatagattttcccttcattctctggaccttttcagtccaaggatcctcatgttctcgtaagaaggaagcttttttttttttttttttttttttgacggagtctcactctgtcacccaggctggagtgtagtggcacgatctccgctcactgcaacctccgtctcctgggttcaagcaattctcctgcctcagcctcccgagtagctgggactgcaagcgcttgccaccacacctggctaatttttggtatttttagtggaaacgaggtctcactgtgttagccaggatgcttttgatctccggaacttgtgattcgaccacctcggcctcccaacatgctggaattacaggcgtgagccactgcgcctggcccaattaatagcccctgaaatttagatatcttggttatacacaaagacatcattcctaaaattaaaaaattcattaatttaaaagttttggaatccataccttgcactgtcatcatggaagtgtacaggtgttaagaggtcaagagcagtgacactctgtccatagggagactctgaaatctaccaggagacaaagcctcagttgagtcttaaggttgtatgggaagtagtcaaagaaagaaatgtgggaatggctttccaggcagtaagaaggaactagcaaagtcatgaggcatgaagacacaaggtgtccggcatctttgtgaagcatagatacaaggagtacaaaggtactagaagtaaaaaagatgcagcttattcaacactttctgagacagtataggaagcaaggaattttggggaagaaaaaggagaaatattgaaggatttcagtggaatataaatgtggcttatcgagagaaaactgattgtgcgaaaagaaataattagacaaatcaagtctgaaagaagaaaaataaaacaaccaataaaatcatttcagtgaataaatactgtgatgctgcactagaaagcatgcagattttcagcaaagttatggttttatgggtacagagaacagaagccatggtctagcaccaaagaagggaggatgctaatgaaagccaactagggaagagtcaaggagaatagggtcagtgccacagcatgaaactgtagcgctgtagcagaaagttattcatataaggtgggaggctgcagcccatttacacctaggccgctccagtcatactgggtgtgggaagatttaagaaacaacaggcaggatttggggaataggcttcagccccagtaaaggataagaagaggaaccaagggctttgacactgcagagctcatactcttaacactgaggcaattgcttgttctcagacctccctctaacaactggacccaactcaactattctcattcaatgggaataatttcttagacattcctaacccagcagttcttcactcaatttctacagtaacacatttggtcgttgagtccttctttatcacacatattcatgaacaactctttcatatgggccactcactcacataggcatacatcttttaaattgtctgtatacatgtgtaacactgtatataccattttctcttgtaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaaggtaattgggaagagggaacacccactccctgcaaccatccccaaaccctccccaacattgattagagccccacctcggacatacttgagatgtgttttccccagtttgtgactcaacagctgagacaatgttggtacttcagaggccaacaagttgacaacttagtgcattccattactggtgtagattgaagtatttcagaatgtatatttgggatcagtgaaagaacaaaagtgagagggagttgaagggggactgagacttccagtacattagaaagattatataataataaaatcataaaaactgtttaaattcaagatatgtacatttagccaatgaatgtatctgttctattgagaccatttaacccatcactaccctttataatttaaaaaaatgcaatacttacatgtgagcctgcctctcagaagtgtgatctcctctcttgttatatcaagttaaaaaaaaggatttgaaaaagtctaagtccaaaatcagtatatccttcctcatggaaacctttggctggtttctataatttgaatatctttacctggggaatgtgacctagcagtctccatcatgaaaacattagtttttaaaacaaaatgatcggagaaccgcattgggaaagggttaactgaagcacatggagttcagagaacaggaagcatgtgctcagtgcacaggggaggagtgaggaaagtgctgaggagcatgagtcagtgcttgttcctgtcttgtgactgctggtctccttaaggccaggctgggctaatgcagtagagctagactaaagcacagctgaaccctcaagcaggaactgagagcaaattgtattgaaactgcttcagctgtcggagatcgtttatatgtcttccttttttctgcattggttgggaataaaattgaatctattccagtaaaaggaccagccctatcaagaaagaggaagaaggaagtggatgctacttcacctgcaccctccacaagcagcactgtcaaaactgaaggagcagaggcaactcctggagctcaggtaagcttcaggaagaggagcaggcttcaagtcccacagaggaagctctgctacggctcttccactcaatctctccagcaggcagttatttcttcatgtttcccatcaagtttcagatttaccaaattgtatgataattgatcatcttattgatgctcaaagcaatgcaccaaacacatgagtaaacataatgtaaatatatataacataaatgtgataccttcattctagtagagtggagtgtcaacgtgagaatcaggtaagtactttgtccatgtgtataaaaacctagtttctctaatcccaagtcagcacatcccataacagaaataattagagaaataatgtgtataacattctcctctttcttcgtttaatgaaaccatctatgcccatctcttaaactggcgagagatgggcagcaacctctcaagtttccaagaaacatcttcttaggaataataaaactactatccaataatgaaaatgtgctctacttcatttggcactgaaaacgaataacaggaaaatcaaaccactttcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgaggtacactcttcctggtcccattttgctttgtttttttcaacccaaagtaaaggactgatttcaccggttacttaaaaattgcatcgataatttgctagttaatccaatgtacatattgagaaaccactacattttgatcttttgctttcacagggatacttgatgaacttgacattatctctgactgcaggaagttttctgttctgtgttgtttggggaagggagagagagctatgcagtacagaactgtcagctgtgggctcactgtctactgctcccatgtccttcatacctcttcccttggttcactatagtattccatgtcagacctctccagcacctgctagtttgtgaatgaggttatccataccctcagctctttttcttgtagattaaacaacctcccctgcattaaaactgttctatcgcagtttaaggagactgggatgttaaagagtaaagatgttaaagaaaaccctttctgagccccaggtttctgttagcatgctacctgctagagccctgacactgagaaaggctatggtggtgggaatgacactctgtagagtttctgcagcctgaacctactgagatgatggcattctgaggggtttatcctacttgtgttctcacctgctgtaagcaaactgaatcttgggtaggaacactatgaaatgtgctctttaaattgccctgtctacactggtgataactgaacactctttgtgtctatagtttgtggtgggcaccgtttttcattttttttttatttttatttttttttagtatttattgatcattttaaatgtcatttaactttgtctatttttaggctctggcactttaagctggtaagagaaatagtataagaaattatttcattctaaaatttatttatttatttattgttgttgttgttgttgagacagagtctcgctctgtcacccaggctgaagtgccctggcataatctcggctcactgcagcctccacctcccgggttcaagtgattctcctgcctcagcctcccaggtagctgggattacaagcgcctgccactacactcagctgatttttgtacttttagtagtgccagggtttcaccatgttggccaggctggtctcaaactcctgatctcaggtgatccacccgcctcggcgtttcaaagtgctgagattacaggtgtgagccaccgcgcctggccctaaaatttattaagttacttcatgacactggctttcagtatccactggtcttatgttgctcttatgctttatttcttaaggatgattctgtttacagaaaggtcatcttttcactatatggtctcctctgttacttcatcttgctattgtaccagtttaagatatcttctgccctggctcgcaatccctctctatcctgactccagctctaaacatctgtgcaagttttggggccctgtgttgtactgaggtcactgaatagcagttctgtatttctcaattagacatttttctttgttctcctgtgctatcatacacagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataaggtaagtcctcaaaattgtttcgtttcatttttccaccaacacctgaaattaaaagtcttgatgtgtgagatgaagctttgcctataaactggatattagaatccaggactctgaagactaatgacaggtggataaagacttctctgaagataagactgggattaggggacctgttaatatttctttcccatgttctccttcccagagcattaaactgtagtctttacaataatgttcactgagaaaccttaagactttatcagttgttattatctatgctaagtgatcaaggacattgtgaggtctacatccatacacacatgatactaagtttatccctttgattattatctctactgtcataaaaatcacattatttttattttgaatgaagtattgtcctctgaggcttgagttctggttgtgacagtcagaataagaaataaattgactactcatggctggaaaacaaatgcagaaagtagataggacaatgttctgaccaaatgaaactaattcatcataaagaaatggaacaattgggaaatacgaatttggatgatacttggaaaatcaggtaatctaaatttgtcatttatatataaataacaaaaaaaaaaaatagagtacagagtgcttttcctgatatgttcctgtccaaattcataaccagttagcatgagacattccaccccgcaaaaaagcatctatcctctgctattgattcaagcaatttatctgatcaatacttcattacccattatatttgtttcctagaacaactcattaacctgcgttactttctgtacacagtcttttttttttttttgagacggagtctctgtcgcccaggttggagtgcagtggcgcgatctcggctcactgcaaccttcgcctcctgggttcaggcgattctcctgcctcagcttcccaagtagctgggactacaggcgtgtgccatcacgcctggctaatttttttgtatttttagtagagacggggtttcactatgttagccaggatggtcttggtctcctgacctcgtgatctgcccacctcggcctcccaaagtgctgggattacaggcatgagccattgcgcatggcctatatacacactcttaaagagatgattcttacaaatccagttctaggatgatgagtaatgagcaaaaagctggaatgtttgagctcaaggacttggtttcaggagggggtacaaatattggaagagactcagtaaatgcagaaagtagaaaaagtaattagagagttaccagaagcttgctttttcttacagattcctcataagtcactgaataaatagttgtagcagatatccattctttttgcatggggccagagacccagaaaggctatcagagatttcagcttcctctgtatcaaggtgctttgggaagcaaagctgccctgtaggtgaaagcagtagaaatttggaagaaaactcattgttctagaactgtcatagaaatatctcagatatgaaagacttaaacaaaaaggatattgagggacggctttctgcaaagatgtggcctaagatatgtgcatatctgtactaggagttgctgttgtgcatcttgtttaactctcttagaagggacttcagcctatatgtggttgttattaattacattctcaggaacagaatattaattttctgttacagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccaggtaagaattaaataggcaaatattagttttccaaagtggaaatgatttgctttaagttttggcaaaaacaagtttgtaggttttttttacagggttcagcgggaggcatgagaaaacagatattctccttgtattcacatttactttttttaattttttttttctggatggaatgatgtgataggatacaattttaaaaagaaagaaatctgaactttatcaaaaaaattgaactctgaattttatgtaaacttttaagtgattgtagggttgggatttaaaattacatgttctccatttgtgaattagaaaacgtcgtgtgtgtgtgtgtgtgtgtgtgtgtgatactttctagtttgtaacattacaatacacatatgtgtgtatttagtccataaaaatacctaatttgaaacttaaaattatttgcagtgatcaaaattatgtcccactgacaaagttttatacagaggaagctctccaatttgttaatttgaattcaaatattcacgtgttaagtttccttacagtacatgattttacgctgttgccattttgaatgttgtaaattattttttatttcagtaggtttttgggaaacaggtggtgcttcgttataggaataagttctttagtggtgatttctgactttttgatgcacccatcgtccaagcagcgtacactgtacccagtgtgtatgtagcattttatccctcacccccctcccactctttcccctgagtccccaaagtccattgtatcattcttatgcctttgtgtcctcatagcttacctcccacttatgagtgagaacatacaatgtttggttttcctctcctgagttacttcacttagaataatggtctccaattccatccaggttgctgtgaatgccgttattttgttcctttttatggatgagtaatagtattccacggtgtatacataccccatttctttatccatttgtttactgatgggcatctgggctggttccatatttttgcagttgtgaattgtgctgctgtaaacatgcatgtgcaatgatctttttttgtatactgacttcttttcctctgggtagatacccagtagtgggattgctggatcaaatggtagatctgctttttagttctttaaggaatctatacactgtttactatagtagttctactagtttacattcccaccagcggtgtagaagtgttccttttcaccacatcgatgccagcgtctgttttttaaaattttttgattatggccattcttgcacgagtaatgtggcatcattttgtggttttgatttgcatttccctgatcattagtgatgttgagcgtttttccttatgcttgttggccatttacatatcttcttttgagaattgtctattcatgtccttagcccttagccctttttttttttttttttttttttttgagacagagtcttgctcttttgcccaggcgggagtgcagtggcgctatctcggcttactgcaagctccgcctcccgggttcacgccattctcctgcctcagcctccagagtagctgggactacaggcgcccgccaccgcccccggctaaattttttgtatttttagtagagacggggtttcaccgtgttagccaggttggtctcgatttcctgacctcgtgatccgcccgcctcggcctcccaaagtgctgggattacaggcgtgagccaccgtgcccggcccttagcccactttttgatgggattatttgtatgtgcaatgcttgttccctggtgccataaataaatagcatttgaatatcaatttaattttttcagcaaggccatttttatactttttgtagaaagggtacactcgccagcggttttgccacaagagtatacggaacaaaggagacaggctcatttataatctgacgcggccaccctcctgctgcgttcggtttccattggctgggacgggacctcaccttctgtatttgtcccgactggctagcacttagaactttttaaaagaggcaaaggcataggagaacaaaggaaggaggaagtaacttgtggaatattgagaaaggtaaaaacacctttaaataaggaagaggaacaggctatgacctaatgcttgtttggatcagtataagcatgttagggcaaatatttaggctaaattgtgggagctaagaacataaagtatattgattttttattatggctagcagatatttaagaatgtttgtacaggtctttgaataaattttgcttttaagagaagttactatttatttctaattagatggggaggaaagtttttgaagaggaacctctactttttacaatttcccctcatttcataattcttctttaaacttgtttaatatgttttgacttaatttttttttgtccttttaagagaagtaatttttcagaatagggtggaggagaattaggagttaactctgcaagagtggcagagataagtttttgtataaaatttcaaaggcagggaataatataacagcctacaagaataagtacaccaataacaagagcaaacgaggtgagaattgaagttaaattttttttttatccgctgaaccaatgttttattattttagaaaaagagttatttattttagaatttttggcaagtttatcggatagggctgttaatccttgtagcacttttgttatagttctatcaggggcagtattaggaataaaggtataacattgagttttaattatgacacaaacttctttttttgctaatattatatttaaagctattttatttttctagaccatctggctggtaggtcctaattgcttagctttctctttgatggcgtcctcagtgtaatttatgaatcgttgctgattatagtagatatagtttatttagtctacttaaaaaaaatttatagttacttaacagaacaacatggatttaaactctgcagctatttgattttgtgctttaaacttatttggcacttctcataggaccttaatagcatttatgtaaacctaacgtttaaaggactcatgaggagtttcctttggcctgcagtgtcttgtttttacctttttttttttaggttggtgaaatgccagggtgcaggggatagccagttggattagagcataagtactgctccaattatttggcagagtgtctagtaaaagtcctctacaatatcaccatacatttgcttggggatggctaagcgtggactgatgggcaagctcttggaaaggcttgagctccttgcatccttttatgcttctaaggaacaccaaattttactcttgccgtgagaggcacaaagtaaacttggcattcagaggtggaagcaggcttgccctcgggggcggacccccggggtattgagtttcaggaaataacagatagagagctcagcatgatggattatcctaaactgtgggattttgcaagagagccaccatatgtccatttctggtcaatgaggagaccgtccgagtggaaaggggataatctggacctctgggctaccatgcgtacaagcgtgataataatttttatttaaagtgcgaagggaatatttaattcattccagccaggcatttgcatcttgatattttgtcttaatggctaaggtctgtcttagatgtcttatttttacaatagacaacctagttttattattagatgtaggggcaactggtgtgggatctagaaccgaggctactgaagaaggggaagatgggggaataatgcgtgttttaaaaacacctagggggtctttttcatttatgtcaatccccatgccatctaagcgaccaagggcaggtctagagttagttaaggtggaggtggtgataaagagaaggacagagttacattgataagggctgacagttagaaggggtagcccttttggtgaaatagatgaagggttttagatctgcacaaaccttttttgtggaagtctaactttgctcttgagtagtttaaaggatgtagtcccatttactacaaggttgccaggctgtaggagcagaaaatcgatgccttggctgcaggtgctcacaatgatgagtgctacgggtaattgtgtcaattagagggccgggacataaatatttgtgtgaaaaggctagctgtcgttaatctttttttatttccacaaagtatgagaaaacaagcattaaagacaatggtctaaggtgagttagacttagttatatttataacaaaggagctaataacaaaagaaaaaaatatataaaagatgtattaaaatgaagctttctttaacttagaagggcttaatcttagtacagtaacccataattctaacgaagaagatgttttcttgactcaaatatgatgggtccattctttctcagctgtgcggacggcagtctcagtggttaatacataaaatagggtccttcccaggctcgagtttttttttttaatcttttttcatcttttaataagaacatggttttcaggctggtgctggtgtactggaaattctaggggtggtacctgtgctaaaagacttttagttctgagggaaaagaaagtggaaaataagcatataatttttgttgcatatcctggggcttgaagccccatggtgacgcctcccgctccattcctgctcagcgccgcccaagggatgctgtggccctggcccctcttgaagtcttggccttcttgtggccttcaccacccccgcgtgctatggccttggggatgaggggcattgtgacttacctggccaccctcgggacttaaaaaaaaataaacaccattttatatttgactattttttgtataattttatactaaataagttaaattttacctttatattaatgtgctattaatgttaaatttaattttagtaaaatattgtagacattatttatccaattttaatgtctgaccataaagtaaaacttttatagactcattttaattttttatatttgtttttttcttgatgatttgcttgagttcctcatagattctggatattagtcctttgtcagatgcatagtttgtgaatattttctcccactctgtgggttgtctgtttactgattatttcccttgctacgcagaagctttttagcttaattaagttccatctattcatctttgtttttgttgcatttgcttttgggttcttagtcctgaagtctctgcctaagccactctctagaaggtttttccgatattatcttctagaatctttatggtttctggtcttagatttaagttcttgatccatcttgagttgatttttgtataaggtgagagatgaggatccagtttcattcttctacttgtagcttgccaattatcccagcaccatttgttgaataggatgtcctttccccactttgtgtttttgtttgctttgtcaaagatcagttggctgtaagtatttgggtttatttttgggttctctattctgttccattggtctatatgcctatttttatacccagaaccatgctattttggtgactatggccttatagtatactttgaagtcaggtaatatgatgcttcctgatttcttccttttgttctttttccttagttttgctttggctatgtggtctgttttttggttccatatgaattttaggatttttttttctagttctgtgaagaatgatgttggtatttggatgggaattgcattgaatttgtagattgcttttggcagtatggtcattttctttatttctttctttttttttttttttgagacgaagtctcgctcttgtcccccaggcctggagtgcaatggcgcgatcttggctcactgcaacctctgtctcctgggttcaagcgattctcctgcctcagcctctcgagtagctgggattacaggtgcttgccaccacgcctggctaatttttgtatctttagtagagatggggtttcaccgtgctggccaggctggtctcaaactcctgacctcaggtgatccacctggcttggcctcccaaagtgctaagattacaggtgtgagccactgcgcccggccaatatggtcattttcacgatattgattctacccatccccgagcataggatgtgtttccatttgtttgcgtcgtctatgatttctttcagcagtgtttttagttttcctttagaggtctttcacctccttggttagatatattcctaagtgttttattttatttattttattatttgcagctattgtgaaaatggttgagttcttgatttcattcttagcttggttgctggccgtgtatagcagagctactgattttcatgctttaattttgtatcctgaaactttgcttgaaactttgctgaattcatttaccaattctaggagctttttgaatgagtctttagggttttctaggtatacaatcatatcatcagcaaacagcaacagtttgacttcctctttgccgatttggatttcctttatttcttttgtctgattacctggctaggacttccattactatgttgaatagaagtggtgagagtaggcatccttgtcttgttccaatgcttagggggaatgctttcaatttttccccgaccagtataatgttgtctgtgggtttgtcatagacggcttttattaccttaaggtatatcacttctatgccaatattgctgagggttttaatcataaagtgatgctggattttgtcaaatgctttttttttgcgtctacttagatgatccggtgatttttgtttttaattatatttgtgtggtatatcacatttattgacttgtgtatgttaaaccatccctgcgtccctggtatgaaaccgacttgatcatggtgcattatcttgacatgctgttggattctgttagctagtattttgttgaagatttttgcatctatgttcatcagggatattggtctgtagtttttttgttgttgttgttatgtcctttcctgcttttggtattagggtgatactggcttcatagaatgatttagggaggattctctctttctctatcttgtgaaataatgtcaataagactggtaccaattattctttgaatgtctgatagaatttagctgtgattccatctggtcctgggcttttctttattggaaattattttttgttaccatttcaatatcactgcttattatcactctgttcagagtttctatatcttcctggtttaacccaggagggttgtatattttcaggttttctactttatgcacataaagatgttcatagttgcattgaatgatcttttgtatttgtgtgatatcagttgtaatatttatcattttgtttttaattgaacttattttgatcttctctcttcttttctttgataatttcactaacggtctatgaattttgtttattttttcaaagaaccagctttatgtttcatttatcttttgtgttgttctttgtctgtcacaatttcatttagttctgctttgatctttgttatttcttttcttctgctgcattcgtgtttggtttgttcttgtttctctggttccttgagatgtgaccctattatctatttgtactctttcagactttttgatgtaggcatttaatgctatgaactttcttcttagcatcacctttgttgtatctcagaggttttataggttgtttctctattatcattcatttcaaagcattttttagtttccattttgatttcattattgactctatgatcatacgggagcaggttatttaatttccatgtatttgcatggttttaaggttgcttacagttgagttccaattttattccactgtagtctgagagagtacttgatataatttcaattttttttttaaatttttgagacttgttttgtggcctattatatggcctatcttggagaatgttccatgtgatgatgaaaagaatgtatattctgcagttgttgggtagaatgttctgtaaatatctgttaagtccatttgttgtagggtatagtttaagtccaaaaatttttgtttgttgactttctgtcttgttggactgtctagtgctttcagtggagtattgaagtcaaccagtattattgtgttgccatctgtcttatttcttaggttcagtagtaattgttttataaatttgggagctccagtgttaggattgtgacattttcctattggactagttcttttagcattatgtaatgtccctttttgtcttttttaactgctgttgctttaaagtttgttttttggtgtccatttgcatagtatatctttttctacccctttaccttatgtttatatgaaaccttatgtttatgtgaggccttatgtgttaggtgagtctcttaaagacagtaaacacttggttggtgaattcttattcattttgctgttctgtatgctttaagtggagcattttggccatttatattcaatgttagtattgagatgtgaggtcctattttattcatcatgccatttgctgcctaaataccttacttttttattactgtgttattgttttataagtcctatgagatttatgctttaaatgttttatgttctattttggtgtatttcgaggattcatttcaagatttagagctctttttagcagttcttgtaatgctggcttggtagtggctaactctctcagcatttgtttgtctgaaagagacttgatctttcatttatgaagcttagttcactggatacacattctcggctgataattgttttgtttaaggaggctaaagatagtactccaaacctttctagcttgtaggatttctgttgagaaatctgcttttaatctgataggttcctttataaattacctgatactttgcttcacagctcttaaaattcttttctccgtcttgactttagagagcctggtgactatgtgcctaggcgatgatctttctccagggtgttccctgggtgttctttgagcttctcgtatttggatgtctagatctctaggaaagccagggaagttttcctcaattaatccctcaaatatgtttttcaaacctttagatttgtcttcttcctcgggaacaccagttattcttaggtttggttgtttaacataatcccaaacttcttggaggctttgttcagttttttttttttttttgagacacactttagctcttgttgcccaggctggagtgcaatggggcgatctcggaacactgcaacctccacctcccaggttcaagcaattctcctggcttagcctcccaagtagctgggattacaggtgcctgccaccacgcccagctaattttttgtatttttagtagagccagggtttcactatgttggccaggctggtctcgtactcctgacctcaggcgatccacctgcctcagcctcccaaagtgctgggattacaggcatgagccaccatgcccggcagctttgttcatttttaattcatttttcttcatctttgtcagattgagttaattcacaagccttgtcttcaagctctgaagttctttcttctacttgtttgattctattgctaagactttccagtgtgttttgcatttctccaagtgtgttcttcatttccagaagttgtgatttttttttatgctctctatttttttggagatttttccatccatatcctgtaacattttttaaatttctttaagttggtattcatccttctctggtgcctccttgggtagtttaataatccaccttctgaattcttttctggcaattcagagatttcttcttgggttggatccactgctggtaaggtagtgtgatcttttggggctgttaaagaaccttgttttgacatattaccaggattgtttttcttcttccttctcatttgggtacactatatcagaggaaacatctgggactcaagggctgctgttaggattttttttgtcccacagggtgctcccttgatgtggtgctctcccccttctccaaaggatggggcttcctgagagctgaactacagtgattgtcaacacccagcagagctactgtgctccaggctccaggctggtactgggtagtgtctgcaaagagtcctgtgatgtggttcgtcttcaggtctcatccatggatatcagtacctgctcctgtggaggtggcagggcagtgaagtgaactccatgagggtccttggttttaattttgtttattgggataattttgtgttggttgtcctccagccaggaggtggagcttttaagagagcatcagctgcaatagtatagggaggatacaagcttgccctagggtcacttgaaataggatttgagtttctcaggtggtgggtgggggggggccacagagctcccaagagattatgtcctttgtcttctggctaccagggcaggtagagaaagaccatcaggtgggggcagggttaggtgtgtctgagctcagattccccttggacagggaaagctgatgctgctgtgggggatggggtgtgattctcaggccaatggaggtatattcccaagggaattatggctgcctctgctgtgtcatgcaagttgccaggcaagttggggaaagctggtagttacaggcctcatccagttcccacacagcctgaaaggccagtctcactcccaccatcacccaccaacaacgctgagtttatttccaggcagcaagtgagcagagctgagaacttgctaccagcctccctgctgagaaagcaagcagggttttcagagttcaagcctccctgcctgctgtggcttctgtgctggtgtctgcactcccagatcacccccacccctgggttctgtccaggaaattttgtgttcggtcgaaacttcagctggaagttttcttctccctgtggtatttccccaattctactggcagccctcctgaaggacctttgtgagacaaagtcagtaatggcttccctggggactgagagagcccacagggctcttcccgctgcttcctctacccctgtatttcgctcagctctctaaattcaccttagctccaggtaaggtcaaatccttcacttgtgatccagaccttcaggttccccagtgaggatgtatgttcaggggtggatgatcccctttcacactttcacactttgggcactcacagtttttctgctgtctcctggagcctgcagcagcaatccgctttttttcaaatgtgccattttgaatattccactcacatttaaatggaaaagcctattaagatatattaggagaatgatgttcttcataggcttcaaaaggatataaaactcgtggtaaataataaaatatttgaagaaattaggagggtggggaaccaatataatgcagtggccaaaagcaaggactttggaataggatagacttgttctacatctggcacatttgtttcctgatattgggaaaaatagcttttaaatatttctcataagattggtttaaaaattaaatgagataatggaaaaatatttcttattccattgccttgtacattatgggaaatcaatgtgcaataggtcctattgctcttagcaagataaagacaaacactggaaagatttctagggagagaaaatgtcacatgcaaatgttaaaatgtgaaacagcatagtgagttctgtataaattggtatatgtagaaaggtataggaaaatgatgcaagacaggtaaaaagcagccctccaacaagctggcttttgtcataaagacagaaatggagtctccaatgtaaaaacatcagtaagtagatattgaaagattttaggaagaagagtacttgatcattccacattttagcaaaaaaaaaattctgacaattgcctggagggatacattagagagagaccatgtttggaagtaatgagacctattagaatctaataaaggatgatattctcacaaatgaaaagatgttgtgcttcctctaatattgaaaaccattaaacagaaaacgaatactttcagataaagaaaaaaacaaacccgagaaacaatgaccccaagagcatgaagctaccccaggaacagagtcagcttccaaatccttcagaggccagcacaaccttccctgagagccatcttcggactcctcagatgccaccaacaactccatccagcagtttcttcaccaaggtacaatttcctgggtcccatgcctcatgtctccccaccataatttacagggatcattagactgttgaaagagctgctgctgtaatctctgtgaatgtacaatcttggtatgaaattatgtcactcaatcatttattgaattcatacagtgagatagcaccacatcataatctttactatctaaaaggcattcatttatataatgatttctaactttaagaggattactatcttgtattgctccagttgtagagagggtaagagagagtggccagacaagcagagacgaagacaagaatgcgttcagatcctacattcccgtttcttttacccatttcccctttgcttattagtaatatttctgattttattttcatagttccaagttcctacccccattacatattttgacacatggtattttcttgatgggtatctgtttctcctatgtcatcactggtgagaatctccttaaattttacatgccaacttaaatgttttcctctggcaagttctcgctgatacaagatactggaactgatgagtcctcccattctttgctttcacagggtctcctgtcaatgagattaaattactaatttcatagaagtgaacagagagacttactttataatgtgttccccatacttccttgatctgaggttttccttaacagggtcagcatagctcaggttatatctgtagaccagagcaaacctacaaattcagcctagaacatggaacaacaatgacaataattatatttccactttttgagcacttaactagacgttggttcttacgtgttgttcctgatgtacgttatctcattctttcttcataaccatcaggaggatgctaattctgccccaattcacagagaagaaaatagaggtacagaaaggttaaaaatcttcctcaggctttcaaagaaagttagagtcatgattcatatccagtcttatttaaacctaaaacgtgaaaaattaatgattatatatggctttagattaggagtttatatatgccatgtcagtaatttatttattagtcgcgtaacagttacatagcccacgctttgcaaaccttctgataacaaatgtggccagtggtgatcagagtgtgttctaataagtaaaccaccctccagaagtagaatcctttcattcgcctctctaacagagtgcattttctatattaaatatctgaatgacagaagtggtagaactatggaaattaaactaatattaataaataacaaaaaaggttaaaaatagtcaaaataaaggaagttatacttccttacccttggtaaagagtatttttaaaaaatcacttacttggtaatgccaaggtaagttcttcaatatttctaaatacatttgagaaccttgaaggattctagctggctgatgcagactacaaaacagcagaattctgcatctggaattgtggattttaaagaatctttctagcaaagtgatgatcaaaacatgtaaagcaacataaggctggttttcctggagcctgaagagctgcaggaaagagaaagagtaatttaatcaagtaaaatttatgtgattaaatttctcactattaattaagtatattcattgagaccctactagtctctgtgtcttttgatatttataaggtatgcgttcatgaagtgcttcctgactcaagaggattactgtcttttgttgatccaggtgtagagagagattgtggggaagtagccagatggaggaagatgaatacaagaatatgttcattatctttattccaattacctttcatcctttcactttgttcatgaccacattccaggttttattttaaaatatcgatggtcttttccaaatgagaagctttgacatatagattgcttcctttgctgggatcactttctccagtctcttcttgaacccaactctccacaggccccagcctaaatcccttcctagagcaagtcctcactggcaaccacgtttcagattaggtgagatcctcccgtagttggttctctctggtcctctctttgtgagctttcctagctccctttatttttcctaatagcatttaaacaattggggtgtgggagtaattttctccttttatataccataagctcagatggtaggtagcgtctaccccagaggaacagaatacaagaggggaaaaagtcagttcatgctatgtgcatcaattcttattccagattaccttttgctcagcagtgatatgacccttgtagtcacctgcactgagggttcagaagcctgtacctgtggtgaaggggcaggaaacttggaggaaaagcagaaggattaaatcattattttttacagttgcttcttacccaagccccaagctgtattctgacccagcagcagatacttccagccaccatgtacacatcctggaagagaagcttcctatatttaaggattctctattttgatttttttttggtttgttttcattgttgtaatttttagctagcttcagaaagctgtatttccctccatagtttatgcaggtgttgtttgaagaacagaacctgtgtctttttgccatcttggcacaggtggctgtggaaggagcccttgctcagtcattgcaacctaagatccattttctttgtgccttttcagtgacttaagtggcatctccaaacaactatgcttttatcactcatatttctttgaaaggattatgtgagaatttctaagtcccacctgctaaaatatgaatcacaacccttgctacagctgtacaaatgattgtgctgtatgtgaacttccctggagcacaggaatcccaggaggattatatgccttcatggcctcatgcacctaaacacactacgcagccatttattcttgggtgtccactatcgtctgtaaatacagttgtctgtctaactactttcctagtgactccccagatgagtatagtcttgttccactgatcatagggtttcccaaagattttctctatggtatacgctctatattcattgagatttaaaacaaacaggctattcttatcattgattttttttttctgttctgtacacctaaagcaagaaacacaaattgacatgaatcaggagcagggatgggaggggagataattgctctaagaaaaaaaattacgtagtgatttaaaatattattcaaccaaagattacatttctctcatctaaattctactctggttatgggactgttttatttaaatgaatttgagaagataatactccaaggtactctcgtgaataagtggcagaaatgaatagagaagtctctttaataaaaagcttcccataccaactcgatctagggtttctgtcaacaaggtaaacagaatatgagacggcagttaatcagaacacacatacaaatccctgcagagacagtgtaacaacagtaacataaatcggatttctacttcgtaagcacttactaggtgctggttttaaaatctgtattctttatgtatattgttgcattctttcctcataacagtcatgattgatgctattctcagcctcattttacataagagacaaccaagataaatacagttttaaaatatttctcaaaattcacaaagacagtgagtgtgctaaatgtaaattatgtgcactttatgtagtttttcttattcattcttccttacatcacccagatgatgttattgtcagtcacatttcacatttctaaacaccaaggatcttagaggttaaaactttactcaagctgataatgatttttagtgttagagccaagattcaaatccagccttaatgaactctaaagcttgagcatttaatgatcatatactgcttccaaagtcagaatatagatgttgaactgtctcatatatttacacatatttaaaattagacattgtttttgtttgggtttgttttcataatctagtctctgcaaggctcctaatgaaaaatcaggtgctgtaagtctctgtatcatcctatgttttacattgccacgttaagacccctgtgttcatctgcacccaataatcagatgctgtatcttcagtgtaagtcaaaagaaaaactagatgacaattttccaagttagtgtctcatctaggtgccaactgcactgtgaccacactgttttctaatcactcatccatgtgtaccagttgaagacaggcctcccatgtacagagttctcaatttttcatgttgttttgttgttgttattgtcctgtttgactggtaaattccaaaattctatactttctaagagttttatatgtcgtatagagctacctatcatgactgtttgccatcttgcttcaggtggatagacagaggctatgcctagtgaagtcattatctgctctgatcttctctgctatttcaaggacaaaattggacatcccaggacagtcagttttctgacgcataatgacttgaaagaaagttaatgacagtttcaaagttcccaattgcctaaatatgtgatacagcaatttctgcagccataggaatcattatgctgtgcctaaagaccctaggacagggattctagaaagaggcacgtgtctccatggccgccgatgcttaataacacagtgcattacttctgctttggtgaccagcccaaaggttgtctcaccactcactctaagattcaccagctgagcaggaaagccttgtccttactcatcatggtttctcccgaagattttgtatatgatatgcgttcattgtgcttttggattcaaaacctgaagaagacagaagcatgactttaagtcacgactcctctaaagcatagatcatataatgcctgaatcatgatcgggtatggtagcagggattatttactatgagaaaaacaatcagctactatattaaaatattactcaacgaaatctacaatctgctgaaatccaaattctgatcatctaaattctgctgaaataatgagaatatttgtttcaacttattttgaaaagaaaattactcaagacagttttatcaatgctattaggctgccacattgtagaagggaataaagaggcttttttgataatcttcctataccccctcaatcaggagctccctacaactgggtcaacataaagcattaaatatctttaaatagggcagacattaaaaaaaatgcacagaacataaaataacaataaaaatattgttctgcttattgaggatttattggatgctggtctgtaaaaactgtgtttgttacaaaattatgccatatattcgtcattgtatctccataaagataaaattttcatctcatttcacatatgagattcatgagatacaaagaggttaaaaataccattcaggctaataaaaataattagtgttagagtaaggattcatatctagttttagtcaagtaaaaaactttggtaatcatgcaaatatgtttcttccagtatgggacagtatatattaaaattctgtcatatatccataaatattcatatatgtagtgttgaattttgcatttgttttcataatccagatgccacaagccataataaggtgcataacgggcctatagggttgggtgttcgaaaccataacaagcaggttttatagcccttttttcaatctatttaaagaccagagaaatatattttatagacgggtctctatatattggagatgggtctcactctgtcacctaggctggagtgcagtggcgcaatcaaagctcactgcaacctcagacacctgagctcaagggatcctcctgcctcagcctctcaagtagatgggactaaaggtgcacgctaccaggcctggctaattttttaaaatgttttgtagagatgaggtctcgctatattgcccaggctgatcttgaactcttggcctcaagtgattctcctgcctcagcctcctgagttgctggggttacatgcacaagccactgcatgcagcttaaatgttcttaaagtctttcattagtgacattaggggaagtcacacatgattttccagacaccctctatcctttctttaacaaggtataaaaagacaggtgctgggaatgccctagtgcaatttggaatgatcctaattactgttgggaatcctgaaggattctgaatatctgatgcacacacaccacaggaccaacagaatcccgcccctggaactgtgctttcagggaatgcttccagcaaagggaggatcagtatgcccaaacagccaacacgtgagtttcctggaacctgaagtgcaaattacaggagtcagtttgtgtatttgcttgatgagaatggcttctatcactttggttaatgttgttctaaaatttgctgcccttataaactgagagggttatttaacaaaaataacctcaatggaggggcttaaccaagttggcctagatggattttcagcagaaatagagccaggactcaatcacacaccaataaaatttcaaccaacaggatgaaggctataatactggtttgtgagtgtacagttgaaggagttaggatatctaaattgacactcttcttccatagaaaataccagagagatgacagtgagaacagaataaaaggaaaaataagaaaaccaaacctatatagatacagacatggatacattaggtttttgtttgtttgtttgagatagagtctcgctgtcacccaggatggagtgcagtggcataatctcagctcactgcaacctgtgcctcccgggttcaggtgattatcctgcctcagcctcccaagtagctgggactacaggtgtgcaccaccatgccaggccaatttttgtatttttagtagagacggggtttaaccatgttggccagactggtcttgaactcctcacctcaggcaatcctcccgcctcggcctcccaaagtgttgggattacaggtgtgagccactgtgcctggccgggttctatctcattccgaaaaccacaagacagaaaagactcaatcttttcctgagaacctggaggccagaatcaccccagttgatgacttcaatagaataaagtcttctcaagacttgaaactgcatctgcaaacttctggcttcagaaaacctccaggagtgagccatcctcagacttcacagaaaattacataaaccccatccagccatttcttagccaaatcactagcttactattatcatcctttgtgcctcttcaaaggtgtatttgcattgtataatgcaataggaaccattgctgaagaggtacaaattagtacagacattttgaaaaccaatttggtgctatcttaaacctgaaaacatgcatactttaccaatgctgcaaatccaactgggcatatgaataaataaaatgtatacaaatagtcacagcagcatcatgtgaactggaaaaatcttggaagaacccatgacgtatgtcaagagaatgggtaaattagggaacatgatgttgaattgaaattaaataagctgcagatgcatgcatcacagatgcatatgaagcatataataattggaaaaagcaaatcacagtaaattttaaatagtataataacatttttgtaagctctgaaactaataaaactaaatatcatattgcttaagaataaatgccttgtgtggtaaaagctatttttagagctattcatcatgattcaagactgtccttacctctgggagctaaagctgatagaggatgagttcagagagaagcatgttggtaatcttttctttcttaaattgtttgagtgttttcatagctactcatgctacgaagtatgtagttttaaacactgaacaaaaagttttatgttctaaatttagaaatatactcctttcaataagattccattaatacatgtggcatacttaaatagagaaacatttttaatgaaacgattttcatctcaccttgatctggggtatccatcaacagagtcaacataaagcatggaaaatgtgtgcatcaggcagaaattcaaatcctgcacaggccattattaacaatggcaataattatatttttgcttgttgggcatttactagggtctaggctctaaacttattagctatgtatattatgtaacttattcttcattacaaccccataaatatgatattgtcagtctcaattcacatatgagaacactagcgttcatagttttggaataatgtttctaccagtgtgagagagaagatttaaattgtctccagtatatttacatgtgtgtgtacactaacatttcagaatagacagtgtcaggcttgggtttgtttaatagcctgaactctgcagcctttcagtgatggaggaggtccacgagagtggccagaggctgttctcatcagagagccacagcactgcagcaggctcctgcagccctctcacctaccactttttcagctaacggtgcgatagaattatattagtgaaagccagaagtgagaaaaacagtgacaaatggacatcacatgtaaatggttagaaatgggttttcactattataattaatggtattcaaagtatatgattttgcagacactctctgtcctcacttgaacaaagtgtaagaagccagctactgggaattccccaggtggaacgtggaacccctgtgattacgattgagaatcttgacgatttcagtttgcctcatatagacagcaagggcaacataatcctgactctggaactgtagctttgagaggatcctcgcagcaaagatcagtttgctgaacaaaaagatggagaggttggtgtactagagcctgaagagcagataactattacctgtatgtgtactcatttgatgagacaggtttacttataaatactcctcagtttggctgattttactctgagtcatgcccccctcatcaccaggaagagttatctaccagaaaatgacattaagtggtctcagatcagcatacaacacagatagatccaagaatctaaggccagtgaaagaaacttcagtcatctgaatcttgaccatttcagaccgaagactataatcctggtcctgtgtaggctgaaatgtgggctgaggaaactaaagttatgtcagtatctagacacattagcagagggaagagcctataaaaagggggattttgaaaaaatcatatatggagcccatacctactcgttaatagttcagacccatttttttgtcttctacttcaaagacgtaagtgaatattcctggaaaattctgatttctcctacatactggcttaaaagggacatgtgatgttttcttagctccaacccttctaaataagcaatgtgtccatttctgtagccataggagttattctgctgcacctaaacctcccttagcttagtaatctcagccaggatcatatgtcttctacctccggtacagccattttccctctggtgtccagccagccccataggaggcaaaacctgtctgactaccctctatatgatccagtagctctgcaggaaagctttattcttattgatgataggttctctcacaaattttgtgtgtgatatggattattcctggttttgattggaaacccaaagcataacaattttatatttgatatcttctgccatgtctcccttaaaataaacaacacaaaatgatttgaagtatgaataggaataattgctattttttcctgaataataaatcccccagtattactataccaatgtgttcatcctctatattccagtttctttgcgatcctttctccttcgctctctcaccatacatcagagtttagtttccgtatccatgctcttaaccacatcgggggtttggatacttcttttgatgtcaattttttccatctcagttctgtccccagatatcttcaaccacaaggtaccagtctaatctattccttgagcaagttctcactaataccctcctcccagaatagatcatattttctcattgtttgccttcataggtacctttctatttctttagagcatttatcatagctataataaacctatgactttcttccctactcagcaataaatgtaggttatagataccctttcctaggggaagacaacacaggggtgggaaagtgagtttacacttgtgtgttgtcaacacttatcccagcttgccttttgttctgccctgatatcactccctgtgttacctacaatccagcgttatggggcctatacccaaggcaaatgggcagggaaggtatgggcagggaaatactgacccatggcaacttgagggatagggaacactaagatttacattactattctccaatatcatttctcacccaagccccaagctgcccccggcccaggttgcagacctgagcaccatcacacatgtcagttgaggacaggctttctacatgtgggttttctcaattttttagacagtcatttttttggttattaatttcaagatttcatatttccccctatatagtctttcctggttcttcttgggcagaactagctgcttgtaactgttgccatcttgggacttaccatcaaggccacaggtagagcccatgtgtagtcatgaaaatctcaggcccactgtctctctgttactgcaatgacatacatagacatcataagacaactactctgtccatgcatactggcttggaagtgacactttctaagaccttgcctgcctaaatatgcagcacaatcatttctacttgcataggaatcattctgctgctctgaaagcacaagatccaaggcagactcatccacctaaacatacaccacgtagtcatttcttctctgggatccagccatcttcacaggaggcctgcaaaaatggtgtctgaccaatcagtctgtgattcgcaacgtaagccgggaatccttgctcttatacatcacagcttctcccaagtagtttttctataatagagttctttctgactttttaattcaaagccggaaacagactattacctttgatttatgctgttacgtatcctgaagtgaacagtacacaagggcataattcatgaacagggtagggtggaggaggatttattctgagggaaaacaaatgcttgcacttttaaaatattattcaaacaaagattataatttcatcatccaaactgggctattgtgatgacagtttaagatttcacttatttttaaaagattatatctcaagacaatcttgtcaataaaattacattgctacacatggcagatctgaagagaggggcttctctcctattatgcttcctatattacctccatacaaggtttccatcaacaagggcatcataaagcatgaaatatctgttcaccggagcagacatgcaaacccctaatagatcgtggaaaaataatagcaacaaagatttatttattgagcatttactgagctctggactctaaaacccattctttgtgcacattacctaaattattctttataacaccataaaaaaatgctatggctagtcccatctcacatgtgggaaaactgaggtgcaaagaaatcttcctcagggtcacacagatagtattagagtcaggattcaaatgcagccttattgaacttaaaatgttaacatttaaaatgtgaacctttaatgagcatagactgaatccacagtaggtgtgcaaatgttaaaatgtctgcagtttatttttaaacaattttgaaaatacagtgttttgtttggggtttatttccatagtccaggtgctcagtggtggtcagagactgttctaatcaagaagctgttctccatgtgagctcactacaagcagttcttttgtgtacctctctatcaacaattgccacttaaaaaattaggttactgaatgggaaaactgctaaaaaaaagtgccacattggccaaataggatgaatattttttggacttccattggtttaattaaaagtagtcaaggtatgtgattttagagatattccccaattttacttgaaaaatgtataaaaatatagctaatgggaatgctttaggtggaatattaaattcttctgaatacagctaaaaactctgaaagattctgattgcctgatccatactgtagtgatcatagaaccttccctgaggaattgtgaatttgagagaatcttcttgttatggctacgatcagagatccctaaaggatggagatctgggtttcttgtatgctgaagagcacttgagagagactggtttgtgtatctaattgatgagaaaggcctagttaataaatgtccataaatgtagccaactttattgcaagccatgctgcccccaaaatagccctaagagttgtacctgaccaaataactcagtccagttttacaggatgtgaagactgagtattccatccccagacaatgcaatttcagttatctgagtttttaatcctgactgggatgagagaaggctgagtgatagaagtatctgaatatgtggtattattcctcctgcaactcagggaaaaacagagaaactggcaaagtgaacatcctatttaaaaaagaaaaaaggaaaagatgtgtttcatctgatcttgaaaaacattaactagaaaaaaagaacaaacatctattttcctttagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacggtacaagttccctcttcccaatacattcccctcactacaatgtaatgacaaggattaacacaaccttgaaagcacctcaccaatcccctactacatacaatgctttaatttaaccaaatcagtcatttatttatcaagtgtgtattttgaggtcctatccaaaattaaaattctatttttatcatctctattccatagcaggtataattagatatctttttaattttattttccttttggcttacctttttgtttttccctcaatacaccacgaaaataatactttaaggtagaacaaggtgggaaaaaacagagccaaccataacactatcactgattctttctctttcatttattataactcaaataataccatctttaaaaatttaggaaaagaaggtacataagcaaaaataattaatttttaactatcagaaatctttatctaatgccacatttcagtacatggtctttctgactttacacctttcattatgtatatacaaagagtcttattatattctctcagagtaaatcacattacgcatatttttctataactcatgctttttattaatatatcttgaactgccattcaaccatacaatatagatttaaattactttattgtaccagaaaaattgcatggttattccatacattataaaatgatcctacattatttggcttatgttgtttctagtattctgtgaatttacaatgaacataataagaacaaatgtctctcagatcttctttcattaccctcagagtagctttataattatttccttaggtcctgtgcaccttgtgtcagggtactaatgtcatggctattgtaaggtgatttgatactgattaacttcattgggaacgggtttcctaatgttatggaaaattggccacattgatgagttttgtgtgtgatatgcgttattcctggttttgatttgaaaaccagaaggataacatttttatatttgatatcttctaccatgtctccctttaaataaacaacatacaatgatttgagatatgaacaggaataattgctattttttcctgaataacaattccaccagtattattattaccaatatgttcatcctctacattccagtttctttgcaatcctttctcttttgctctctcaccatacatcagaggttagtttcactatccatgctcttaaccacatcaagggttttgatacttcctttgatatcaaatttttccgtctcaattctgtccccaaataagttcaaccacgaggtaccagtctcatctattccttgagcaagttctcactaataccctcctcccagaatagatcatattttctcattgtttgccttcataggtacctttctatttctttagagcatttatcatagctataataaacctatgactttcttccctactcagcaataaatgtaggttatagataccctttcctaggagaagataacacagaggtgggaaagtgaatttacacttgtgtgttatcaacccttatcccagcttgccttttgttctgccctgatacctctgtatgacctacaatccagcgctatggggcctacacccaagacgaatgggcagggaaggtatgggcagggaaatactgacccacggcaacttgagggataggaaacactaagatttacattactattctccaatgttgtttctcacccaagccccaagctgcccccggcccaggttgcggacccgagcaccatccacacacgtcagttgagaacaggctttctacatacaggttttctcaattttttagacagtctttttttttagttattaatttcaagatttcatatttccccctatatagtctttcctggttcttcttgggcagaactagctgcttgtaactgttgccatcttgggacttaccatcaaggccacaggtagagcccatgtgtagtcatgaaaatctcaggcccactgtctctctgttactgcaatgacatacatagacatcataagacaactactctgtccatgcatactggcttggaagtgacactttctaagaccttgcctgcctaaatatgcagcacaatcatttctacttgcataggaatcattctgctgctctgaaagcacaagatccaaggcagactcatccacctaaacatacaccacgtagtcatttcttctctgggatccagccatcttcacaggaggcctgcaaaaatggtgtctgaccaatcagtctgtgattcgcaacgtaagccgggaatccttgctcttatacatcacagcttctcccaagtagtttttctataatagagttctttctgactttttaattcaaagccggaaacagactattacctttgatttatgctgttacgtatcctgaagtgaacagtacacaagggcataattcatgaacagggtagggtggaggaggatttattctgagggaaaacaaatgcttgcacttttaaaatattattcaaacaaagattataatttcatcatccaaactgggctattgtgatgacagtttaagatttcacttatttttaaaagattatatctcaagacaatcttgtcaataaaattacattgctacacatggcagatctgaagagaggggcttctctcctattatgcttcctatattacctccatacaagatttccatcagcaagggcatcataaagcatgaaatatctgttcatcagagcagacacgcaaacccctaatagatcgtggaaaaataatagcaacaaagatttatttattgagcatttactgagctctggactctaaaacccattctttgtgcacattacctaatttattctttataacaccatacaaaaatgctatggctagtcccacttcacatgtgagaaaactgagatgcaaagaaatcttcctcagggtcacacaaatagtattagagtcaggattcaaatgcagccttattgaacttaaaatgttaacatttaaaatgtgaacctttaatgagcatagactgaatccacagtaggtgtgcaaatgttaaacaattttgaaaatacagtgttttgtttggggtttatttccatagtccaggtgctcagtggtgctcagagactgttctaatcaagaagctgttctccatgtgagctcactacaagcagttcttttgtgtacctctctatcaacaattgccacttaaaaaattaggttactgaatggcaaaactgctaaaataatgtgccacattggccaaatagggtgaatattttttggacttccattagtttaattaaaggtagtcaaggtatgtgattttagagatattctccagtcttacttgaaaaatgtataaaaatatagctaatgggaatgctttaggtggaatattaaattgttctgaatacagctaaaaaccctgaaagattctgatagcctgatccacactgtagtgatcatagaaccttccctgaggaattgtgaatttgagagaatcttcctgttatggctacgatcagagatccctaaaggatggagatctgggtttcttgtatgctgaagagcacttgagagagactggtttgtgtatctaattgatgagaaaggcctagttaataaatgtccataaatgtagccaactttattgcaagccatgctgcccccaaaatagccctaagagttgtacctgaccaaataactcagtccagttttacaggatgtgaagactgagtattccatccccagacaatgcaatttcagttatctgagtttttaatcctgactgggatgagagaaggctgagtgatagaagtatctgaatatgtggtattattcctcctgcaactcagggaaaaacagagaaactggcaaagtgaacatcctatttaaaaaagaaaaaaggaaaagatgtgtttcatctgatcttgaaaaacattaactagaaaaaaagaacaaacatctattttcctttagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacggtacaagttccctcttcccaatacattcccctcgctactatataatgacaaggattaacacaaccgtgaaagcacctcaccaatcccctactacatacaatgctttaatttaaccaaatcagtcatttatttatcaagtgtgtattttgaggtcctatccaaaattaaaattctgtttttatcatctctattccataacaggtataattagatgtttgtttaattttatttttcttttggcttacgtttttgtttttccctcaatacatcatgaaaatcataccttaaagtagaacaaggtgggaaaaaacagagccacccataacactatcactgatttttcccctttcatttattataactcaaacaatatgtttaaaaatttaggaaaggaaggtacataagcaaaaataacttttaactgtcagaaatctctatctaatgccacatttcagtacatggtctttctgattttatacctttcagtatgtatatacaaagagtcttattttctctcagagtaaatcacattcacatatttttccataacccatgttttttattaatatatcgtgaactgccatgcaatcatacaatatagatttaaattattttattgtactagaaaaattgcacagttattccatacattataaaaatgatcattttttatttggctttatgttgtttccagtattctgtgtatttacaacgaacataataagatcacatgtctctcagatcttctttcattgccctcagagtagctttataattatttccttaggttctgtgcaccttgtgtcagggtactgatgtcatggctattgtgaggtgatttgatactgattaacttcattgggaatgggtttcctaatgttatggaaaattggccacattgatgagttcattagagttaagtccatcagagttaaagccatcactcacaggtggccaatatcatcttccaggtcagatcacattgctggtctgtggaggcagccgtcctgcctccatgttctggtctctaagactcccttgatcccttcttgcctccatacctcctcttccagatcagcagcccctccaagtcaaagtgctctcctacaactcagaaacagtgcaggccactgtggagacaggaggttaaagaaaagtcccctcccgcctaatttttcacgtccatgactctttttagttcctgccattattcagattggagagcctctaacctgggccccttcagattaggaaagtttgtggagtcttccagtggctgccttaatgatgtttttgcaacatagtgctgcttcattagaaagggctttgcaatttggttctttaaaatgcccctatctactagaatgagttccaactgaaatctcatgaaatctaaggtttgtggttgagactattccttactctgaatgctagtaatatgatttttttctctatttttattttatttggtcactgtcatattaggcaggagggaacttttctttaacctcctctctccacagtggcctgcactatttctgagttgtaggagagcactttgaattggaggggctgctgatctggaagaggaagtatggaggcaagaagggatcaagggagtcctagagaccagaacatggaggcaggacagctgcctccacggaccagcagtgctcaatatgacctgacctgggtagaaaggagtaaaactgagattcttctaaaatctcatctcttttgggagtcacttcatggcagctttgcctttaccctctgcttccccatacctcttgataggggatatgccttttctttatgggttaattctcattaaaaaagaaatattcttccttccactctcataaaacaatgaagataataaaattactccttacatctttttcatttcttccgttacctaaatcatactatctcagtgatctttgtctagttttccctactttacccagttaaggtgatacttgaggaccaacactgaggctgagatgactctcactagagaatgaccctgtttttcctgttttaattgtgcctatgttttggtctctaccttctaagttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataaggtaagcccacaccattgttttataaaatttctcctgcaacctccaatttttaaagtcttaacttgtcaactggagtttggtcaacttactcaacacagaaaatcaaccccttcacccttcccccagcactagagataattgaatagagttcatttcaggatatggggtacgttatattgtaacattcctcttcttaaggtatcatcatgcaagttatttagacagtcactaggaaacttggcattttattagttttgatgatctattcagagccacccttgtccaggacagtgcagagtttatatcaacacacatatccttaggattttgtttctttgagttcttctccatctgtatcaatgacaacttaatttaattgtgaataaaagagttgctctcccaagcctgaatcctgattgtgacaaccagagtaagaaataaaatagactactctgctttagaatgcagctatgtctaacagttagctagaattctgatcatttggactccaaagtttcttgcctcttctcattcattaattcatcaggagactgtagagcaactaacttctgcattaaataataagagaaatacgaagcaaaaagactaaaaaagtcacgtagcttaactgctcaatttataaatggggcaataaaatgcaaaaaaaagaaaaaaagcttggtgaattcttaggcttacagtgtgcctttcagtctctacacatcatgtaaatattatgcttagctgatttaacttcttgtttgaagtactgtttcatactccattatacatgtcttctagggtggcttacttttaattgtgctgttttctctacactcagtttaaatgactgtacatatatatgtggttgtagagttaatgaataatgagctacaaaccagaacaatgtgactagatagataggatgatctagatttgagatctgggcagattgggaaagagtgactatatggagaagaaagaagtagttacatattgaaataacagtctacttaatgaggacgtgcaacattctttctcaaacttacaaagtgccataaaaagcctctattctctgctcttgggcaggtgtgaaagaaacctaccaaattaatcagatttttctgtatccaggctccttaaaaaatcccagctgtgctgatgtggaaacaggaagaattaggaaagtaatcaattttttttcctagaaaaaatccagcagacaaagaacttcaacaaaagaggctcaagggaggagttgaaaggcaggattcaaagaccaagtatcttaagctatttggtacctgttattcaggacctacagctctgtttactctatcaaagacaaaagtttccagaaacaccctgtatttctcatagatttgaaaattattgatccagtttcagaagataagtgttaattttcttttgcagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggttggaactttataggaacatcatttttccaagtggcgaatcattttgtttatactttaagaagactagactgctactattacagagagtctagcaagtggaaaaggaacaaagccttgcactttactgggtgtaaacttcccaccattgtttttaaagaaggatacttgtaatcataataaaaaaaattacagagactttcaaaggccatgatacctaagttaaataagaaagaattggttgcttttaccacaatgtggagataatttaataagaatttgggtttggttaaggcacatttgtttcaactagctggttctgtgactttctagttgactaaagacttacactaggaatctcaggttcatcatttgtgaaatgggagaaatactgtctaccatagagggtcatcaacttagctcacagcagccctgaattaccaagaatgcatctgagcaaatcagatcacaaaggtacctgcctttagtgagatacatacactggtttacatcagacagaggtagctgggtctacataacaaagtccatgctttttgccacactgacccatacattcatgtgggattcttggaacactaacaaaggctaatattagaaggcaaatagttcaaaacaaaggctgacatattcaggcacacacatgctctcagattgctccagttctcaggaccagcagtcaaacatttcaaaccttctttgatagcaattgcaccaggaataccttttgtactctcccccttccttctgcccaatgaaaaccctctcctcaactcttgtcattgggtgcaccagctcctttctctctcctgttgttccctgacatctcctgctctttcacttgcactcatgctgagtaggagtgaatatctcatttcacggtccaaattaaacagagaggcatgactcaaaggtcaagaatttattaagggagatagatgagagcgagaaaagaatcatttagaaaggaataggggaagagatatggtgcagggggaggagatacagtgtgattgaagggagaaatgtaggatcatcagcatctcaactggtctgtctttatctctttctccttcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaggaatgcttccccagcagtctctttaatccatccatgagttgcttaaaagcaaatagtctgtggtctgcaaatcagggtggggcacacaggcctcaagcaatatttggatttatactttgggtgtgatctttaccgggtaaagccctgatcaagaatgaacaggctgtgttctgctgaaagaaaccaggctaaagggataagtaagcgtgaaatccagtttgtggttcagttgccaagtgctgtgttactgttttagcccagagcagtagatatcttttcagaattggtctcctggagggggcataattgggtaatttttctgccaaatgaggcaccttctggtgatgtgcatgaaggcacttgtctgtgttagaggaatatctgggcctgcctgatgtgaaatatctggttttatgcatttcctcaaaacaccgactgctcttcacgcactttcaaaccatatttcctgttctcgcaatccactatagtgatctgatacattagaaagctgccctaggaagagctgcattaggcaaacactgaagataattaattttattcagaatagaatagcagaaagtaagtatctaaaactaaaatttagctaaatttattgattatatatttggtacctggtacttggcaattattttgtgacacttaatcttcatattagttctagaaggttgattgttttctcctctttactcaccctataatatgtgacaaacacggaatagaaaggcaaagtcactttcttaatgacccttagatggtaaattagagagcttgatttagaacccaggctgctcttctcgtttggggtgtgtacgttaggagagggttgtggggatgtggtggaagctgtgaggaatggaatggggaagtctactactgttgcaggaattttcctttgttcagctaaacatgggaatccttatcatggggccatgaaaagttaggctcgcagacaatttgaagtgtgaggagggcagcgtttattgggtgaaaaggaaaagagggaaacggtccttctgcaaagccagactccctgcttgtgggcttcccacctggcagtttgaatttcaggttccacccaggaagaggaggggctgggctcttccccactggaaatggcgcaaacttctgtggcttcaccccagtgcacactcctcccagtgtgcaggctggagtttctctggggaccccttcccacctggctgtctcattgccccctctaaagaaatgcatctaactgccattagaataaggataaggataaggacaaagaccgatcttaactgcttcctgctgacagggggtgctgtttcggcaaaacagcagtcaaagtccctcagaggcctatttaagggttcccagcagaatgggccattgtccgcctctccagttgcatgactggagtttgatggcctgaaggcaagaagagacaaattgtgttattagaaaacatgtatctaaacaaggggaggggtaaggacagctcaaaaatcctgaggccttttatcagtttgcacaaggagagggaggccaaaagcccaaccggcaaaaaaaaaaaaaaaaaaaaaaaaaaaaaaaactaccctttagctgccatgttgggcttctgggttcccttcccctgagcccaatcctaagctgaccagtttaaggttttaaactcttcccagtttggaggatgcatctgacgggagtgtcccgtagtacggagacacaattgcctatcagtgaagagagaactgaggggggagaaaggaaaaatgaaaggtgttttttcaaaggagtcccaaaggttcaggatgctttcaaaaggggtacagattgaaaatgaatggttactcatctaaaaagaggggagcaggcatccctggttcccgtctcttcctagcagatacccatggtacatgagggagagaaggaagagcatcctctttccctcttccatcctcacatccccaagtcccagcaaccttggcag

SEQ ID NO: 12495 - DNA, 31318 bp, Human
tggcaaatttttgtatttttagtagagacagggtttcgccttgttggccaggctggtctcaaactcctgacctcaggtgatccgcccacctcggcctcccaaagtgttggaattacagatgtgaaccactgcacccagcccagcattatgtttttgagggttcatccacatggtagcttggatcagagcttctccactgacatttagaggctttgccgacagtggggagggaggggcaggaaacaaaatactcagaggctaagaaatggaacatgggggaaagactaagttgcatctcttaaatttttttttttttttttttaagagacaggatcttgctctgttacccagactggagtgcagtggcacaatcacgattcactgcagcctcaacctcctgggttcaagccattctcccacctcagcctcctgagtagctgagaatacagatgtgtgccaccacgactggctaacttttaatttatatatatatatatattttgagatggagtgtcactctgttgcccaggctggagtgcagtggcgcgatctcggctcactgcaacctccacctcctgggttcaagcgattctcctgcctcagcctcctcagtagctgggattacaggtgcctgccaccacacccggttaatttttgtattttcagtagagacagggtttcaccattttggtcaggctggtctcaaactcctgacctcgtgatccacctgccttggcctcccaaagtactgggattacaggcgtgagccaccgcgcctggcctaattctttattttttatagagatggggtcttgctatgttgtttaggtagacccaaactcctggggtcaagtgatcctcccacctcgacctctcaaagtgctgggattagaggggtgagcccaggtgcacaaggctggagcttggcatgtggggaggtgggcattgtggagggccagcatgctgcaagctctttgtaacaatttgttggaaggatgaaattaggccatccaagaacactgccctccttcagctcttgagtctcagattcagaagctggcgagatggcccggtgcggtggctcacgcctgtgatcccagaattttggtaggccaaggcggacggatcatttgaacccgggagtttgagaccagcctgggcaacatggcaaaaccccctctcttaaaaaaaaaaaaatgcaaaaattagctgggcgtggtggtgcatgcctgtagtcccagttcctggggaggctgaggtaggaggatggcctgagcctggggaggttgatgttgcagtgagccgtgattgcaccactgcactacagctgggccacagatcaagaccctatctcaaaagaagaaaaaaagaatttggcagccaggcacggtagctcacgcctgtcatcccagcactttgggaggctgaggtgggtggatcacttagggttaggagttcgagaccagcctggccagcatggtgaaaccctgtctctactaaaaatacaaaaattagctcgatgttgtggcagttgcctgtaattccagctactcgggaggctgaggcaggagaattgcttgaacccgggaggcagaagttgcagtgagtggagatcatgccaccacactccagcccgggcgacagagcagggctccatctcaaaaaaaaaaaaaaaaattggctagagagggccagagacctggccaagtgcatggaaccacaggtggcccatgggcccatggggctggcatctgggtgttcagttcaggtctggggccagcagggcagaaccccctagaaccctgacttgctccaaagtcagacttgctccagagtctgtggccgccaccatcaccaccaccacggagctgacttcctgggtttctctttcactttgacttgccttagggatgggctgtgacactttactttttttcttttttcttttttttcagtcttttctccttgctcagcttcaatgtgttccggagtggggacggggtggctgaacctcgcaggtggcagagaggctcccctggggctgtggggctctacgtggatccgatggagccgctggtgacctgggtggtccccctcctcttcctcttcctgctgtccaggcagggcggtgagtcccctgaccctggcatggcggctcctcttgctgggtggaggcacgtgtatgtgtggagagctgtgggcctgctgtgtgggttggtttcatctctctgtgcctcagtctttcctgctgtcaaatgggagatgggcagtcatggcttctgggatcgaacttagacatctttcctctggtctagattttctcttctgtgaaatgcactaaattttttccacctcccggagttcaatgagaaaaaaaactaaggaaggaataaaaagcaagtatgtatctaataggtatacatagtatagtatcttatgtatgtagtttacaatagatagacatacataatataatgtatacagtcatttccatatttacggggcaatggttccaggaccctctgcagataccaaaatccaaagatgctcaagttcctgatataaaatggtaaagtatttgcatataacctatgcacatccttctgtatactttacttatttatttatttatttatttatttatttatttatttatttactgaggtagggtctcactctgtgtcccaggctggagtgcagtggcctaatcataactcattgcagccttgaccacctgggctcaagtgatcctcctgccttagccccttgagtagctgggactgcaggtgcacactaccatgcctggttaatttttttggtgtatactttttacagagacagcgtctcgctgtgttgcccaggctggtctcgaactcctgggctcaaatgatccactcaccttggcctcccaaagtgctcagattacaggcatgagccaccatgcccagccttcccatatacttttaataatctcaggccctgcacggtgactcactcctgaaaatccagcactatgggaggccaagatgggtggatcacttgaggtcaggagttcgagaccagcctggctaacatggtgaaaccccatctctactaaaaatgcaaaaattagccaggcttgatgatgggcacctgtactcccagctacttaggagctgaggtgggaggatcgcttgaacccaggaggcagaggttgcagtgagccgagattgcagcactgcattccagcctgtgtggcagagcaagactctatctcaataataataataataaataaactttccttctctgtacactggggatcagcggggtgctgactttttcaatggctcttgagatgcactgagtgcctgtagaatgcccacagcagtgctggccacacctcaaggtcccagcgccttcaggggccaggcatggctggagaccagcagcagggagggggcgagaggcagcccacgaggtatcctggagatagtggcagtgagtggtcagtccagggaaagggaaggaggatgggctttaggctctcaggggtgggtgggtgggtgggggttctgtgtcatcacagagagagatggaaggatggagagccttgtgtgttaagcatctttcccccctcaaggttggacacttggggctgtttcctggggtgccgccttctcccccaaggcttccaatctgcctgcagggctcaggacaggtccttcttgtgggagtgagggcgccggggtcttcctgacccatccatggtggcatccccctccttctctcacccagttccacacctagcagactgtggcaatcccaaagggcacggggatcccagtggctgagggaggtcgctgcctcctggagaaatgttattaataattgccctgactgctagtgggccaagtgtgcttgcctgggccagccctggcaggcctctccctgccatgcaccctctactgtctttccccatgctggcttcagacactggtgccaccccaggcacacctccacttctctctgccctccagactgttggtcttactgttctttcctgcaggggtacctcccgagagtgtctcccaaatatgcatctcaacctctgaggactaaagggtggtggatgaatggatagacaggtggatgggtgggtaaatgaatggatggatgaattaataaatacatgtatgtatgtatgtatggatggatggatggatggatggatggatggctggatggatatatcggtaggtagataaatggatggatgggtgggtgtatggatgaatgaatacgtggatggatagatggatagattggtgactagatggatagatggatggttgggtgaatggataatggattaatgaatgcatggatgcatggataaatacatggatggatggatggatggatggactaatgaatacatggatggatgggtgaatgggtggatggtgggatggatggatggatggatggatggattaatacatggatggatggatgaatggacgaatggacggataaatgggtggatggtggggtggatgcatggattaatacatggattgatggatggatggatggatggatggatggatggatagatggatggggggtggatggatggatggatgaatacgtggatggatggacggatggtggggtggatggatggatgtatgaatacgtggatggatggatggtggggcagatggatggatgagtagatggatgaatgaacacatggatggatagatggatgggtagatgcgtggatggatggatgaatacatggatggataaatacatggatggatgggtaaatgggtggatggtggggtggatggatggatggatggatggatggatggatgggtagatgggtgcatggatggatgaatacatggatggatgaatacatggatggatgggtgaatgggtggatggtgaggtggatggatggatggatagatgggtggatggatgaatgaatacatggatggttggatagatggatgggtagatgagtggatggatggatgagtacatggatggatggatgggtagatgggtggatggtggggtggatggatgatggatgaatacatggatggatggatggatggatggatggatggatgggtgaatggatgaattcatgggtggatggatgggtagatggtggacggatgaataaatacatggatggatgggtagatgggcagataaatacatgggcagatggatggatgggtggtggtaggagggtgcatagatgggaaagtgggtgggtgggagggctgatgatcacttgggtgtagaccccaaggctgagcccttctccccacacagtgcaaggccaggaatgtcattatgtcttcattgcctttgcagctgcctgcagaaccagtgagtgctgttttcaggacccgccatatccggatgcagactcaggttcggggcagttcctcattgttggctgaggattatgtagggctctgcctgaccccatccacagcggcccctcccatggcctccaccaccaggccaaagacccagccctgcctgtggtcttgggagtccccaccccaccacctgctggcccattcttaccaggttcaagttgccctggagtagccagccgcctctctgaacattatcacttccctagcatggtctcagggctggtgtctgtgtccgttcagattggtcggtacatgggagaaagtacctgttaagcattttgaagccccccccccaacctgataaattattagaacatttatttcatttatttatttttgagacggagtcttgttctgctgcccaggttggagtgcagtggcctgatcacagctcactgccacctccaccttccaggttcaagctattctccagcctcagccttccaagtagctgggattacaggtgttagccaccacacgcggctaatttttgtatttttagtagagaccaggtttcaccatgtcgcccaggctggtcttgaactcctgagctcaggtgatggtgagccacctgcctcagcctcccaaagtgctgggattccaggaatgagccaccgcgcccggccatattgtcggaacatttatgctcctaatgcaccctgaaaagggtctgaacactaagcagacacgctgtccattcttttgtttgataacgatttactgagcatcttctatgtgcggacacagttctagacataggcaactggctatgagctcaactaacttcccaagaccacagcctagtggaagagatagacaacaggcaaacaaatgtctatcacaaatgtgatgatgtgttttgaagaaccagaggaggaaagttggggccctggggaccccccaaaaaaaaacaccagaggagggtgagggatagagagagaggtggcaggacatctggcctctgtgaggacaagttaggaggctgaggattcggaataggttgaggtgagagacggcaggggatgaggtaggaaggacgcggggagggtttaggctgaggtgacgctgaaagatgtaagcatcacaaagatttgtcttaggcacgaagacccctccagactctggtctgttcccaagcctacaggatctcttccaggctcggcctcgggccctagggacctgagatgctatcggatatccagtgatcgttacgagtgctcctggcagtatgagggtcccacagctggggtcagccacttcctgcggtgttggtgaggacccctctaccattcccaaaccctcacccaccatcccactcttgcttcaaccccctctggtgcccctactctcggatgcgtgatcttggctgggtcaacactccttcctgggcttcagtttctcatctaagaagagagagttggaggattgtggtggggggttggtcagtgaaggtaggcatcccagggtgggtggccatgagggtctctctagtccttttttcttcttcaccctttcacttatccacccatccaaccatccatccatccatccatccatccatccatccattttttcttttttctttttttctttttttgagatggagtcttgctctgttgcccaggctggagtgcagtggcatgatgtcagctcactgcaacctctgcctcctgagttagagtgattttcctgcctcagcctcctgagtagctgggactataggcacacgccaccacacctgctaatttttgtatttttagtagagacagagtctcaccatgttggccaggctggtcttgaactcctggcctcaggtgatccacccccccttggcctcccaaagtgctgggattacaagcgtgaggcactgcgcccagccctttcattcgtttcttcgctgtgtggtgcagtccttgctgggagatactggggtccctcaaacccctccagtcccagactgatctccaaggaacccccaggctgggggaggaggtgtacaagggacagaaaaggatgctgggggctgggcacggtggctcacgcttgtaatcccagcactttgggaggctgaggtgggcggatcacttgaggccagaagttggagaccagcctggccaacatggtgaaactccatctctactaaaaatacaaaacttagacgcatgtggtggcatgtgcctgtaatcccagctactagggaggctgaggtgggagaattgcttgaaccagggaggtggaggttgcagtgagccgagattgcgcgactgcactccagcctgggtgacagaatgaaactccatctccaaacaaacaaacaaacaccaaaaaaacgatgctgggatgtgatgcacaaagtcggctgtggggtccactaggaccccagactcggcactgacaccctccttcctgctgcagccttagctccgggcgctgctgctacttcgccgccggctcagccaccaggctgcagttctccgaccaggctggggtgtctgtgctgtacactgtcacactctgggtggaatcctgggccaggaaccagacagagaagtctcctgaggtgaccctgcagctctacaactcaggttagcaccttgttctccccccgtccgttttttacccagagaggccatcaggctgcaaggctggagctagagaggattcctggcccttggcaagggacttgatactactagccattgtcacttcacgtagtgtcacgcaaacactattgtgacaaagcagtctttcatggtccccttaccaatcccctattcgtgggcacttagattgcttctggtttctctctgctagccataatgctgccaagacctggttgggttcttattatctgttctcatgactcgacatcatgtattttgccgggtgcggtggatcacgcctgtaatcccagcactttgggaggctgaggtgggtggatcacaaggtcaagagatcgagaccatcctggtcaacatggtgaaaccccatctctattaaaaatacaaaaattagccaggagtggccacgcgcgcctgtagtcccagctactggggagactgaggcaggagaatcgcttgaacccgggaggtggaggttacagtgagctgagattgagccactgcactcctgcctggcgacagagcaggactccatctaaaaaacaacagcaacacacaaaaaagccaaaaaaatttgcctggtgtggtggtgcatgcctgcaatcccagctacccaggaggctgaggcgggagaatggcttgaatccaggaggcagatgttgcagtgagctaagatcaagtcactgcattccagcctgagtgacagagcaagacactgtctcaaaaaaaaagaaaaaaaagaaaaaagaaaagaaaagaatgaaggaaaacatgtcatttgccacaacatggacaaagctggaggacattacgctgagtgaagtaagccaggcacagaaacaaaaacatttcatgatctcacttacatgtataatctttttttcttttttcttttttttgagatggagtttcgctctgtcgcccaggctggagtgcagtggcgcgatctcggctcactgcaagctctgcctcctgggttcacaccattctcctgcctcagcctccccagtagctgggactacaggcgcccgccaccgcgcccggctaagtttttgtatttttagtagagacggggtttcaccgtggtctcgatctcctgacctcatgatccacccgcctcagcctcccaaagtgctgggattacaggcgtgagccaccgcgcccatcccacttacatgtataatcttaaaaaaaaaaagtcgaatatctaggcaccgaaagtagaactgtggttaccggggatggagagaaggaggaaatgggggagatgtaggtcaaaggaatacaatttgtagttacgcagcacaaataaatctagagttccaaggtacagtagagaactataattaaaaataatgtatattgaaaatttgctaaaagaatagatttaagggctgggtgcagtggttcacgcctgtaatcctagcacttcgagaggccgaggtgggaggatcacctgaggtcaggagttcgagaccagcctgaccaacatggtgaaaccccatctctactaaaaatacaaaaattagccgagtgtggtggcgggcgcctgtaattccagctactcgggatgctgaggcaggagaatcacgtgaacctgtggtatggaggttacagtgaaccgagatcacaccactgcactccagcctgggtgacagagcgagactccatctcaaaaaaaaaaaaaaaaattttaagtgttctcaccacacaccaaaaaagtaattatagaaggtgatggatatgtatatatatttttaagagatggggtcttgctgtgttggccagggtggtcttgaactcctgggctcaaatgatcctcctgtcttggcctcccaaagtgcttcgagtacaggcgtgggcccctgtgcctggccatggatatgttaaattccttactgtagtaatcatttcactatggatatgtatatcaaaccatcatacctcttaaatttatacaatgatataaaaaaagaatcaggccgggtatgaccacggtgcagcaagactattttatgctaatttatgtctctccttgggtcaggttccttgaaatagatctaaaaactaagtacgatttccctgatagttctaaacaaacaaacaaacaaaaaaagaattggctggacacagtggctcatgcctataatcccagcactttgggagcccgaggtgggcggatcacccccaagagacaggcacttttgtaaattgcttaccagaattgattaccctctggcaagcaatttacaaaagtgcccgtctcttcacagccttgccagcaatgggtgttaatattttaaagttatcttcactaacaggatcctgtgtataaatctttattaaaaattatttatttttaaattttaatttaattttaatttgttttgagacagagtcttgctctgtcacccaggccggagggcagtggtgggatcttgtctaactacaacctccgcctcctgggttcaagcgattctcctgcctcaggctcccaagtagctgggattacaggtgcccaccaccatgcctggctaatttttgtatttagtagagacggtgtttcaccgtgttggccaggttggtcttaaactcctgacctcagatgatccacccaccttggcttcccaaagtgctaggattacagctatgagccactgctcctggccatatttgttgtttttttagagacaagttctccctctctctcctagattggagagcagtggtgtgatcagggctcacttcagcctcagcctcctaggctcaagagatcctcccatctcactctcctaagtagctggaaccacagtcatgaactaccatgcctggctaatttttatgtagagatgagggggtctcactatgttgcccaggctggtctcgaactcctgggcttaagtgatcttcctgccttggcctcccaaaatactggaattacagggtgagccaccgtatgtggcttgtgtataaatcttgactttttgatcataatataccaggcttagctgggacctgcaagtgtcccctaattcatatttagggattcagttgcttaccctggacagggtggattttcagggcccattaactcacatacgtgtgggctgcccctcgccaatccctacctctgcttccagttaaatatgagcctcctctgggagacatcaaggtgtccaagttggccgggcagctgcgtatggagtgggagaccccggataaccaggttggtgctgaggtgcagttccggcaccggacacccagcagcccatggaagttggtgagtttgtttcccaagtccagggtggacacgggcctctccagggcaccttcacccccaaatcagtctcaccatctctgcatctgtccccgctcccaaccagcccccactctagcccctgaggtggtttttttctttttctttttttttttctgagacggagccttgctctgtcgcccaggctggagtgcagtggcatgatctcagctcactgcaacctctgcctcccgggttcaagcgattgtcctgcgtcagcctcccgagtagctgggattacaggcatgcgcccactaccacacgcagctaatttttgtatttttagtagagacggggtttcgccatgtgggccaggctggtctcaaactcctcaggtgatccgcccaccttggccttccaaagtgctgggaatacaggcatgaaccaccacgccttgctcccactaaaattttttaaaataaattttttcttttggaataaccttcgattttcagaaaagttactatataaactggtgcagagaacgcccatatatcctttacccaaactcctctaatgttaatgtcttacataaactccaggcattatttgaatgtcaccaatttttccaggaatgtcttttttctgctcccagattcaatccaggatcccacattgtgtttagtaaaataattattaatttttaaaatttagttataataattttttactgctttatatgttcctaaagaaggtttgaacctagagaaggttctctagtaattaacgatagaaataatccctggaagtatggtctttaatttaaaaaaatttagcgaggtgcggtggctcacgcctgtaatcccagtgctttgggaggccgagttggggtgggattgcttgaggccaggagtttgagaccagcctgggcaacatggtgaaatcccgtctctaccaaaaatgcaaaaattagctgagtgtgatggtgcatgcctgtagtcccaactactcaggagactgaggcgggaggatcacctgagccctgggaggttgaggcttcaataagccatgattgcaccactgcactccagcctagatgacagagtgagaccgtgtctcagataaataagtaaataaataactaattgtaaaacagcaaatatttttcagcaccaaaatgcaaaacaatatatgaatatgtttttattctagggcgactgcggacctcaggatgatgatactggtgagaataataatagtaatgacaacaacagctgcagcaaattggcattaattgagcacctactgtatgccaggtccaatgctgaatttttttgtatgcctcttaccctgccccatagttcagtattggattctttccaaattgcaggtggggaaacaaatcacgacttggagggggtgagaagcctttggccaaggtcacgaccgaagggatggccgcagccaggacttgaactgaggggcagggatggacgtgggtgatcctggaggccctaagaggacagggcctggcctgcttctgctgagcccccaggacccagcacgtggctctgtacacagttggagctcaataagcacatgatggttaagtgactggtgccaagtcctggacaattcttacggcctgatgttcgacctgcctctccccagagtcctgcctctgccccctggagatgaatgtggcccaggaattccagctccgacgacggcagctggggagccaaggaagttcctggagcaagtggagcagccccgtgtgcgttccccctggtaagatcactctgagtacaggaacaggggcaagcattagaaataaggcaacagccggaggtggtggtgcacacctgtagttccagctgctcagaaggctgaggcgggaggatcacttgaggccagtggtttgagaccagcccgggcaacatagtgagaccccatctctaaaaaataaaataaaatggggctgggcgtggtggctgatgcctgtaatcccagcactttgggaggctgaggcgggcagatcacttgaggtcaggagttcgagaccagcctggccaacatggtgaaaccccttctctactaaaaatacgaaaattagctgggcgtggtggcgggagcctgtaatcccagctacttgggaggctgaggcaggagaatcccttgaacccgggaggtggaggttgcagggatccaagatcacaccactgcactccagcctgggtgacagggccagactctgtctcaaaaaaaagtaaaaaaaaaaaaaaaagtaataataaaataaaatggaaaaagaaataaggcagcaggtattagaaacaaggtggtgagtgttagaaataaggcagagggagaaatgggtgctcaaaccctgacaatgtggcatccggtcttgctgcacccactttagggttttttgctgctgttttttttgtttgtttgtttgttgttttttgttgtttttttttttgagacggagtctcactctgtcacccaggctggagtgcagtggcgccatctcggctcactgcaagctccgcctcccgggttcacgccattgtcctgcctcagcctcccaagtagctgggactacaggtgtctgcaaccacgcccggttaattttttgtattttttagtagagacggggtttcaccatgttagccaggatggtctcaatctcctgacctcgtgatctgccctcctcggcctcccaaagtgctgggattacaggcgtgagccaccgcgcccggcctactgctattttttgttttgttttgagactgtcttgctctgtcaccctggctggagtgcagtggtgtgatcttggctcactgcaacctccgcctcacgggttcaagcgattctcctgcctcagcctccagagtagctgggatttacaggcatgcaccaccacgcccagctaattttgtatttttagtagagatggggtttcgccatgtttgcccggctggtctcgaactcctggcctcaagtgatcctcccaccacggtctcccaaagtgctagaattccaggtatgagccactgcgctcagcccactacagggctttatcaagtgagaatcatcaggctgaacctcacggtgtctcaaggacaatgtcacctgcaggtggcagggtgtactaaacagctgctgccctgagcctgggcaacaggaaaatgagtgagagggtttcaaaccatgcagaaaggcctggcgctgtggtttatgcctgtaatcccagcactttgggaggccgaggccagaggattgtttgaggccaggagtttgagacaagcctgggaatcaaaacgagactctgtctctagtctataaaacaacagcaacaacaacaaaaccatgcagagaaatacatttgcattcaaaaaggaacttagaggccaggcgcagtggctcacgcctataattccagcagtttgggaggccgaggcaagtggatcacaaggtcaggagttcaagaacagcctgaccaacatggtgaaaccccgtctctactaaaaatacaaaaattagccggacatggtggtgcatgcctgtaatcccagctacttggaaggctgaggcaggagaatcgcttgaacccagaaggcagagattgcagtgagccgagatcgcaccagtgcactccagcctaggtaatagagtgagacttcgtctcaaaaagcaaacgaacaaacaaacaaacaaaaaaccttaggcaacatgagattacaggtggcagttatccctggggatgcaaattgtgttaatttttcttccttcagttttttctcttttctgcaatttggggcagcaagggattttcactttgtaaatgtggagaatccatcatttacaaagaaaacatccatcagtctttctctccttccaattcgtctagttggtttggttctgattgcagaaaaccccccacagcctcaggtgagattctcggtggagcagctgggccaggatgggaggaggcggctgaccctgaaagagcaggtaacggggctgtcacagggctgtggggtggcctgggatggggagcaggaggcaaaagcctaggcgggggatgagcaagtggtagatggagggagatgagatgtagaggtggcaggaagtgggcaaattgtgggtttaactctgaaggtaatagggagccatggagtgtgtgtgtgagcaggagaggcacatgactggactcagatgttcacagactttccctggctcctgtgtgagaaacagagtgtgggggaattgcacagaagccagaaggccaggaaggagataatggtgactgcatttgcctgggtagcagattattgctttaagtcccaaaacaacccattaagtgcagtctgattagtttacagagagggaaactgaggcatagagggagtatctctgttgagacaaaactgacaaatactccactcgttgactttaccatagtcatcttagtcaggtccctaatgggctgttactataaggctgtagcaaaaatcctttatttcctatgttcctctaactcaaattcctcttcttttttttcctttttttttttttttttttgagatggagtcttgctctgtcgcccaggctggagtgcagtggcgccatctcggctcactacaagctccgcctcccgggttcacgccattctcctgcctcagcctcccgagtagctgggactacaggcgcccaccaccatgccgggctaattttttgtatttttagtagagacggggtttcaccgtgttagccaggatggtctcaatctcctgacctcatgatctacccgtctcggcctcccaaagtgctgggattagaggcgtgagcccccgtgcccggcctctcaaattccttttctaaggaaaaattttctgcttgaggtaactgggttaaaagatggaaacatttttgttttcctgaatgtcagtgggttttgtcaatttcccacctccctcaagctagatgtgtgcgggaggtgaatgcctgtctcacagcagctttgccagcattgaggtttattattcttttaatttttgatgcatgttattggctgtggcctttgtccaagtctgtcttcataggctgtgccctgctgtctgcctatgggatgatgagtgtgatcaggtacccacaagctgtctttcatactcctgacagccaacccagctggagcttccagaaggctgtcaagggctggcgcctggcacggaggtcacttaccgactacagctccacatgctgtcctgcccgtgtaaggccaaggccaccaggaccctgcacctggggaagatgccctatctctcgggtgctgcctacaacgtggctgtcatctcctcgaaccaatttggtcctggcctgaaccagacgtggcacattcctgccgacacccacacaggtgcctcctctgggtggggagggcggtatgagggcccctcagagctgagcacctactctgagcctcagctagaccagggtgagaggagcgaggcagaaaattttaaaggagtgcctgatttaggggtgtatcaaaaattcagtaatcagccaggcacggtggctcacacctgtaatcccagcactttgggaggctaagacaggtgaatcacctgaggtcagcagttcgagaccagtctggccaacgtggtgaaacccagtctctactaaaaatacaaaaattagctgagtgtggtggctgtagtcccagctacttgggaggctgaggcaggagaatcgcttgaacccaggagccagaggttgcagtgagccaaaattgtgccattgcactccagcctgggcaacaaagagcaagactgtgtcaaaaaaaaaaaattcaataatcaagatccataatgcagttttttgttgttgttggtttgttttttttaagagacagagttttgctatgttgcccaggctggacttgaacttctgggctcaagcaatctttctccctcagcctcccaaatagctgggaatataggcatgtgccatcatacctggctattatgcattattaaagaacaacaacaaaaactagctgagccactgcgctccaccctggttgatagagctacactctttttcaaaaaagaaaaaagagagaaagaaagaaaaaaggctagagttgaccctgtgtttatttaagatctaatttcttttttttcttgtgacagatggcatgatctcagctcactgcaacctccgccttccagattcaagagattctcctgcttcagcctcccgagtagctgggattacaggcatctgccaccatacccggctaattttgtatttttagtagagacggggtttcaccacgttggccaggctggtctcgaactcctgacctcaagtgatccacctgccttggcctcccaaagtgttgggattataggcgtgagccaccatgcccagcctaatttttgtatttttagtagagatggagtttcaccatgttgcccaggctggtctcaaactcctgccctcaggtgatccacccacctcagcctctcaaagtgctgggattacaggtgtgagccactgtggccgacctactatttttattatttttgagctaggttctcagtctgttggcagactggagtgcaatcatggctcactgcagccttgaactcccagactcaagtgatccttccacctcagcctctggagtagctgggactacagacatgcaccaccacacctggttaattttttatttttattttttgtagagacaggtgtctccctacgttgcccaggctggtctcgaactcctgggctcaagtgatccacccatctccacctcccaaagtgctaggattacaggcgtgagccaccgtacccagcctggtcccatatcatagtgaaatggtgcctgtaaagctctcagcattggcttggcacatgcagttggtactcaataaacggctgttgctatccccagaattgcaagcagtatccatctctctgacattcatgaagacgccctggcgggagggagtgggagagatttgcccagggactgagtgggtgtgtgctcgtgcttctgagtttggcatgagaccaccagtggcgccggtcaggccagggaggcctagtcttgcatcacactctccgcctaggctaggcaagtggtgggcagccaggtatctgccacagccggagacgcctacaaggctggaagtgggtgtaatggcagtacaggaagctctcatggtgaatatcctggcaaggagacagcagttaggctggaggaggactcagctcattcaaacaccacctgctgactggatgcggcggattatgcctgtaatcccagcactttgggaagccaaggcaggtggatcactggaggtcaggagttcgagaccagcctgggcaacacggtgaaaccccatctccaccaaaaaataataataaattagccaggaaatggtggcgcatgcctgtggtcccagctactcaggaggctgaggcaggagactcatttgaacccgggaggctgaggttgcagggagccgagatcatgccactgcactccagcctgggcgacagagcaagaatccgtctccaaagaaaaaacaaaaaaaaacaaacgccatctgctacccactttgtgcctggccccaaggcagcctccagtgcagggaaacagccaaacacagacacccctggccctgtagggtcaggggtatagacgagagggtgggagagaggctgcaggagccagagaaggggactggggagagagatggcaactgtctcgatgcgtctctcccctctccttccagaaccagtggctctgaatatcagcgtcggaaccaacgggaccaccatgtattggccagcccgggctcagagcatgacgtattgcattgaatggcagcctgtgggccaggacgggggccttgccacctgcagcctgactgcgccgcaagacccggatccggctggaatgggtaatggcctggaatggcctgcgcctacccctcctctgtgccctcccttttaggtcctggtgggttcaaacctgcagggaaggcacacagcgggtgtctaaggcccagagaggtgttgctgcttactcaatgtcatacagaggtagggacagggtgaggttcggagcctctcacccatatgggtctggaacctcttgctggcatcctgagctcagttccaggcagatcacacacatacaggtaatgaatctcacatcccaaggtgtttgttaaatattcaaccgcgccagggaaggtggcagttcgcgagatgctggtggcaaattaatgagcagtctttagggaaaggggggccgtgaggctcaggtggcctctcactctcccgcttcctgctctgggccttgccagagccccagaaagcctcagcctcagcctgttccttgaagaatacacagcctgaggagacagaactggacacggaacccctgaccccattgtccgggcaaggtggctaacacctgtaatcccagcactttgggaggctgaggcaggtggatcaacagaggtcaggagttcgagaccagcctggccaacatggagaaaccctgtctctactaaaaatataaaaattagccaggcatgatggtgtgcacctgtaaatcccagctactcaggaggctgagacaggagaatcgcttgaacccgggaggcagggattgcagtgagtcaagattgcgctattgcactccagcctgggtgacacagcgagactccatctcaaaaaaaaaaaaaaaagaagccctggttccatggagtaagggctgggttagagggggatggggatggggttgggggtgttgcatagggaagagatcttggaggaggggatattggtgcaagggctttgaaacatgagtaggagttttctgggggttcctggcagatggcacagccagtgcaaaggtgcagaggtgggaacacaatctactgaatggcctggcctttgcttatccttccagcaacctacagctggagtcgagagtctggggcaatggggcaggaaaagtgttactacattaccatctttgcctctgcgcaccccgagaagctcaccttgtggtctacggtcctgtccacctaccactttgggggcaatggtaagtgacccaaacctgcaggtttacattattttttctttttaaataatttaaaaaaatagaggctgggcacagtgactcacgcatgtaatcccagcactttgggaggccaaggtgggtggatcacctgaggtcaggagtttgaaaccagcctggccaatgtggcgaaaccctgtctctactaaaaatacaaaaattagccgggtgtggtggcgggtgcctgtaattccagatacttgggaggctgaggcaggagaatcgcttgaacccaggaggcggaggttgcagtgagctgagatcatgccactgtactccagtctgggtgacagagcaagactctgtctcaaaaaaaaaaaaaaaaaaaaaaaaaaggacaatgctgttaaggcagacagaatggctcacccctgtaatcccagcactttggcactttgggaggctgaggcttgtggatcacttgaacccaggagttcaagaacagcctgggcaacatagcaagaccccgtctctacagaaagaaaaaagtttgccagccatggtggcatgtgcctgtagtcccaactactcaggaggctgaggtggtaagatcacttgatcccaggagtttgaggctgcagtgagctatgattgcaccactgcaatcatacaacctctgcctcccgggttcaagccattctccttcctcagcctcctgagtagctgggattataggtgtgcactaccatgcctggataattttttgtatctttagtagagacagggttttagcatgttggccaggctggtctcaaatgcctaacctcgtgatccacctgccttggcctcccaaagtgccgggattacaggtgtgagccactgcgcccggccagcattgtccattttatagataagaaaactgaggcccagggaagggaaatgacagtgactgagtggcagaaccagaattaaaacccagctcacctgactctgtggccaatgttacctccgtctctggacagtgggaggctgggcattcaggaagtgctcaaccagcactccttttttttttttttttttttttttcttgagacagagtcactctctgtggcccaggctggagtgcagtggcacgatcttggctcactgaaacctctgcatcccgggttcaagcgattctcgtgcctcagcctgccgagtagctgggattacaggcgcccaccatcatgcctggctaatttttgtagttttagtagaaacagggtttccccatgttcctcaggctagtctcgaactcctgaccttaagtgatctgcccaccttggcctcccaatatgctgggattgcaggcatgagccatcgtggctgggctttttttttttttaaagacagggtcttgctctgttgcccaggctggagtgcagtggtgccatcttggctcactgcaacctctgcctcctgggctcaagtgattctcctgcctcagcctcctgagtagctgggattacaggtgtccgccaccatgcctggctaatttttgtatttttagtagagaaggggttttgccatgttggccaggctggtcttgaactcctggcctcaaatgacttacccacctcggcctcccaaagtgctgggattacaggtgcgagccactgtgccaggcctcgaccagcattcttggtgttgactatgacaatggtactggttgcagcctcagcagctgggacaccgcaccacgtctcggtgaagaatcatagcttggactctgtgtctgtggactgggcaccatccctgctgagcacctgtcccggcgtcctaaaggagtatgttgtccgctgccgagatgaagacagcaaacaggtgtcaggtacgtgaggcagtgcagacctggcttggggaggaagggaggatcctggcctgtgatctctcttgctgtgtgaccctgggcaccttgccgtccttctctgggccttggttatcaaacccttaaaacaagagaattggctgggcgcagtggctcacgcctgtaatcccagcactttgggaggccaaggcgggcggatcacctgaggtcaggagttcaagaccagcctgaccaacttggagaaaccccgtctctcctaaaaatacaaaattagccgggcatggtggcacatgcctgtaattctagctacacgggaggctgaggcaggagaatcgcttgaacccaggaggcggagattgcagtgagccgagattgtaccagtgcactccagcctgggtgacagagtgagactctgtctcagaaaaaacaaaaacgaaaacaaacaaacaaaaaacaaaaacaagagaattagacttgagggtctttttttttttttttttaattttatagacagggactcactctgtgcccaggctggagtgcagtggtgccatcatagctcacagcagcctcaacctcctgggctcaagcgatcctcccacctcagcctccctagtagctggaaacacaggtgcacaccaccatgcacagttaatattttattttttgtagaaatgaggccttgctatattgcccaggctgggattttttcttttttttctttttgagagggagtctgtctctgtcacccaggctggagtgcagtggcgccatctcagctcactgcaacctctgcctcccgggttcaggcaattctcttgcctcagcctcccaagtagctgggattacaggcacccaccaccatgcctggcaaatttttgtatttttagcagagacggagtttcaccatgttgaccaggctggtctcaaactcttgacctcaggtgaatcacccgccttggcctcccaaagggctgggattacaggtgtgagccaccgtgtccggcctcgctcaggctggtttcaaacttctggcctcaaactatcctcccaccttggcctcccaaagtgctgggattagtcatgagcacccagctgaacttgagggtctcgatcaccccttgcagaccctggagaaggctgggtgggcaccagccaagtgcttatggtgtattggattcatccatgggaagctgcccctcacatgtagcagcagctgaactctcatcaagcagggatgactgtctccattccacagatgaggaaaccaaggcctggaggggggatctgatgagggacaggaaagcccacaaaacagggtttagccaggagggtttttggctttccccaggaaagagttcaagtgcatgtcggtggtgttagacagaaacttttactgaagtggccgtgtagagcagcagcagaagtcctgctccttgcagagtggggacgccccacaggcagggcagctacgtctcatatttatacccgcttttaattatatgcaaatgaaggggcggtttatgcagaaatatctaggatgaaggtagtaacttccgggttgtgggatcattgccgtggacaggggcggtaatttccgggtgttgccatggtaatggtaaactgacatggcacactggtgggcgtgtcttatggaaagcccaggacctgctttagctagtcctcagtttggtcctgtgtccaagccctgcctccagagtccaatcctgcctccaacctcagatccacctgcccaaagatccaacaagtcagccggacgcggtggctcacgcctgtaatcccagcactttgggaggctgaggcgggcggatcacttgaggccaggagttcaagaccagcctggccaacatggtgaaacctcatgtgtattaaaaatacaaaaaattagctggctatggtggtgggcgcctgtaatcccggctactcaggaggctgaggcacaagaatcgcttgaacctgggaggtggaggttgcagtgagctgagattgtgccactgcactccagcctgggcaacagagtgagactccatctcaaaaaaaaaaaaaatcttgagatgaatgggcgcattaagagaagagattttaggttgggcttggtggctcacacctgtaatcccagcactttgggaggccgaggtgggcagatcacgaggtcaggagatcgagaccatcctggctaacacagtgaaaccccgtctctactacaaatacaaaaaattagctgggcgtggtggcgggcgcctgtagtctcagctactcgggaggctgaggcaggagaatggtgtgaacccaggaggcagagcttgcagtgagccgagatggcgccactacactccagcctgggcgacagagcaagactccgtctcaaaaaaaaaaaaaaaaaaagaaagaaagagtagagattttagcaaaatgcctatgaatccccaccccacccacaggctgtggtagcccagcctggcctctgaggagtaaagaggtcccaggactcagggttgcctctcccactgcagagcatcccgtgcagcccacagagacccaagttaccctcagtggcctgcgggctggtgtagcctacacggtgcaggtgcgagcagacacagcgtggctgaggggtgtctggagccagccccagcgcttcagcatcggtgagtggagggggtaggacccagttatttacccagcatgcactgcactgcgcttcccacaatgatcttagcagccctgccctcactctcactccctctatggctccctactgccctcaggagaaagtagcagctcaaactgctcccattgccttctctcgcagcttcctctcacactccaggagccttgcccatgcaggcccttccctgcctcctgcctggaatgtttgttttccacacggtccaactcctattcgtccttcaaaactcagctcaaaagttccctcctccagcaagacttctctgcctccttctggccatgcccttgtttacaactgtcccttctccctggtctgacactgcggggttggggtagatgtgtcaaggtatctgggggctcttggggaggaggaagatgcaggaatctgttcattgagcgacaaataaatgaatgcaaaaataaggaggacacaggcaaaacccggtgtggtggctcacacctgtaatcccagcactttgggaggctgaggctggaggattgcttgagccgaggagttcaagaccagcctgggcaacatggtgagacctcatctctacaaaaaatatttttaaaatagtggggtgtggtggtgcacacctgtagtctcagctgctcaggaggctgaggtgggaggatggcttgagaccaggagttcaaggttgcagtgagccgtgactgcaccactgcactctggcctgggcgacggagcaagaccctgtctcaaaaaaaaaaaaaaaaaaaaaaaaaatagaagaagaagaaggagaagaaagaagaagaagaggaagaggaatagaagaagagggaggaggaggaggaggaggaggaagagaacaacacaggctctgttgtcgggtgcatggttataagagattcagagatcaaatgatccctgttcatgccacggtgtcctttcagttccaagagaaccaactggaacccagagaacaaaagagtcagggttggtggggggcaggcaggcctgggtccaggggcagccacatgtgccctatgtgcaggctcctggaattacagagtctttttttatctttttgagacagattttccctcttattgccgaggctggaatgcaatgatgcgatctcggctcactgcaacctccgcctcccgagttcaagcgattcttctgtctcaccctcccaagtagctgggattaccggcgcacaccaccacgcccagctaatttttgtgtttttagtagagacaggtttcatcatattggtcaggctggtctcgaactcctgacctcaggtgatcagcccacgttggcctcccaaagtgctgggataacagtcatgagtcactgtgcccggcctggaattacagagtcttgaacacttcctgcatgccaggcctttatttcttgacagctaccgggcaggtgggttctgtggtctcccagtgagaagcccgtggcatgtgcaccaggatcagcagcaagttcatggagaaaccaggccctcctagctccttccctgaggaagaggcaggaggtagccctctgccaacccacgctctcccacctcagaagtgcaggtttctgattggctcatcttcttcgcctccctggggagcttcctgagcatccttctcgtgggcgtccttggctaccttggcctgaacaggtaactgacacctcttaccgttaccatagcgatggtaatgatgctgggcaggggagccctaaagtggagcttagcccgcagattgggtccttggctttgcccaggaaataattcaagggcaagccagaggtagaagaaaacagctttattgaagcagcagttatagctccgtgactgcctctgcagagcagggcttccctgtaggcggagagtagccgctgagagcggttttgcagtcagatttatacttacttttaattgcatgcagattaaggggggcagtttatgcaaaatttctttcttttttttttctttttttttttcttttttgagatggagtcttactctgttacccaggctagagtgcagtggcacgatcttggcttattgcaacctccccctcccgggttcaagccattctcctgtctcagcctcccaagtagctgggactacaggtgcgtgccatcacacccagctatttattttgtattttcagtagagatagggtttcaccatgttggccaggctggtcttgaactcctgacctcaggtgatcctatgcagaaatttctagggaagggatagtaacttttgggtccttggtcattcccatggaaaggggcggtgacactggtgggcatgtctgattgaaagctgctttcaagccgggcacggtggctcactcctgtaatcccagcactttgggaggctgaggcaggcagatcgctttaggccaggagttggacaccagcctggccaacatggcgaaacctctctctaccaaaactacaaaaattagccgggtgtggtggcacacgtttgtaatctcagctactcaggaggctgagtcaggagaatcgattgaacccaggaggcagaggttgcagtgagccgagatcgcgccactgcactccagcctgggcaacagagcaagactccgtctccaaaaaaaaaaaaaaacctcagctcctctcactggtcccctttcctccccagggccgcacggcacctgtgcccgccgctgcccacaccctgtgccagctccgccattgagttccctggagggaaggaggtaaggatgccttttctaattccaagtctttttattgggtgcacacgctggacaagggttacgcattagctcattttattctctcccaattcatcaaggtaaggactccaaaaccagtgctccataccccttcccattttaaagacaggcaggcagaggtccatttcctggcactagaaacagaattcaaagtggctttattataaaggaaacctgatggaaaaaatcccaagggaatgggcttcagatatgcctgaatccagcgattggggtctatctcggagctgcccgttcagggttcttccgcaggcaggctgagccttctctgattggaagcagggtgtccattttccccattaactggggcaaaagtctcagggccatcactgattggtccagcttgggtcacatgcccttccctgagcctatggctagaaccagaggggtagggaagggtctgatgggtgggctggccagggtcacatgaccattgctagagctgaggtggggtcactgcactgtcaaccacaccatctgtgaaaagagggagggaaatttcccaaagacagatgggagtgctcttcctaagaggggctgaatgggagtcagtgcggcagactccatcctcaaatcggtctcaggatatatggagtctcgctctgtcacccagcctggagtgcagtggcgccatctcggctcactgcaacctctgattcccgggttcaaacgattctcctgcttcagcctcccaagtagctgggattacaggcgtgcgcaaccaagctcagctaatttttgtatttttagtagagatggggtttggccatgttctccaggctggtctcaaactgctgacctcaagtgatccacccgcctcagcctcccaaagtgctgggatgacaggtgtgagccactgcacccgtccaggtctcaggatgttagagaatttaaccagcagtgacctggtccgttccatcctgctgtggatgggaagtagagctctgctcacagctgtggccctaccctccctctgcagacttggcagtggatcaacccagtggacttccaggaagaggcatccctgcaggaggccctggtggtagagatgtcctgggacaaaggcgagaggactgagcctctcgagaagacagagctacctgagggtgcccctgagctggccctggatacagagttgtccttggaggatggagacaggtgcaaggccaaggtcctggggcccagtgggccagacggtcaggggtgcaaccctgcccggggggtgggggggctagacatccatcgctcctgggatatcagggcctggaggcctgagggagaaacgaaaacatccactttgtcttacagacacgaagagcgactatctcaatcacaacggctggttattaagcacttatggcatacccagcccattccatccactcacatgattccctaccaaatccctacaaccaccccctgaaaggaaccatgactgttgtactttacagatgtgatcgttgaggctcagagagggtgagtgactcgcccgaggctacgtagcacacacaggagtcacatttggacccaaataacccagagctcctccaggctccagtgcacctgcctcctctctgccccgtgcctgttgccacccatcctgcgggggaaccctagatgctgccatgaaatggaagctgctgcaccctgctgggcctggcatccgtggggcaggagcagaccctgccatttacctgttctggcgtagaatggactgggaatgggggcaaggggggctcagatggatccctggaccctgggctgggcatccacccccaggagcactggatggggagtctggactcaagggctccctgcagcattgcggggtcttgtagcttggaggatccaggcatatagggaagggggctgtaaacattgtgggaaaaatgacggtcctcccatcccaccccccaccccaccctcacccccctataaaatgggggtggtgataatgaccttacacagctgttcaaaatcatcgtaaatgagcctcctcttgggtatttttttcctgtttgaagcttgaatgtcctgctcaaaatctcaaaacacgagccttggaattcattcattcattcattcattcattccacatatatttattaatctcttcctctaggtctcctccaggagcacctaatccgggggagacagagccggatgagagcttggaaccctactaagttaggactgagcaggggaagggacggcctagggggagtggagcagccgggcactccggtaacaggaaccgtggtttgcccccacgctccttcctcctcacgcccaccaactcgcagcaggacccttgccccccttacacaccctgaatcctccctctttctgcccacactgccccacctccctcgcgttctgcagccgcctccccctgatccccactgcggtctgagccgaggtgtgggggggggctcctgaaatcccaccccagccctggcgattagcgggtagtccagattctccccatggccaccaggtggcaacagcggcgcgcgtttccccggccgggcccgccctgcctcctcccaccgcgtttgctaaacagacttttccggtttcagacagaggaggggagttaaaaagcccagaactactgaattttgtggcaaaaaaaggatgagacctctcggggagagacccctggcagccaatagggccaggaggcaagaggcccaggccccgcccctttggtctgggggcctccctttccccatcgatgcatctagatagggaaacagaggcctggatctcggtgccccagccacacggtggctggtcagagttctgcaaatgccccccgccccgctccggatctgccacatcccagcttctgctcaagccgttccctccaccaggcatgccctcccttgagcgtttatcctcctttcttttttctgagacggagtttggctcttgttgctggagtgcaatggcgcgatcttggctcacggcaacctcccgggttcaagcgattctcctgcctcagcctcccaagtagctgggattacaggcgcccgccaccctgaccagctaaaatgtgtttgtatttttagtagaaacagggtttcaccatgttggccaggctcgtcttgaactccagacctcaagtgatccacccgcctcggcctcccaaactgctgggattgcaggtgtgagccctggaggcccctggagttggccgcaaacccacccctatgcacagtcccttgggtgcgagaagtaggagacaggcaatgtttactggcagcagctgggacttttgccagagtgcatggggaagatgcacaccctgcttccactagcgggagactgagctggacagagggaagcctggagcttggagcctctttccttcctaccgtggggatgcctgtctgagagaggagcctgcagggaggacagcagcaccgagatgaagcattagttcctggatccagccatacctgaaacccaatattttccatctggttcctctttttaaaa

SEQ ID NO: 12496 - DNA, 6308 bp, Human
atgagcagaattcaaccagttatcagatggaaggccaaggaagcttggggagggctactgaggggatacggtaggcttgtctgtggagagcaaaattcttcagtctacaaagttcttttctgggctccttcatctttcggtttctcttccagctccctcgttttgggcctcttttgtttccccattcccctcccctgggccttcccgtttggaaaaggggtcacatatcctcaccctggaggcgtctgccccttccacacagttggtgttggaacagtggagctcagagaggccgatgctgaccgcgtagatgtccagcaccaacagtgggattttgggccctgtgggggacacagagagaactctccgggagtgcggccccttggcctcccctctgggtgcccagtgggcagtgggcctgggtggctcagaatcccagccaggagcactgaaggtcaacaggctcccgccctgagttttctgagccaggcctccctgtttcctccccagccagtggggagcgcagtgaggggcggggcctggagtcttgggagctccctggacaacaacatgcatttagcgcagctcagtctcagagccagcaggatatgttttcttaaaaaaaaaaaaatgcctaacatcttggctttcaccgaagggttggtatctgctttgtacactttggccttcttggcttttcactgaaacacacacacatggatgcacactcacttccacacacaaacccacaccaagacagacacacacacacactcacacacaaactcatgtacatggtttcatacccacatccatgcaaacacacatacaaatccagaaatacgcaccctcacacccacaaacttgtacacacacacacacgtatacacaccaacacacatacaaccctggcttggacaaaagcttcccgttttttcttgtttgaagtggaaatctcccaccttccatgagattcaatttctcgcccttcccccgctaaaatcctcctggccccatcatttcttgggtcctttccagacagtgctgtgtctttaaggaagttgaagctgctaaaagtgagtgagagagagagaaaaaacacaacccaaaaaaatttggcatctcttcccccctcaagtttctggtgtcacttatgaaacacaggtccttgttgctgcagagaagcagttgttttgctggaaggagggagtgcgcgggctgccccgggctcctccctgccgcctcctctcagtggatggttccaggcaccctgtctggggcagggagggcacaggcctgcacatcgaaggtggggtgggaccaggctgcccctcgccccagcatccaagtcctcccttgggcgcccgtggccctgcagactctcagggctaaggtcctctgttgctttttggttccaccttagaagaggctccgcttgactaagagtagcttgaaggtaagccagtggggaggagggctccagggccagcggcgggagcgggaggcctgttggacataggggctggttccctcttggtccatccctgctggtctgaggtgcgtgggacaatccctagcttggagccgtccagggggcatctgcttcttccacaacccacaactgaggccccagaaatcccagctgcgtttgggctgagcctctggcctcacccaagtcagctgagaggtcctggcgggggtttatttaggcagctgcctggctaagtttgaacagaacaggccacgggtgtgattccacagaaaaggcctggtgtctgctgcggtcatggccggaggagcgggagagggcgggtggagtggatgggggtggtgtgcactgcacaaggggcctcgtctgggccaaggcaaagcatacctatggggggctccggtgggagggactgcggccaggatgtgggagggcagggggaggttctgcaaagtgctgggggaggggggtggctggaaaacagatttcaagtcataaagtcagctaggaacaggccgaggcagggagaactctccactcggaggaggagctggggtcctcttccatcccgtcttcatcctgcctggctgcgtgacctcgggcaagtctccgcccttctcttggcctcagtttctccttccgtaggatgggggcggtgggctaggtggtgttgggatttagctgggttatgtgggacagggcctcctgatgggaaagagctctggctgggcttgtgggaggaatgagtccctttggcaggttctcgggatcccctgggtgacatgcctttctctgcaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggctgtgtccatcccggagcaggacaacatcgcctgcacctcaccccatgtgctcaagggtacgccgctgagccgcctgccgccactgccatgctcggcgccctcagtgcagctcagctaccaacccagccaggatggtgccgagctgcggcctggttttgtgctggcactgcactgtgatgtggacgggcagccggcccctcagcttcactggcacatccagatacccagtggcattgtggagatcaccagccccaacgtgggcactgatgggcgtgccctgcctggcacccctgtggccagctcccagccgcgcttccaggcctttgccaatggcagcctgcttatccccgactttggcaagctggaggaaggcacctacagctgcctggccaccaatgagctgggcagtgctgagagctcagtggacgtggcactggccacgcccggtgagggtggtgaggacacactggggcgcaggttccatggcaaagcggttgagggaaagggctgctatacggttgacaacgaggtgcagccatcagggccggaggacaatgtggtcatcatctacctcagccgtgctgggaaccctgaggctgcagtcgcagaaggggtccctgggcagctgcccccaggcctgctcctgctgggccaaagcctcctcctcttcttcttcctcacctccttctagccccacctagggcttccctaactcctccccttgcccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgcccctccgtgtctgcctggaattttgtctggatctaggagcctctgctgggagataggatcaggagctgaagagtcagggcagccagcctgcctgcccacagtggcaggggcctctgagactccaacagactgtggaggcacaggagtgctggcccgatgctgtgtcaggggctgggccttgcggtgagctgagctgcagatgttcccttcctccaaaccatcccacaggacagctgggggcaggagcctggggtggctggcgaccctgagcagcgcctgatgtcagcagtggcttcaagagaggcattttggaaaggcgcaaggaaatggaagtgcctgggtggtagctcctcttccctgtcctgctcctggaagagatgttaggaatgaagaggaaagaggggacaggtggggcaagatggaggagacagatgaggagaaggggacacaggacagaggaggagaaagccccagagagactgggaataagagaacatatttacatatttgagggagaaaccaggggggaaacaaatcgtacttatctttctcccaaagaagaaatggtattccaagaggaaagtccaaatgaggactgcagattccctgtaggaatctttccccacagagcaagtggatcagtaactggcctgggccgtgtgtgtgtgtgtgtgtgtgtgtgtgtgtgtgtgtgtacagcaacctgagcggtgcgtgtgtgtgtgtgtacagcaaccttcagcctctccagtgcatgtgtgtgtgtgtgtgtacagcaaccttcagcctctccagatgaggagcataaggatgaggtcctaacctggagactctgcacaacctcctatctgtgccaggtaggatatatgtcttcctactgcctctatcccatccctttcaagatcgaggatgctgcatgcagagacaatggcctgggggagaggctctgtggcctttctccagagctcccagaactgctgagctcagcaaagtggaggcaggatgctaaggagtctggggtagcagctgtgagccttggctgctggccagccccattccctccctccaggtccacatacagcacctccccctgcccactctcccctcatcaacttgcagctcctgctgagctgatgtcaccagcagcatgtatcaagaatgactcctaatctaaaataaaagttgaaaaaaatgactcacgtctggtggaaaacagcaggatggagccaaattccatgcgctaggccaccttgggtaagtcattgcccacgtctgggcttcagttgcctcaaaaaccaaatgacatggtaggactaggtgctacttcatggtccaatagactctgattgcctaaggcttgatattcccagcctgacttggacatccctggctccattcctagctgagtggcttggcttcttggagtaggacatggacctaagacctaacacagggaatggctgtgccttgagtggactagctgctcccctgctttaaggtcttccgtggtccccactgccctccaggtaaagcctgaattccccacttaaagcctctctgacctgctcctccaacaagcgcacccttccttcctcttcttggaacagctatttaattgttcccttaatgttccatggtgtgccatcctctgcacctttgcttatactgttccctccgcccaggcaccctttccctgttcttcatttggctaagtcagtctttgagagtgggctctggcatcaccacctccagaaagccttcctggatgttcccccatccccaatgtgaacaggccccctttctctgggaacctggattctcctcccctgagaccctgttagttgctgaaacaaggtcaggaagcctttttcaacgggctgcagtgggatcacagtgtgccctctttggcctcctcggggcagccttgaaagtgggtttcaggtccctgaccccacccctggctttacaggtatttgaggctgtagcaggaacctgagcttg

SEQ ID NO: 12497 - DNA, 78269 bp, Human
aagtgaactttttaaaaccaaaacaaacaaagggactatttgtttttgtttatgttttccttaaagtgagaaaaaaatattgagcctcctaagtttgcatttaaaagttggcaaagatgagtctcagttagtgggtttgatggctctatgagaaagagaataaaattacttacgatgacactccatgtagactgagcaaacgaaagactcctaagtattgcaacagctactgatgatattttgttttcccggatgagaacactttgtgaagtctataactcttttcatctgaaccaagcaggtgtaaaatgtactttcctcagaggagtttgtagtctagtttgagaagatagcactgtattatctaggtttgctggtagtgacagaaacctcaaaataactgagacttagaaaatagatattaaaaaatgtaatccagggctggcatggaagatccatggtcaccagggtcccaggctctttctatcttatactccattgtcctcaacattcaatttccacctcatgatactagatagctgcttcagctccaactgttacctcaatattctagtcacaaggcaggaggaaaagggaaagaaaaggggatgacagatcccactaaggaaatttcctagaagttgtgcacacgacttctgctacattcagttgaccagaagacagtcatacaactacacctagctacaagggaggctaaaatttgtagtctttattcttgctggccagatgcccagataactgtcagggattctgttactctagtaagaaggagagagtagctatttgggaatagtagcaatccctacctcaagcccatactcagaaaaaaaaaatactatcttgtttgggcagtgtatttccacacatatgtcttaagaatctcagaatgggggaggtaatttaaaatataccagtaccgtaccctcctgggtgtcttgattatgctggggcatccagtatatgaaataaaattaggctgttgtctggtaatttacatttaaaaataaacattggagaatttcactcctatacagcaataattattatttcatttattatttatccctacccactacatgcaatatctgcttacactaaaatctcttgattattaacatagtagaggtaactgtcacacattatacttcaactatgtactaactctaaggtgacatgtatgactagcacctaccattcataagatgtatgggattcagtcctccaaaggaccctcacaaggaagctaaggatcagagaagtcatggcttgctcaaagagaaacagcatagtaagtgacagagctgggaatccaacacaagtttgtctgttttcaaagcccacatatactttgtttattatgccattctgaaggattcacttatttttcactcttccacaaaacgtcaggacagaaaggcagtcatctatatgtagcattgagaaatttctatgggctttaatttaaatcttaaaaactaataaacttcagcaacatatttcttcactttaatgtgtgagggttttgtgctcattacctcttttaattgtccaacccaatttggtgatgatccattcaacaaatttttcttgaacatctgttttatgtgtcaggtactgtgatggttgctgagtatatcatggtaagcaaaaccacacattgtccttactccttgtgctacatgatttaactgctggatggattaaaccaggaactataaagattaaactgtaatccttaccacaattttgagtttacagtttttcaaatatcatttcaagccattagcaaaggctgtatgtattttttacatatgcctcctcgttttgtgaattttgaaaggatgtggtttcggcctttgacatcagaggagaagctcagctatgttggctgaacgttgatagaaagataacgttgaaggcaagttgcccttgagcagctctctgaagatcaactgcctccacattgcattctttgccccaaaactctttcctttggttgtgctaagaggtgatgcccaaggtgcaccacctttcaagaactggatcatgaacaactttatcctcctggaagaacagctcatcaagaaatcccaacaaaagagaagaacttctccctcgaactttaaagtccgcttctttgtgttaaccaaagccagcctggcatactttgaagatcgtcatggggtatgtgagcagtttcatttgtcttttttcgcatagcattttatgtttggactgggctaatgcaaaaatatatacatagcataaaatagagcacaggaaacacaaacatgcttattgtaacaacataaaaagtacagtaaaagtaatcagaggagaatgcagagagcagtcaagaggtgaaatggtggtgctaggtgatttcagttctaaaaactgtaaatttaacattcatcagctttttccccctgcaaggttatgtttggtttttaaattatgaataacattttaggtagcaagtattatgattcgataaaacttgaactttctatgaaacatactaaatttaatgaaacatactaaatttaatgaaacatagattaatacaacactagcattcaatgggatgatctaccccagctttcttattttttagtggaagaaactggtgtttagaatggttaagttttgggttcagtgttaacgttttcatgaataactctgtttgtctcaatactcgtcgctagcctgatcttgaaataagatttcccaggcatttaattatctaaaagttgtaaggcacaatggcaaacctcttcatctcttgatagacttcttaggacaccagggttattaagaacaaagtttctgcagtgcagaccagcggttcttacccagaaggagtatggctgctttgctaggtcagtctatctctttatctaaaaatagtcttgtgcttcttaacatcactaataacaaaagcaacaggaataatcctaataatgtagtttggtagaaaaagcattggacaaagggtcaggagaccaaactctacttctcagtaggtgatccagtctgggcaaatgtctacctcctatttcaggttctttcttcataaaatgaaaaaactggaaataacaaccttcaagatccctttcttcttcaaaacttctttgctttatgcagtggctcttgtttagccctatgctgcaatttttcaaagcatgtttgatttcttactgtatggttatattatttttacatcattagtggggtaggacaaggattatcacttatattttactgaagggaaaataatattaggtgcctgatggtcacttagaaacaaaagtgctccagttctttgttggagtctgacttagtaggtggtggcatgagtttgggattctttggtgtgccagggtttaaagcacttcatgagatggagctccagaggaggtcaggctgggtatagagcctatggatgcctcactttttaaagttgcaggtgttgcatgtcttttgtgaattaaaaaaatacagaaaacaaaaaagttgcaggcgaaatagctctgcctctttagaagtgaaaagaattgcttgtcttattatcagactcttactgataacaatttaccagtcaatcagaaaacacatggaattacgtgcaagtcctctttgctaggtggccaggagcccagtttgtgaacttgggggatttatcatgtagagctaataaatcgcatggcattactcaatgcttttttgtgaatggaacatttaaagtttttgtttcatattgaaagaacagtcatgtacctttaaatatttttttcaaagtccattttgcagttttcaccagttcgtttttctgattcaacatagtatcatctcatttagttagtattaataattccttagcccaactgctatttgtgaactgattgtgaattcagctcaatattatttgtaagtaatcacaaaaccagatggccttaattcagaatattattggtcataatttgcatgtagacaaggttgtaaaatcaccctacttctttatctgagcattatggaaaatttcaagacaattacttcattctggggagccctaggctacagtttctaattcttccatgtgagatatagagaatacatgtccaaacatcaaatttcttgttttctaatgccttttttactcttataaataacattttaaaagtatttctttaattatttaattattatagaagtttattaattagaaatttatccaagttccctgaaaaaggtaatatatgtgaattattattgttcatgtcttaggtatactacatggtttcaggccaccaatttgcacacaaggctgcattaatattactcataagtaaataacattacacttatgggaagaacattttcatttttaaattaaaggcttcattttcaatctgtaaaatgggtgtgataatagtacccatttcataggaagatggcaaagactcagaggtataatgtctttaggctgaactttttgaaattatttggcagatcgaatatcagatattagaagtttcaaacaattcaacttaatatattaggtacttagcataggccctgtcatctggtaagcatctagtaaaaattaaccattatttgtatccctttcatgtctctacagaagctagcaggctgtcataacaattcattttcaaattatgggagatattcaaggattcttcaaagtcaagctaagatcagggtcctggattccttctattctgtggctaaatataagttttgtggggtagatatacatgcattatgagctgtttggccagttattgcccctcttagggtgtcgggtgtcagagcttctttttctcttttctcatgtgtaaaattatgattcttgcagttctcatattctatgaatttataacaccatatgaaaaataacccttctacatactcaagaacatattctgtaattctagaaatcaagtatgtttattctaacctaaaaaatcatgcctattgtcattataatactaattgattgaggttttactttaacatggttttagttctggtgttcgatgcctgtttttcctgttgagatgtgcaagtgttttcagaggggccaagaagcgccttcatcttgctggagcagtgggccagaaagaagcatagatttggcaggtggtagcttgcagacagacatgatttcagaggctctcctgtgcctgtcaatttttttccaagttgtccctgatgcctgaaattctatgacagaggacaatgagagataagggcacatggatgtcctggtaaatgcttaggaatccgagtacagggcttgttggagagccctgattcatagtgtttgccaattcctttggtgtaaatattcccatcatggcccattttaaactaccaatgtgatgtctgctggctcacagattcctgaaaacttaacaattagctacctcgggccagtacaagccgagtccagcacactgtcggcaagcctaagtacaaatgatccttggagaggtagccaccaactaaacagcatacttagttgcacgtgactgatatcggatccttttcagcggtaaagggaaaatggagagcctcaggcactttgagtaagcacaggatggaagaggcagcctaaatgggaataaagcatcatagattggtgtggctcacgtggccactttctagatgtgggatctcagaccagacacttgacctctttctgcctgtgtcctatttgtaaagtaaggaccccaacactacctacttcaagtgatgttgagtatttcatgagaaaagtatgttataagctttttaccaattgctacatggtaaggtgattattactcacaattttgcccaagcaccaccttggtcttctgaaagcccctctggagaactggaaaggttctcctattttgatgactctttgccccttagggatcaagtgtgctgtgctccttatgatgtgggaggcattatcatttacatggaacaagagaaacagtcaagatcaccattccagtaagcatctgggtgagggtctccactcctcatggccttttccctttagcctacagtcttatctagcaacagaaccatctcctgcttgcagcaagcatcctttctaaattaaagatggtaggtggggagatggtcccctttccttgcttttgaaagcattactgctagtgatcacaaacactgcttctggaatcagacagatctgggtcaaaaactagctcacatttgatctgtgtgattttgtataaattatataatgctgtgcaattctctaaaaagctatctttttttttttttttagacagagtcttgctgtgtcacccaggctggagcacagtggtgccaccttggttcactgcaacctctgcctcccaggttcaagtgattcctctgcctcagcctcttgagtagctggaactacgggtgcgcgccatcatgcttggctaatttttgtatttttttttagtagagacggggtttcaccatattggccagctggtctcgaactcctgacctcatggtctgcccacctcggcctcccaaagtgctgggattacagatgtgagccatcgcgcctggcctatgtttttaaaataattaagcaaggccagacacagagactcacgcctgcaatcccaacattttgggaggcctaggtgggcggatcacttgagcccaggaatttgaaaccagcctgggcaacatggtgagactccgtctccacaaaaaaaaaaaaaaagccagatgtggtgctgcatgcctgtagtcccagttacacaggagggtgaggtgggaggatcccttgagcccaggaggttgagactgcagtgagctgtgatcatgccactgtaatccagcctgggcaacaggctgattcctggtctcaaaaataaaataaaataattaaacattccttcatgatcttatttccttttaataagatggaggtcacctttattctcataagatagtaactaacatttactgagcacttactacatgtccaacactgtgcaaaaatgtgaattatttcacctaaccattataaccactctgtaagttaggaactgttattaccccaatttgtaggtcaagaaattgagacaaagagggtttaaacaacttgcctgatgtcccacgtctctagagtctacattactctctgataaatagtacttattaccatagttgttactcataggtaatcagggattccattgggttattacacagtatgcaatacattcttgctctgaagtccccagtgtaaaggacagtcctgaaaattggtaccccctgccaaatgggtcttctgcaatgaaatattttaggacctctacgttttccacaaatgccccaggacaaatccttgtctttattcacttcaagaagccccgctatgtgtcttaaaaaaaaaaaaaaagagagagagagaggcgggcacgatggcccatgcctgtaattccagcactttgggaggctggggcaggtggatcacctgagggcaggagttcacgagcagcctggctaatatggtaaaaccccatttctactaaaaacacaaaaagttagccaggcatggtggcagatgcctgtaatcccagctactcgggaggctgaagcaggagaattgcttgaacccaggaggcagaggttgcagagagccaagattgtgcgattgcactccagcctgggcaacaagagtgaaactccgtctcaaaaaaagagagagagagagagagagagagagagccttggcaagctttgcctcctaaagttctcctagaatctccccagattcccacaggatatctctcacctgggactgtcagcatatctatcacctgggactgctaccacctctcatgttgtccctgcacccgcttcacccctgcctgccacttcatcctccacatggcaaccagcaccagcttttcacatgtgactgtagtcaagtcctgatgaccttcatcagacgttgatgtgtccctacagcggctctccccattgccctaacgatggacaccagcagaatctaacacatggtctcgtctgtctcagctcatgtctcactttccctcatctctggaatccaaccacaccaggttttcttcaacgttaaagcctccgttttaagtgtcacttacttgggaaagccttccttgatgtccctagactaagtcatgtcctcctgtcctgttctaccacagcaccaggtgtcctttcttcacagcacatgctgaagttgtaactactcatttgttaatgtgatgatgtattaatgtaatttccccacctcaccctccattgaactatcagctttatgagagcaggcacccaagttgataaagatggccttgccagtgtctacaagagtgtctggcacacactattcactcatgcatcatttgtggagggaataaaaggagaaagggagaaaagaaaggagggagtaaggacataaggtatagattcagctggagaggttagagacacaaacgaagctcaaatagagaaggttcaatacccaaataatagagaccaaggcaagtgacataggacttcaaaagggagattactgggtgtagaaacaagtaacaaagactccctggaggtagtagtgtgtggcctatcgttgaacaaggaagaggaagattcagatattcaggtggttggaattttaagtgctgggtcagaaaggcacatgtaggaactagcaggagggccgggtcccagccctcaactctttttaggagaattaagcaactcttttctcctttttcctctgcctgtcttacccctccttccttgccttttacagctaaagcctccgtagataatattctttttttttttcttgacccagaaccttgctctgttgcccaggctggggtacagtggtgggatcacagctcactgtagcctcagcttcccaggctcaagtgatccttctgcctcaacctcctgagtttctgggactagaggcatgcaccatcatccttggctatttaaaaaaaaaatttatagagacagggtctcactatattgcccaggctgttctcaaattcctgggctcaagcaatcctcctgcctcagcctccaaaagtgctgggattacaggcatgagccaccatgcctcgccatgcagataatattcttaaaactacccaggcatttttacttgtgacattgagcagtcatgggctctcttctcttcattcccatgtcattcagttgccttccagctgggcttctgctggcatttgaagttttttacagtctgttatccacacaacacctagaatgaaccttaaaattttaaatcagatactactttctaccttaaaaccctccatggctatttagggtatttaaataaattctcaactatgcccttcaagacccttcatcctgtggtcccagcctgccttctttatttcacttcacaccacactccctttatgtgcttctgtcacatctgccttcttcctgaaccataagcactccaagctcaaggtctcagcagggcctttgtacagggccaggactagggtgagacaagtgagacacacacataaaatggcactcattctcaggatgcaggatctttgcattagctgtttccactgtctcaaacaccccagatttttgcaggagggtttgtttgtttgcttgtttgtctgaaacatggtcttgctctgttacccaggctagaatgcagtggcggaatcttgggtcactgcaacctctgcctttcagactcaagcgatcctctcgactagctgggactacagaagtgcatcaccacgcctggctaattctgttgttgatttatttcccatctcttcaaagcacatagataccttagtatctgcatttatttgttaggtttatggatctgcttccctgtttaatttctgtctgtccatctaatggaagggcagttccatgagagcagagatcttgactgtcttcttcatcacagtatcaccatcatctaaaacagttctgggcactggttagttgtagtaggtgatcagtaaatatccggggaatgaatgaaggtcacataactcatgttgcattcagaaaagcatctgaaagctaaaaatgtgggccttgtctagccacacagagacaagaaagggcccaagcaaagtactttgcaattgagacatgcacagtttgcatctgttttaatggagtgtcatcatgaattgatctttgcctgtgtaatgtgaggttaatgttttatggagataaccgttgtattgatattttcttttctcacaataaaattagatttgattcctactgttcagggactggtacacccattcatcagtttctgcagtagaaatagcccacagagaaatactataaacacgagagtttagattctgactcagtctgaaagaaagcagaagagctcagtttcaggctgggcacagtggcttatgcctgtaatcctcgcactttgggaggccaaggcgggcggattacctgaactcaggagtttgagacaagcctagccaacatggcgaaaccctatctctactaaaaatacaaaaaattagccaggcgtggtggcatatgcctgtaatctcagctacttgaaaggctgaagcaggagaattgcttgaacccaggaggcagaggttgcagtaggctgagatcgcaccactgcactccagcctgggcgacacagcaaggtgctgtcacaaaacagaaaaaaaggaaaagaagaagagctcagtttcttgaactacaagctccatgtaaaacaagacatgtaaatatcaaacgtggaaatcgtgtctacaaaaaactattttaaagctcttcgcaaatgttcatggaccaaatagtaaatcctcattccaccctcattttcttaacgaactaataatacattcctcccattcatcagtgaattatgaggcctactggaaaaagtagaccttccaggacataattttcatccagaggtcagtttgggtttggcttcatgacactcagaggcctcactaaaagtgatcctaaggagaaaacaggtctgtaatgccttcccatgcatataaaagtccccttttggatcaacagtcttctcagttccttgaaattcagtaaaagttttctgtattttaataaaataagagctagatacaggttcttatgtcttatgttgccatataattcctattaacctaaagttatttgtaagtaggcttctcattatatttttccttttctgatatttaaaaagtcacagaaattataactgtttgttataaaaattcaactatagggatttttccccccaaacttcatatattttgccatatctttattatgattattattggtttgtttgtttttattgactctgtatcaaggaaacgtttctgtgttggtacatttcaatttattcatttgttccgcaaacattttgtaaatagctgctctgtgccaggcaccacgctagatgtgaggaacgcagtggtaagtaatggaggcaggtgtcttaggttggtgcacaagtaactgaggtttttaattgaggtcaattacttgtgcaccaccctaatagcttgcattctaggggatgggacagacagcaagcaagtgtataactgcatagggcagatagagaatgtggtaggttctatggcaagaccaggcagccactctggctgaactgggaggtggggtggtcagagaaggaatttatagctaaactgaagtttgaggaaataactagttaaatgaagaaatgggaaagagcattctgggcagagggaacggcaagtacaaagaccctgaggaaggaaaaagcttggcttgcgtgaggaacagagatttgaacatgcagagttcaagagaggggcacaagacgaggggcagaagccaaactctgcaggcccttgtggatcatggcaaggagtttggatttgattccaactcccatgaaaagtttccaaggttgaagcagtgggtgtgagtccctccatctagaagtgaactgacagctatggggtcagcagattatacaatggccaagaatagaagccaggaagctgggtacagtctcctgcagtggtctcctgggccattgtgtagtgtcccatcctacgagttgttcttcagttgtcttatgtttttttatttatttatttatttattttatttttttatttttgagacggagtctcactctgtcacccaggctggagtgcagtggcacagtctcggctcactgcaacctccgcagtggtcttatgttttaacttttttgtggcatccttcttcctgggggtactttgtccagaatcatctcactccatgttttgatgggaaagtgcctggtgtataacctgcgtcaggatcaacactgagctcagatagacagtagcagcaaagactgaaaccaaattagaattgagttaaatcagctttgattaatctcaagacagagcaaggaatattctgatcctcatattgtcaaaaaaaattaatgaaccaagtacattcagaatgttttctataatttggtctgaagacatcaatttactatctgtgtcagcactggtcttttccctcatgcagatgtatcttttgcagagttataatcataatgcatgacaattttatattctacttttctatctattctttcatataaatgtatttccatatatctacaatgcctccaaagtaatcatttttcatatatatgattttttaatggttgagtcagttcattgcaagaacatgcttatctattttatatacgtggaggaataggtgaacttatctgttagctatggttcaacattcaggttgtttccaggtataatgaaaacaccaaaaaaaagcagtatacataatatagggctgtctcatttttaaaatcagcttcttaggatagagtgccccaaataggataattgtgtcacaggataagaacattttctggtcttgatcatttattgctacatcatcttccaaagagattgaagaagcagtgtgtgggccaccaaaagcggcaccatgtttgttttcagaaccattagagaagattatgtttctaaaaaggaactaatagaaacaaaagaatctcactgttgtgattttcaagtactccattttgaatgttttagtgagagagaggggaaaatacgtgatcttttatacataggtgagatggtttggtttaaagtcagtgtcacatgtatgtagatgaacccaccacctgcatagttggatttaaggggtgccaaaaggtctcctactctgcaaaacctgaatgcccgaactgactgtcacagagtaggggtggtctgaaaggttcccatgaatgagctctttgggttaggtcatgaaacaccttatcaaggagcaaatgaaatacaagaaggtgtcacaggagccacttttgactgttccgtagaagttagttttaattttagacagggcctatgacactgaaattctcaggctgtaattccagaaaagcggatgaggtgagcaaggaacaacagggcagcctaatagaaaagagatttggacccgggtcaccgggctaattctttactctctctgggatttagctttcttgtccataaaatcaaaggattcagctgatcaatgctttttcaaaatttaaaaaacattttaatataaaattatacaagccatcaccatccccacatataaaacagagagaagtggaagttctctgcttgaagcagggcagggaaactgcccagaaccctatgccccttggcctgtcccttactttcagggatcaacaagttatcttccaactctgtgacccttccccctggggtgtaaattgaatagtagaaatgaaaagacaaagccagtttagaaagtcaccttgaaacctcattgtcctcatctctaacattataaagttggactgaatgatttctaaagactcttccagttcaaaaacatggaaacttggctcacatttgtaataccaacactttgagaggttggcattacaggatctcttgacggcacgagtttgagaccagcctgggtaacatagtgagatcccatctccacaaaaacaaaaaataaaaaaattagctgggcatggttgtgcacacctatagtccagctatttgggaagctgagggaagaggattgcttaagcccaggagtttaaggttgcagtgagctatgattgcaccactgcactccagcctgggctacagagcgagaccctatctctctttgtttttaagtggaaattgtgtatctctgccaattatatcaggaattcacaaaaagtgatggagattagccaaacatggaaatctttccaggaagtaatacctttagggtgattaataactgtgtggctcatgagaaagcatgttgtcaaaatacaagcatgaccccaagaacgcaccctaaaaatgaagtcagacatttcatgtgtaaccaatacaaaatctgaaataataacagccaatatttaatgagttctcgctgtgtttcatagcatcaaggttaagtgttttatatgtcttatatcataaatattcacaataaccacattcattatgttatcctattgttatccccatgtcatttatgagaaggctgaggtttatagaaactaagtatctctatctaggttacacatataggacgaatattaaaagttggattaaatgttcttcaatggacattttcagatctaagcttgtttgggtctgataagtcttttaatagaagctgaaaaggcagagttggggcaaggatttgttggtgagtttctaacataatccaatagaggtgttgagtcgggaccagcaggcttgctccagattgcccagcagacttacccgaaagacagcagaaacatcatcaacagcaacaattttttttaaaaaaccacaatagttagcatcactacaagaagaggactgaacactttgttaagtattttctcatttcctccttacaattctttgaacaagataaaagtaaaattttgttttggtgaggaagcaatggagctacgaggacggtaagtaatttacccaaggaagcaaagtgaaaagtgtaaaggcaacagcatgccttaggacataaggattccctatactttgctcctacatacattagtgtgacctgtcctgatatctctgtggttacccaagtagaattacattttgcaagaaggtaattctacttaccttcacgactgcgagcatctcagccagtttctcgctgcgagtttgtgaattcgccagtctttggtgactttgcagagtgtgtttccattcacctgaactctatgggctgacaaacatgagttcctggacttgtaaacctgaggatctgttcctggggtggcctctgacaaggaaagatgctgtatccgcctcagcactatttaattttccagattaacaactaatagcagcattagccacttattgagccttttctgggaataacattctgggaaagctatatccaaagtggtaatacaaggagtaccaggaggaaagtattagcctagcgaagtgacccagaaagggagtttgagggagctaataccaaacctcacccttttccacaatccatgctgaggccatttccatgacaatgatccaatttggtgtttcccaaagtggggtactatcaggagcacacaagatggcacatggacaaatctggttttaacatgtctttaatagttatgtatctactataatttatgttagaaataagtgttttaaaatttatggtggtaatttaaagtttcctcctagaataaatttgtttatgtggaaaaaataagtcaattgaaagaatactattgagcagacaatactatttgagggaactagggtatggtagaaattgccaagctaagttggaaactgaagcctgggagcactgaatccttgggataacaacatgaatcataattcattataatttgcttttaagtagttccaagagtgaaatgtaataacctccactggacatttggagacgcagaggtgatccacagagtccagggcacttgaagatattgggttgctgcaaaagtaattgtggtttttgccattaatagatataagcacagaggagcagggaagatggtcaaaagagatcccaggcccccacgttctgccagagcacagtgagcaaatgagcctcctgccacaaactgaacccacatttctctcaatccaagaaaaggctgttctaattccaaacaagctcattgtaaacctcaataacatgaagttagtattgttcacgttgctttccaactgtgtttcagatttatataactggttcctaacacataattaactgctgttggaatgaatctttgtccccttgcctccgtgcctgctggacttcatatctgtgtattaatagtcacttttgtttggcgatcttgtgaaaaatgcagactaatttttaatccttaaagagataatacattcacataattttatttttattttttcagataatggcctttcgccatgtggcacatttcaataattttaaaaaaacagttgcaaaatgttatgcagtaacaaatctcccatctttgtcccaagtcacattgctgtcctacatcacagcaaccacgatagttaatttcttataagttcttccaataatactttatacatatacttgtaatactaataaacattcttcttttcttcctttttaaatagtagtaacatactctgcacacacttcttaacttttcttttagttggttaacaatgtatcctggagattgatccacactgatacacaaagatattcttcattctgtttatggttgcataatacttcattgtatgcatgaaaaatttcttttaatgaaggttggtctgtttccagtttttgttattatgcacaatgagaaatgaacagccttgtagatgtgtcattttccataaatacttttataacagtggttctcaaccaaaggtgattttgcccaccaggggacatttgacaaaacctggggaaatttttggttgttataagtggggaggagggtgccaccaacatctagtgggtagaagctgagggtgctgctaaatatcctacaattcacaggacagactcacaacaaaaaattattcagcccaaaatgtcaataatgctgaggctgagaagctccagtctgtagaaaacatttctagaagtggaattgctgagtcaaaggatatttgcatctgttattttgttgactatgagcaaattactctctacagaagttgtaccagtgaacattccccagggccacatgtgagaagcatgttttctcaaaacctcacaaacaccattatcttatgttttgatctttgctaatctgataggggtttaaaaaatagtacttaagtataatttatttgcatttctgttgttatagtgacattaagcatctttccatatgcttaaatatattccttttgttcattttcctataagtttattagtattttatttaatttgtaggagctctttaactaccagctaaacactttgggcagactagttttaacctacattttcattgtcaagagatttttatccacctgccaatttttctggaaatcttattccaaatcatttccattaaaagttttgtcatagggttcacaataatcactttctgctgcatacttggttttacttgctgttccttcaatcaattaacagatattaattgaacatcgcctcagtgcaagcagttatttcctgaaatgcaatgaagtttttatgcacttatgtattttggctactggtccttcagtgcttaaaaagaagacacaaaaaatacgttctttcaaactcatttaacatttcatatttcttattctgggaggaaggtctttgaaggaacattcacagctcagagatactgacagaaacaatacagaggatgccttgagaatctactttatgcttggaaaatatcacttagttcttgctcctaatttccacataagtccttttctctctgctcccttttgtaagaaaatctaaacacacatgttttcaacatgctaggatcatgttaccttgatctagtaagaatggggcttggacattattcctgagttatcatttcacttataagataaatatacccatataaaagcacactgaattactttattagaatctatgaagaaaaaggctatccctcaagaagaacatgagagagactgtcatgtacttgaacccccatggatacagatgagcaggtggcaggtgctctctagctgctgctcactgctaatggggttatgcggtttcaagggcgtgcatcatttcgcacacccagcatttgatgcataccccttattcctctcccataatcatctaagttgacactgtgatgtttttgaaacttctaactgtattaaaatattattttcatttctctgcttttcctcctgcttcacactctctgtaaaaacttcaaatatcataagaatatataactttgtgaaattctgccacagtggaacctacaacaaagaaccagtgttagcagcttggaatgtttttcttcttgtattatttctttggatattgcatatactaatacataatctcttcttccaaaaatgggatgatgctccatctgttgctttaaatctgctctttaacacttggtatatacttttgtccctctgtatagatgaactttattatctgttaatggttacagagtagtcattatgtatgatgacgaatttaaccatacacagatggatgtttaaccataactaatttaaccatttgtctattgatggatatttaagtttttccagtttattttagtgtaataaataatgcttctgtgaaaatcctttttattacatctttatatattttgaacaaatgtttccatagaataaatcagatcagggaaatgtatttattcattttagttaactgtttttaatattataaaagaaatacacattcatggcaaaatattcaaagagtacagaaggatacaaggtaaaaagaaaagctccttgggaggccaaggcgggtggattgcttgagaccaggagttcaaggccaatctggacaacagagcaagactctatctcttaagaaaaaaaaaaaaaggaaagaaagaaagctctcttcacactccctactcccaacccccaggaccacccacacaggtatctgctcttcatagtttcttatgagaaaacacattttaatagatgatcctaaattgccctctgaaaactgtatgtaagaataattctttttcttttcttttctttccttctttgttcctttccttctttccttttgaaaagtctcacttttttcatttgggtggccagggtgttactattttcaaatggcaggttttaaaggaagtgaaattgttttcctcatagcacatccagccacatggtaacccacagtgcgaaatgctgaggtggagaaagccagccaacggtgggccagtgatgagtaagaggtcttatggaaaagaagagagaaacgaaggcaggtgtgggatggatcagtttcctggctttaaggtggtccagggagccttgaaattaatggtcttagctccagactttcccagagctttagaatagagggaggttaggtctagctgaagatgggctggggagggaggaactaggaacagctcattgcaaattgctctggtgttttacaagatgctaatttttccatagagacagtaatgagcatatcttttttgttttgttttatcttgttttgtttgagacagtgtctcactctatcacccagagtgcagggacatgataatgactcactgcaacctcaaccccccaggctcaactgatcctcctgcctcagcctcctgagtggctggtactacgggcatgtgccaccacacctggctaacttttaaaatttttttgtagagacagggcctcactatgttacccagactgttgttgaactcctggcctcaggcgaccctccttctttggcctcccaaagtgttgggattataggcatgagccattgctactagcatttgctagtaggtttatgtaattttaaaaaattctcttaattaacttaatgattcagagactattcttatgtcgcttttgaaaaatgaggcaactgagaggttgagacacttgcctcaggttgcacagctgataaggaatgaggttaggatgcaaacctgagtctgccctacttgaaagctccagttctcccctactctgccttaccagaggagaaagctgaaaactgctatttttttagaaacgtggagatgtccttttcccatgggtagcagacacataacttctcatcgacacatttgctgggctagtccagcagcaaaagagccaatgttgttggagcaaagaggagtggctattctgaggaaccagggagtgtgttccacctttgcaatccagcataagcattgctcagtcaaatgggacagaaacaaagctctgcgagtccatggcttggtgaaatgggtcacacaattgattttccagcactgagttcagggaatgatagtcttctgtggaaagtcccagcaagtgctaagccaggaagcatagtagttaggttatcaggctctggagtcatagagtggagcttgtacgctgctcttctacgtattaagagggttggcctctgtgaacttcaattttctcatctataaaatggggagataatatgttgtaggatcgtgatgaaacaggatggaatgttgaatgcctggaatatagaaaatgttcaaaaatagtatcattttcatgttttttcctgcttctctctttgaaacttataatccaagctctatttcataaaaatattaacataaaaagccgccctgccccctcatctatctatcaagcaatgcacatttatgggaaacctgatgctgacccatttgtaaacaacctgtttctgggttggggttttgtacatagcagagcagctccttctctgtgagatctattgaaagtcagcccttaatacaagggtttgttaaaaaagagaaaaagaaaaagaaggaaagaaagagagaaaggaaagaagaaaggaaaggaaaggggaaaagagagagagaaatagtaacataaaaagaaaaaagatataaaagctgattgcacaagcttacccttgtgaagatttgtaagcatcagcatcttgaattgtgtctgacacgtgtcagatgcttgggatgaaacatcagactatgaggatggcatatctttgaacgtggccaagaaaagagacaagggtaagcaaggtcctgtgactttcgccccaagtaatgcagacagaataacaagtaagaatgagagcaggttgtacttggcctctccctttctctggtggcttttgtgtggtttccttggaaagttttaccctggcatttttcagaaatagcacagttgtttgggatgattataggcaatcaccctttcccagagactgaactgtgtcgggctcattgaccagccaccccccggggaccaactagggaggacatagctggtcctgctgtttaccaagtattggatcttgtgagatgccagaagaaccaacctcagggtctttggaaagactgaccaaccagtcaggatggattgtggtggtggatcccaagcactcatttgggaatgagagtgacgttgacggtggaacatgaaatccatcccaacagaagagcaagcctgagagcaagctcatctgacagcctgttaaggcacaggcacaaaggaggccatgtgagttggtaggagaactcctccttggaaatcttggagtctcgctgtccactaaggtaaccactagcacctgaagtctactggcataggggtctactgagcacctgaagtatggcaagtgcaaattgagatatgcacaaaatatacaatttcaaagacttaagtacaaaaaaaactcattaatttttgtgtggataacaatttttttaatatactacaaccaagtaagattttattttcacaaatgcaatgttggctcactatcctaaagtcaattaagataatatacaatattacttgaataaatgtcaaaaaagaacatttcaataaacaaagaaaaatatttgacaaatccaacactctttgtgataaaacccccagtacactaatagaaaaaaaattttgagtcttgcaaaaagtcatctatgaaaacctacaactaacattatacttaatggtgaaagactgagtgctttatctgtaagtctgggaacaagacataaatttccacttttttttttttttttttttatggagtcttgctctgtcacccaggctggagtacagtggcatgatcttggctcactgcaacctccacctcctgggttcaagggattctcctgcctcagcctcccgagcagctgggattacagatgcgtaccaccatgcctggctaatttttgtattttcttagagacaaaattttaccatgttggctaggctggtctcaaactcctgacctcaagtaatccacctgcctcaacctcccaaagtgctgggattacaggcatgagccactgtgcctggccaatttccacttttaacactctattcgacactgttctgcaagtactagccagataaattacactataaagtgaaatgaaattctccagattgagaaaaaaaagtagaactctttttcattgcacaccacataattttccacaaaaaaaaaaaaaaaaaaattgtaaggaacttcctaaaaacccactaggactattaaacaaattcatccatgtcaaaagatacaagatcaacatacaaattaatttttttaacttttattttaggttcagaggtacatgtgcaggttttcatataggtaaattgcatgttgcaggggtttggtgtacagattatttcatcacccaggtaataagcatagtacccagtaggtagattttcaattcccaccctccaccctcgagtaggtgccggtatctgtggtgcccttctttatacccatatgtgctcactttttagcccccacttacgagaacatgcagcatttggtttttagttcctgtgttagttcacttgggctaatggcctccaactctacccatgtcgctgcaaaggacacaatctcatacttttctatggctgcataattctccatggtgtatgtttaccacattttcttttcttttcttttctttttgagacagagtcttactctgtcacccaggctggaatgcagtggcacgatctcagctcactgaaacctctgcctcccgagttcaagcaattcttgtgcctcagccacccaagtgcctgagattacaggtgtgcaccatcatgcccagctaatttttatatttttagtagagatggggtttcaccatgttgcccaggctagtctcgaactcctggcctcaagtgatctgctgccttggactcccaaaatgctgggattacagatgtgagccaccacgcctggcctcacattttctttattcattcttttgttaatgggcatttaggttaattctatatctttgctattgtgattagtgctgtgatgaacatatgtgtatatgcgtctttatggtagaatagtgtatattcctctgggtatatacccaagaatgggattgctgggtcaaatggtaattctgttttaagttctgtcagaaatcacctaacaatttgaaatgataatattttagatattgggttaaacaaaatttattgttaaaattattacttgttatgttttgcatttttgaatgtgcctactggaaaaacttttaagttacatatatggctcatgttacatttctattggacactatcactttagaacttcacatagaatttttatccctgttcacaattccagttaatatttgcctccactgtctgccctcatcacaatgctgctaggctgttaacaagccagacttacccagtatttttctaccccaggattttgccctggctgcttgctctacctgggatgctcactcccctagaccttctcccagatggctcctgttcgactttttggtctcttcttagatgccctttctctctccagagaggtctgccttggccacagtttggtcacatcaactgttctattctctttccagcacttctttgttttgtctgccttcccaagtatactacgggctctgtgagagtctatcatgttcatcagttcatttcctgaactcagaatagcacctcactcatagctggccctccataaatatttcctgaatggctaaatgtactagccttaaatctgtttaagattgtttaaactgtgttccaacctgacaccctttgttttgagctaattaagctccactgagggccagccactgctgggcactgggtatatgggaagatgccctggtctctgaccttagggagctcaggacctagtaggttccaaagacaaaaatgtcagcaaatggagttgtcatatcacatgccatgagcctgttgtttttatttcactatgcatgccctaaagaaagaacccaacagaggtcaaaacacagcaacctcaagctcgtgcaccctgtttaccagtagctgcagacagttcttgaaaaggcagctccgctgtgctctactatttgtgaaaaaacaggttaaccattccaaagaactgtgattatgggcaggaccagagcttgcatttctaacagtaaatgagaagatagtttgagcccaaagggcacgtttgcagaggcttttgcgggaagacaaacctcctaatttagcattagactacaaaagcaagttctagactgatatgtagagcaagacactcattttcctttatatataccctataaaagtgcagggaaaagacaaatatactccaaatgattaactttggctacctcagggttatggggaagggtgggataataacacactataaatattttcttcacatgcctctgtagtattttgttttgtttgtttgcttgtttgaaacggtgtcctgctctgtcacccaggctggggtcgacggcaccatcactatcacagctcactgcagcctgaaacatatgggcccaagtgattctcccacttcaccctcccaagtagctgggactacaggtgcacaccatgaggcttggctaatttatgtaattttttgcattgtctcactatgttgcccaggctgctctcgaattcttgggctcaaatgacctcctacctcagcctctcaaagatctgggattggctgggcatgttggctcatgcctgtaatcccagcactttgggaggctgaggcgggcagattgcctgagctcaggagttccaagccaccctgggcaacatggtgaaaccccatctctactaaaatacaaaaaaaattggggaccagcgcagtgactcacgcctataatcccagcactttgggaggttgaggtgggtggaccacagggtcaggagatggagaccatcctggctatcacggtgaaaccccctctttactaaaaatacaaaaaattagctgggcgtggtggcacatgcctgtagtcccagctactcaggaggctgaggcaggagaatcgcttgaacccaggaggtggaggttgcggtgagccgagatcacaccactgcactccagcctgggcgacagagcaagactccatctcaaaaaaacaaaaaagagaaaaaaaaaagatctgggattacaggcattagccaccatactgagcctctacagtgttttcatttgtcacaaaaaacataaatagattttgtactttcaataatggataaagttgtttttacttaaaaaactaaaaaccagacaccacaaagctttcctgtatttgatagggtctgcttctcgcatcttgaattttttttatctcagttctgttcctcagctactaaatcaaagatcagcttccgggctgaggacccaaaaacaggaagtaaagactgaattcactttgggagaatttgatgatgtaatgggtccctggatatcaaccaagcacgctcatatatcacaaatctcttgcgatagttaaggcttccttaacttctttaattgggaaggtaccctttattgagggcatctgttataagccagttaatttgttgacatcatcctattttattccccaatcaactctcaaaaggtaggtattatccccacttatcagatgtaaaaaccagggttctgggaagtttaatgaattgcccaaagtcacagagctcttatagtaagaggcagagacctactttaaacatagctttcccaaacgtgtgctcatttcaccatcatttgctacctccttaaaaaaataaggtagaatggggtttgggccacaatcctgaacaccataatcccaaatattgaaatacaaaatgtaaaaatacccaaaaatataattctggaaaaaataattttaaaaacttttttaaaagacatttgtttacattttaaagtggatttatttgagaaacatatgaagacatgacgaaatgcttcataggccaccttgtgcaataaaataggcaataataatatacatatttttgcaaacataaacacccaagtatactaaggacagtcacatgggtataacagttatgagcagacaaactatattcctaaagaaatagctggtattcaaggggaacgccttcagctttcgcccattcagtatgatgttggctgtagtttgtcatagatggctcttattattttgacgtatgttcctttaatatctagtttattgatagtttttaacatgaagcaatgttgaattttattgaaagccttttctgcatctattgagataatcgtgatttctgcctttagttctatttacgtgatgaattacatttattgatttgcatatgttgaaccaaccttgcatccctaaagcctacttgatcatgtaaaaaaggattagccttttttttttttttttttttgagtcagtattgctctgtcacctatgctggagtgcagtgtcatgatcttggctcactgcaacttctgtccacctcagcctcccgagaagctgggactacaggtgtgcaccaccatatccagttaatttttgtaattttttgtagaaacagagtttcaccacgtttcccaggctggtctcgaacccctgggctcaagtgatccaccctcctcagcctcccaaagtgctaggattacaggcatgagccaccacgcctggctggattagcttttcgatgtgctgctggatttggtttgcaagtattttcttgagaatttttgcttcgatgttcatcaatattggcctgaagttttcttttttgttgtatctctgccaggttttggtatcaggatgatgctggcctcatagaataagttgtgggggagacgctcctcctcaatttcttggaatggtttcagtaggaattacattggctcttctttgtacatctggtagaattcggctgtgaatccatctggtcccaggctttttttgggtggtaggctatttattactgattcaatttgggagtttgttatggatttgttcagggaattaatttcctcctggttcagtcttgggagggtgtatgttgtccaggaatggattcatttttctaggttttctaatatgtgtgcatagaggtgttcatagtagtctctgattatttgtatttctgtggggttagtggtaacatcctctttgtcatttctagttgtgtttaattggatcttccttcttttcttctttatgagtatagctagtggcctatctatcctattaattttttcaaaaaaccaacccttggattcattgatcttttgaataattttttgtgtctcaatctcctttggttcagctctgattttggttatttcttttcctgtatcttaattacagagattatgacacaaatgtatacatttgtcaaaactcactgaaatgtacattggtaaattttattatatgtaaattatactttaataaagctgatttttaaaacaaaaaaactaatatgcaatatatttcacctttaaatttttttaaaaaagaaacagcttatataaccatggtcatctgaaatgctatgatagacaacctaagtcttttaatgagattaatcaaaaacagcagaagaaaattctgtcccaactctcagagacagactaatttgccttcagtatttgttctcttagggtccctggctgattcaatggtgtccaccaacactgagggcagatctcccccacctcgcccattctgatacacatactagtctactctggaaacaccctcacagacacaccccaaaataatgctttatcacgtatctagatacgtctctttttttttttttttttttttttttttgagtcttgctctgtcgccctggagtgcaatggtgcggtctccactcactgcaagctccgcctcccggattcacgccattctcctgcctcagcctccagagtagctgggattataggcgcccgccaccacacctggctaatttttgtatttttagtagaggtggggtttcaccatgttgggcaggctgtctcgaactcctgatctcaggtgatcttcccgtgtcggcctcccaaagggctaggattacaggcgtgagccaccatgtccagccttagatactccttaatccagtcaatttgacacctaaaattaagtctacaagtccatcccttgtctatttggcacccatacatatcttaaaccacacgtaatttccaaatgaagacaataacaaagtaatagttctgcctaacaagatgcaactaacataatgaggctatcctgtgtacaacagaaaattcactaatcgtgatttttgagattttagatgttaaggacttagacttcagggatttttatcattcaggatttcagcattcaggactatgacattcagaatcgtgtcttttgggattgattggtagtgggtataatgacgtattttgcaactggttccatagctgaattccatagctgaattctcaatggcagctcaattctaggtacctgtgagaggcttcttccatccagaagcactttcctaactatctttccttggagcctgatagaccaccaatggaatttgttccattggctaaagcatcaaatcccctgagatccattctccaagcacaaggatccttagaaataggtaacatgtaacatcattataaatcacaaataccatcatgtgaattagttatcagggaaatacagctagcaagtttccaaggaaatgagacacaggcccagtagtatttgatggggaggttggggaggacatggagaagggatagttatagatcagagtcaggaatgtcctttgggagtgtcattgtgggactgcggataattaaaggacatggagaagccagaggcagaaaaaaaaaggtgccactaagggtatgcaccacaatccaggtcgggtccgagctcaattactatgctaatatggtcatggatagacacagagaagagaaaattgtcatatgtgtgtccatggatttctctacgcatctcagctacaagttctgccaatgctgccatttgtcacaagggcagtggggtacatgaccccgtgtctcactgagtggaaacctgtcaccaagaagaagactctaaaggcatgtgtccccaggagtctgctcagagtgtttatcccacacttagggccaggaggcagttttggatatttggtttggagggttggaataggtttaaaaagccaatggatcttatctagcagtagatttctggagcaatctggacaaaaatattgtcttctttcttacatgaatgggatgttcttctctccccacagaagaagcgcacgctgaaggggtccattgagctctcccgaatcaaatgtgttgagattgtgaaaagtgacatcagcatcccatgccactataaatacccgtttcaggtaagtccatcaggtgggtagttccccattccctggactgtggttaaaatcttcagtcacagccgggtgcagtggttcaagcctgtaatcctagcactttgggaggttgaggcaggcagatcacgaggtcaggagttcaagaccagcctggccaacatgaaaccccatctctactaaaaatacaaaaaattagctgggcgtactggcgggcgcctgttatcccagctactcgggaggctgagacaggagaattgtttgaacccaggaggcagagttttcagtgagccaagatcgtgccattcactccagcccaggcaacagagtgagactccgtcaaaaaaaaaaaaaaaaaatcctcagtcactgtgagagagggtggacacggatgactctctgcctctctgctccaaggttaggacttagacaaatcccattaggaaacgtatgtgttccttccatcagtgacatttatttgttaattctttcacttattgaacaaaaattaagcacaaaatcttgaaaaggtggttattccttatacccctttccctcatgtcttctcttcctcaaggaaagtcctaattagtgaaggaagaaataaagctgctatcaggggcccgaaacctaatgtgctttaagtgcagtttactcatgatttgaggcaacatattgcaattgctgggtatgaattgcttggagattctgaggcaaaaagattcagattttataatctgaggactatctggaatcgcactgtctagtacagtagccactagccacacatggatgttcacatttaaatgtattaaatgatattaaaaattcagcttcttagtcacattgggcacatttcacatgttcaatagcaggacatggctggcagctactgtactgaaacagcactggttatagaatgttcctatcactgcagaaatttttttttttttttttgagacagagtctcactctgtcacccaggctggagtgcagtggcgcaatcccggctcactgcaacctccacctccctggttcaagtgattctcctgcctcagcctactgaatagctgggactacgggcgtgtgccaccactcccggctaatttttgtatttttagtagagatggggtttcaccatgttggtcagactagtctcaaactcctgacctcgtgatcgacccgcctcggcctcccaaagttctactgaacagagctggtggagggtatctttaaagtccttgtatatgaatcttggcacttctggcttcaaaggcatggatatctccttgcacatcccagggtaccattcctgcttgccaacctgagggatgaacatatttttaacacggcatagaaaagaactttttttctactagaaaagtgaccctcatgagttggaattttgaggactgaaaataaaaggaatagcatgtatttttcagttgttcaaaatctcaatgataatgagtgcctaaaagagaggtgaaatataaagaagactgcagtttagttaacagtattgtaccaatgacaatctcttggtttttttttttttttaatttttttttattatactttaagttttagggtacatgtgcacattgtgcaggttagttacatatgtatacatgtgccgtgctggtgcgctgcacccactaactcgtcatctagcattgggtatatctcccaatgctatccctcccccctccccccaccccaccacagtccccagagtgtgatattccccttcctgtgtccatgtgatctcattgttcaattcccacctatgagtgagttttgaaagatgtgttgtggttacgtaagatgtcatcagtggagaaaagtaggtgaaaagtacacaggaactctgtactatttctggaacttcttgtgagtcttaaactatttcaaaataagaagttttcaaaactctcattgcacatttgtcatataatatctttctcttccatgtgccagaaatatttttttaatcactaaaaacttaagatgagaaataaatgtggtttctagtcaagaggagaactttctcctgctgtcttagtttagtgattgctctcttggggcatggaatctgagacgagcagctgaaactgcttaccctgtgtttttgtagcacccaaacacctggataaaaaggatactggccccctaattacccaaatgtttgcctatatgacgataaacacccgagaccccactctcggctcagtaggtctgctgtcagtcaactatctccatgcacgctgctcaccttgaactctgtgtgtgtgtctccaggtggtgcatgacaactacctcctatatgtgtttgctccagatcgtgagagccggcagcgctgggtgctggcccttaaagaaggtaattaaactcctttgccattgaatcactgacactcttgatcctatagtagggttgggttccacaatagaatagagtgtggtgtgagagcagctgatggctgatttctcttttggggttggtggaagttcccaagttttcatcctgggcccaggaagcaataactggtatcattcagggattgaccaaatccagcctgctgtctgttcttgtcaggctctgagcaatatttgtatataactcatttcaaatagtttaataagtacctacataagatgcttgattttgtctcatggtcagtaaaacctaaaatatttactgtctggccttttaagaacaaatttgccaactcctcgtatagtatgaagaagcagagcataggccctcatgtgagatgacctgggtttaaatcccagtctgtcacttgctatgtacacttgggcgagttccttaattgcctgtgcttcagtttcccatctgtttaaaaggaagaaaaggaagggataacagcacctgcctttggagctgatgtgagcaaagtcctagaaactaggttggcccatagacagcatgcaataaatatcagctagctttcaagcttttcagaccattggtaagggtatttcttaagccttaccttcctgatggcacagttagaggcagcagtgtttaagcacatgggatgtggagccaggcatgaaggtgaaaatcccagctctgccaatgattagcatgtgaccctgggtaagttccttgaccttcgtgtgtctctataaattttgactaaaaacagtcatggagctgttgtgagaattgaatgattgaggacttagaaaaatacccatcccaaagaaagccctggatcaatgttaccattattgttctttagcctgaagcactggatgtgtcagaagatctgggttcaaatactaatctgcctctacgaagctgtgaggaccaaggataagcaaactatttgttatctctggagctgcaattcctctatctgaaaaaaatgagaatagaaatacaagttgtatcttatcccgaggttgttgtgagccttaaatcggttatgagcagacaagtgctgggtgaatggggaagtgctctccgttcttacagtcttgggacatacagcaaacacaaaagtaagaagtaatcaaaatgggctgggcgcagtggctgacacttgtaatcccagcactttgggcagccaaggtgggaggatcacttgagctcaggagttcaaggctacagtgagccatgctcatgccactgcacttcagcctgagcaacatagtgagatctcatctctactaaaaataaaaacattaggcaggcatggtggcacatgcctgtgctcccagctacccgggaggctgaggtgggagaatcacctgagcctgggaggtcaaggctgcagtgagccaagtgagccgagcctgggtcacagagcaagaccctgttcttaccccaccaaaaaaaaaagaagaaaaaaaaggaatcaaaagggccccagctatggtcattggccatttgccctctgtgaagggattttatacacagggtgttaaaactggaaggaatattagagattagatatctagttctgtggttggttcatttatttatttattcattgagacagtgtattagtccattttcacactgctataaagatatgcccgagagtgggtaatgtataatgaaaagaggtttaattgactcacagttccgtatggctgggaggcctcaggaaacttacaatcatggtggaaggtgaaggggaggcaatcaccttattcacaaggtggcaggagagagaatgacagaaggaggaacttgccaaatacttataaaaccatcaggtctcatgagaactcacgtattatcacaagaacagcatgggggaaaatatccccgtgatccaattaccaccacctggtctctccctcaacacgcaggaatcatggagattacaattcaagatgagatttgggtggggacacagagccaaacgatatcagacagggtctcactctgttacccaggctggagtgcagtagcacaagcatggctcactgcagcctcgacctattgggctcaagtgatcctcccacttcagcctcctgagtagctgggactacaggtgcatgacaccatgcccagctaacttttttctttttttttggtagaaaaggggtctcgctatgttgcctaggctaatctagaactcctggactcaagtgatcctcttgcctcggcctacgaaagtactgggattacaagcatgagccactacacccaactctgttctgtgccttatgtatgtatttgtttcagtagcagaccccccttttttttccaaccaaaatcttacttcaaagccacaaacctagaagggagaaaaccaaagtggctgtggttaaaggtaggagaggtggggggtggtaattccaccttctcaaccttctcattacccttaaggcacctttgtagagcccagtgtttaacaatctcattgcatagtgggggaaactgaggctcagataagggtttgcccaacttaagaacacataactaatgcaaggcagagccagacgcaagcctagatgtgctgatgcctaaatgtaacatgaactaccccagtaaatagcacagtgcatttatgcgctcagatcaacccatgcttctgagtggtctgggcaatactcattcaggctcactcagccaggtctaatctcgaggtgttataaaattggtagcccttgatagactgacctggaaataactcttctgttggtgccaacctgtttcagaaacgaggaataataacagtttggtgcctaaatatcatcctaatttctggatggatgggaagtggaggtgctgttctcagctggagaagcttgcaacaggctgtgcccaatatgatccaaccaagaatggtaagagactgggaattccctctagtttttgtgaaatgaccataaaaaagtaaaagcttttggcctttaatcattgagggtgtcaggaacagaatgcaaaattctacattttcagaattttccaagaggaatcatctgtctttcctaccagcctgttggtgcttccatctcaaagctgatgtctacagctcctaaccacttgaagtgtgctctttggaccagcagcatcaacatctcctaggagttagttagaaatgcaaatgatctggccccactcatgacctactagatcagaattttcattttaacaagatcccaggagacttatgtgcacagtacagtttgaggagccctgctataacctgcatttgaatggcatggtctatttaaatcttaattaaagaggcagccttaagagatataaaatatttatgtcttacagtgacatcatgtcacacataaatttaattacacaaattcaactctatacccttaaaggtgagaggaattttttttcttttacattttactctgtgatttctccttgcctcctcttcaaacttgcccttgacctccacagtctcagagaggagaaggccgcagtctaaatgcaaagtgaaaacaaaaaaagctgtttttttgcctttgacagtaaaggctcaggtccaggggattgggctgcaactggattttattgatgactttggaaccttaacctccagtcgagtacaactccactcgaatgcatttcacatttattatgctcttgttcctctcaaccatctggggtacatggcgtgatgttaagggaatgggctgccttgagcaattcagtatgctccgggtcacaccgctggaagtgctctgcaaatccattgtcgaataggaataatggcccatgtggattgttttccttccattttcctctcttctcaacctcttttgccatagtttccctttctcatttattcttttgtgcgctaaaacttaatactgaaaattggcaacccaaggcggatgtaacacatggctaggttttctgtggcttcctgattcataggccctctcattgccactttaaaaaccaccacttttcaccctgcaccttggggaaaaaagctcttagacataatcgatccctgggcccagaagaacaatacttaacaagttttagaaattggtaactattcaagtgatcctacacattagtcctgtttaccatattcatgcgggccaatatttaataaaaatgaaatggaaagttttctctggataggatccaccataataacagaacggcatgggcttacctctgtgagtgaaagccctttccaaagtcagtgatctggtctccaaatttctgccaatgccttgctgtgggccctcagatgagtcacgtggccatcaagggccccaatgtcctcatctcaaaaatggcagggagttctgaggggcttaggatgaaataatacctaagcccttttccaattctgaaattctttgacttggtatttccattttgtaattttcaccatgcatgctgcagctattcctcttcggggcgcaagtatttccctcctccaagtgatacacatgtgactgaggtgctagggacatctgaatgactcaccagaatgccagtgcgggaggactggtcatgccgagctgttccccatgtgaaaccagggcctgagcactcttggggtcctgctgtggttgtcatgcagtcactgtgctaatggttttgcttttgcattgcaacccattgccatatcctcctctgagcatctcctcactctaccctcttctgatttggttaaataacttcatggatctgagttttgcacagttgagagcagagttttcaagaagcacactgcactgtgaacgcagcttatggtcatcaccctggatgaaggctcacaggattcctggtaccgagcacattggcagtgcgggtctatgagcactgggctttggataatccctctgagcctctaagagcattttctcacctgcaatatggggataatgataataggtagctatgtgtaaggctgggagattcagtggtgttgtggaaagcagtacagctgccaacatttacagagttcttgataaatggtaattgtgtctacttgtcttccttattggtggatgaaagaatctgaggctgagatatagcctcagaacttgtatgggtctgggaagcagcagaagtggatgagtaaaaacagacccagccacacccaacccatagtaacacccatttctgcaaccagaactggccctgatctccccactgtggggagggaaaggaaggaagggaaaagcaaggccagaggacgaagaaagagagaccagtcatagaatgtccagggctggaagtggccaaggctcacagctagtattggtgaagccagagttagaacaccagtctcccagctccaagttgagttctaaataggaaccatacttcctattacaggggttttccttcttctgtggtcattgtatacccaggtcactatcccagcctactctttcttggcaagtctgcacgggactgggctccagtgtcaatgtgtgactctcctctaccacatccctgatgtgagctgtccaacttcaagtcaacctcatacagaaatgaggaactcatcgtctacctatgcagcccattctcttcccatctctcgttattaaggacgtctttgtattagcctgaagtctgtgcagtgcctcccgtaccacagagagccccagacacagccacacacctttgattcattgagtccaggaatggcctttgcagagctacaaaggagaaatagtgagagatgcatatgaagagatgagaggaaggagagagagaaagagaaagagagaggagaagagaagagaaaggaggaaagagggaagagagaggagagctaaacagacggagacatggaaacagagataagcagaaagacaaagacagagagatgctggggttggtatagtttgaaagaggcagaaagaacacatattcagatgccttaaggcaactaaaagtggatcccagcccactcaaaaagcagcacaatgacctcccacctcagccaccccctcctcaagcccacaaccatatcaggaagctagtgagtcactgtccccctgagtcaccaattcccactcctgagcttagcaggtggcagagacattcccggaagtctctatgcctacagggaagggtgcaagtctaaccccactggcaggcttttcctgggaatacagaaagagagggcccccgaatatggacttctggaagcttctggtgtgtactagaaaagggaatcagaaaccagcaggcccaaggagataaaagacagcttctgacaaggccaagtcaggtttcactgtgtcttattgctccttctggccccctttcttctgttgttttccctgggccctttttctcagaaaaaccccctggctgctcacttccggttgggtccattagttttcatgctcattttttcttttcctgtttttctcttttcagcttcaaagaagcctcttcctcctactcctgaagacaacagggtgagtgagagcgctagctccgggtgcaggtgggcccacaggctacctgattggcatgttcctatttgcatgtccccctctccccatagttttcaaaccctggctgcatgcagcaggctgtcatgattcagcagaactcaacacattgggtatttttgggcttgaactctcttggggggtctgtccacttaaaggaccattcagctgctaaatctccatctcactttatttattcaacaaatactgatatcaaattgggtggccattcacctgaccactttggagtatagtagcagctcactctacataaaagtgtgtctggcatggtggctcacgtctgtaatcccagcactttgggaggccaaagtgggaggatcgcttgagcccaggagttcgagaccagcctggacaacaaagtgagacccccatctctagaaaaaatttttaaaaattagctggtgtggtggtgcacacctgtagtcacagctacttagcaagctgaggtgggaggatcacttactcccaggaggtcgagactgcagtgagccatgactgtgtgccactgcacttcaacccgggtgacagagcaagaccccgtctccagaaaaaaaaaaaaaaaaacaaggtgcacatctactcttcgcaagcattttggagacatacatttgttgatattttatatatttcaaagcacttccacccctttattatctattttaaaacttactatccgttctatccacttcagagggttttagttttattctcattgtaaagcttgggaaatcaaatcccaagacaggtcttgaggcttttccaaggccattcagcaacttagtaggatgcaaggtttctggcgtggtggtctttaactcgagtggtggttctcaaagtatagtccatggaccagaagcatctgcatcacctgggagcatgttagaaatacaaattcttaggccccacccccagacctgctgtgtccaaaacgctgggggaggggcccaggaatctgcattttaataagcctcctcactgatctataatatactgacttacaagtcttagatggcatagtacctactctagggcagcttattttgttaaggagatgaaaaaaaaaagatgggggaaaggatcatgacctttaggtagggaatatgaccctgaccttatgataatattaacaccaatatccacttttctttcttttttttttttttttgagatagagtcttgctcttgtcacccaggctggagtgcaatggcgtgatctcggctcactgcaacctccgcctcccaggttcaagcgattctcctgcctcagcctcctgagtagctgggattacaggcgctcaccatcatgcccggctaatttttgtatttttaatagagaccgacttttaccatgttggccaggcaggtcttgaactcctgtcctcaggcgatcaacccacttcaacctcccaaagtgctggaattacaggcgtgagccactgtgcctgaccaatacccacatttgagtactcgctcttcattccagagcaagttctttaacaagagctttcagattccatttcctcatgcttcttcctgaagaatgagctctgccttttttcccttcagccaaaatggtgacatttcaaaactggcagcgtccccataaaggaagctctaaatcctcaaagccccagcctggtgtttagatctgtcatcagcctactccctcacaacatgagagaaatgtactgaaactgtagcagagaatgagctctctctccttttctttcactgaccttctgcagactatttcaccatcccctttgaaggcctggttcggaaccctactgccctcccttgcagacggttccctcaacagtcccgcctaaacccacacctcccatcttaagtgaggctgctcttgtgtctttatttttggtatcaatgaaggtgaaagccagaaaacactgctggtccttctctccctacactctgccatttggcttttcagccttcttggaggagcatcgtggatactgttttgagtgttctgaccacaaaggttttggaatcattgttctagtttcaaccgcatgtctaaatccaatgcaacggttctcttgtctgagccacttgaaatcatttctctcctcaccttcttgttctgctgcctgagtggtaatgacatctcgggttgtcatacagagaaactgtttttaatccagtctgagccaacaggtctcatgctctatgtgagaaacactgtgagcagggccagtcctccggggactggccagtcctctgggggttgggggatggctattttggttcaagatgtaaaatatccatggtcagagtgaaggacaatcctaggcctcttttgcctatggatacaaacaaggtcgtatatcacattgaagtacaaattccgattcctcttggccccctgcatccatgggaactcaactcttcctcttacagtccctcccagtcaacccagggcttgctgaggggccactagaatgtgtctgcatgtgtcctttcttgctggctgcctactaaggcaccctatccctgccactgctacctgggctctctgtgagggcccctcagccccgtggagctcttcccacctggggccagcagaggtcctggggggtcaggttgtgctgaggcctgcagcagagtggccaggaggcaggatcctcattcctttcatgcctcaccacatcatggaggctcccaaacaacccttcctgagcccacagactcagtttctccaaatgccatcccttgattttctcactcaaatctaatggttcccaaccttatcaaactcaatcctgccttttaatgacagatattttgtaaggctccttttgttatcctgaaaagaaatttataactaatataacatatatatacacaattttttaaaattaaagtacttaattaaaattttttgttgctttgagacagggtgtcactctgttgcccaggctggaatgcagtggtgcaatcatagctcactgcaccatctgtctcttgggctcaagccatcctccctcctcagcctccgcagttgctgggactacaggcacttgccaccacacctggctaacttttgtattaaacatactttttaaaaagaatcaacaaatgttctaactgtaatatttaaaaaggaaagaaaaataatatatataacaaaatatgtgtttctatataaatattgggacatgactgcactggaagacagaatgaaatagtcgaattcttgcactggcaggtaggatccattggatttggcatctcgaatgcaactgatacaaaatgtggtattgggactcaactacagcattaccaccagtgatataattttccaaaatgatgaacaactcttagtaaacttctgaaccaaagcatagtcttccctcaaagtacaaggtagttgcattcttgggaaatccagtactttggatagggtacagctaggatctaggctcaggatgttcttatataattactgtataagctggtttctcaccacatgaatgtttaccaggatattcgaaagttgtggggaatgtgggactctacagagcattttgcattaaaggcctatagcatacctcaaactgtgatgttcaaaataacccccatattccaagcttgcatgattattagaaaaaaaaatacatgtccagtgtgcccctacagaaaggtactatcataatttgagggccctgctctgacctttctcttcacagctattaaccaatgagttgacctgcagtgggatgaatgccatagctctgtttcttcttcaaacatccttgaacactattcctccctccataagctcttagagcaaaagcctcaggccatccactcttgtccatagcaccccatttacacatcctcacaagctccacaaatatctagatttcaaattccaatctgcagccgggcacagtggctcattcctgtactcccagcactttgggaggccgaggcaggagggtcacttgagcccaggagtttgagaccagtctgggcaacatagtgagaccctgtctctcttaaaaaaaaaaatccgatctgggctcagctgagatgacatactacatcaaaatgacgagactcttttttcagctccagtatttttatgccactaaatgcttcaatgtactcagagaacttgtgacttcctaacactaaaccacattctagtgaggaacttaatatttccctacatttactctcacaaagtctgctaacccatagcaggcgtgcccatcctgaactctggcgactatgcgctttgtggtcttttcttcatgtcctcaatatggacatgaagaaagggactgaggaacagagacatcagcaatagagcctacaggagaaggaagggagacaggtgctagagtagagagagtcttagggctaattcaagtggtagattggccaggtccatttctccatctgggcctcagtttcctcatcctaaatgaaaaagtgtattaagtgatctgttagaggaattccagctccaataacctatgattccgtagatctagataaacccacaaatcatattagtaaagcacaaactgaaagatttcatgttgactgcatctcctttgccaagggcatgatgcatccagcagagaggctgctgcatataacatagtgcagatagagaaaccagcagacttttgtgaaaatcacgtggctgcttggaattcactgtggtcagaatttacctcatagaatgagcaatgtgatgaattccaagcactgatgtctttgtgtcatgttcagcgctgtaactctaactcataaagaaagtctaccagaggaaggcagactgtctccccagacaccccgatgaaaggaggcattttacctccttttttatgtctttgcttggttttgttgtctctcttccccagcgaccactttgggaacctgaagaaactgtggtcattgccttatatgactaccaaaccaatgatcctcaggaactcgcactgcggcgcaacgaagagtactgcctgctggacagttctgagattcactggtggagagtccaggacaggaatgggtaagtcatctttgtggctgctgtccccgtgtttgaggtgtggtgcgaacaaataaaataccaggatgatttgtcctatctcccacagtgtaaccacagcactgaggtgggagaagagagcagaggcagaaggaagagggaggaagaggaagtagttgaggctcatttttcctcttctcagaagtggctctgaggcagtcacttgctatgcttgttccctgcaccccatctcaggcactccagacccaaactcatctaaaaaaccccctggatttttccactgacatctacaatttgggagcttggcaatttgttctgcaaagtgctattgttcctgagtgttaagtgaggctgaaggtacatcccattaggaagtgcttatttttggtgaaaagaaaatgtgtgtatagagatggtacagattgatagttatgttaggacgcatcagaaagaagacactaaagatttagttacaatcgcagtcattgaactagccatccacatgactcagggagaaaataaggttgtacaaatactactttcccactatgcaacttttgaatgaaaaaaataccgagcatgagattcacactgccttttaaggttttttttttcctcttaatatatccgatgtattaacccatgctctggaatattttccagaatctgagttcaatagttgcatcaatccagccataaatgtactctaaattgcaaattcccttgttgaacacttaggttatctccaatattttgcaaatattaacaacactgcaacgaacatctttgtatattaatattaagggtttaaatgttttcaaggtatgaggttattattaattttaaagtataaaaaagaaaactgtccttgcaacatatagatcatttatgtcaacattttacttaactaacagtagagagaaatatacataaaaaataagccaccctccatttgcccccacgtcaagtccaaaagtaatcactatttggccgggtgcactggctcacgcctgtaatcccagcagtttgggaggccaaggtgagtgcatcacttgaggccaggagtttgagaccagcctggccaacatggtgaaaccctgtctctactaaaaatacaaaaattagcatggtgtggtggctcaagcctgtaatcccagctactccactggctgaagcatgaaaatcacttgaacccaggagggagaggttgcagtgagccaagatggtgccacttcactctagcctgagcgacagagcaagactctgtctcaaaaaaaaaaaaaaagtgatcactattaataccttcttgtgtatcataaataaaagttatacctgtgcaaatgcatccttttttcacttgtaccaagtggatccattctgttctgcatcttgcttttaatttttaatgatattaatacacattgaagatcttttcataccagcacatgcaaatctacctcatttttaaaatagttgcatgggccggccgcagtggctcaggcctgtaatcccagcactttgattgggaggccaaggtgggctgatcacctgaggtcaggagttcaagaccaacctggccaacatggtgaaaccccatctctactaaaaatacaagaaattagctgggtgtggtggcaggcgcctgtgattccagctactcgggaggctggggcaggagaatcgcttgaacctgggaggtggaggttgcagtgggccaagctcacaccactgcactccagcctgggagacagaatgagaatccatctcaaaaataatcataataataataattgcacaatcttagaatgtatgattgtattattagtatttaaataatcctttatggtgagacatttagttgccagtttatttgtttcctctgctgtttcaaacaaggctttaatgaagatcttgtattcatgtatcttggccatctttggaatacaaacatatatatatgatatatatttatcacattagttttccttttcttttttttgagacagggtcttgctctgtcacccaggttggagcacagtggcactctcacagttcactgcagccttgacctctcaggctcaagtgatcctcccatctcagacccctacagagctgagactataggcacgcaccaccatgcccagataatttttgaattttttgtagaaatggggtctcattatgttgcccgggcttgtctcaaactactgtactcgagaaattctcccgctttagcctcccaaagtagttgggattacaggcatgagccaccatacctggcctatatgtcacatttctaactgtgcaacagttaagtcagagtatgtgatatcttaattttgccacataatttcctcacaaagcttgccaaatttaccttcctgctaacagagttatggaagtgccaagactgggtatcattgaacttttaaaaaaagtcaatctgatgggttaaaaaaaaaaaagaggggcacaaatatctttaaggataagactttaccttttacatacaccagaatttacattttcaaggtgccttctctttaagtaggcttatcaaccccattacagggggaggaaagacagaagtgagacagggtaaaacgtgatgagattcagaaccatggtttgagaggcagtgtggtttgctagctaagaacagaccccaactcccctcgtctggaacctccctttctagttgattcatgaagacaattgagctagtcacatcaccttctctctgtccattatagacaggcccatatccgaaataggttcaagactgtctacagggtctacaaacaccgaagggacctagaaattcattagttcaatcaactgactttacttagcacacctaatgtaccaggaaatttgttctcctaggccttacttccccaaatgacagttaaacccttcatttggtgacctgtggaaaggcttaactatgcacttcaaagggcatcaaagaggacaccccagcagccagtcagcattatgggaatttccccagtttgctttgtgatagtgtggtatagtggaaagcacacaagatggggagacagaggacttggactttatcagctactcttgtcatatgcagctgaggattcacagatgaccatgtcatatgtgtgaccatgtcattcacagatgaccaagtcacttttcctctgtgaatccatttcgtgaactgtaaaatgcagctgataatgtcagctttgtctacgtcacagtgttgagaaaatcaatgagataatggaagtgaaagagctttggaaattctacatatccacatacaactatgagagttaccatttgtgtagatgacccagctttgggtggcatatgctattcaaaagcaaaatattatttgatgcattaatataattgtaaaagtatagtatggcaaaagtagacataattaagggaattccaagagtgatacagaaggaatggcaaatttcagaataagctgactttcttccgttggaatggctgccttgagcactgtatgaaggatgattctgagggcagatgtccaattctccaaagaaagtatgccatgattgattagcaatgtctgccagaggagtaaaatataagatgatcatcctgtatttggcacctacagtcttgatttcttcactcttcacaactctgaactgattacacatttcccataaacataatcactagattgaaaattggccttattataagaaaattaaaacatgttatggaataaagagcaataaactatcaggcatctttttttgttttgttttgtttttttgtttttttgagacagagtcttgctctgtcacccaggccagagtgcagtggcacgatctcagctcatggcaacctccacaccactgcccccacccgccaccacccaggttaggtgagtctcatgcctcaatctcccaagtagctgagactacaggtgcatgccaccacacctggctaatttttatatattttctagagacagggtttcaccatgttgcccaggtttgtctcaaactcctgagctcaagtgatccacccacctcagcctcccaaagtactaggattacaggtgtgagccaccacacccagcctatcagtcatctttttacagattgacagagtatggagtatctacttaaactagattttaagtataatctagtttaagcccttcatttgacgggtataaagtcagaggtccagagagtagaagggatgccgctttcaccctgtggtattaaatgagataatgaatgtgaaagtgctttgaaaactacaaagttatacacaaatgtaaagaagtttgatattcttattttgtttattatgttttttgtttatgcacaattattaattcttgctcaaaagtgactcctgatccccaaatctagcctggctttatcctttttttctcgtgtttataccgttcatatctgaagaagctcaattagggaggccttaaattaaaaagcttacaatgccaactggtagtgtcttttagaatctgtggttggaaagtcatcttttatattttaattattttggtttcctgactataaaatgatagtactaaagtggaaaaaatgttgattatcacacaaaaatgtttccttatagaaaatagacactgaatattaatctttttttccagtagaggaaatttcacaatgaggagaacagcaaacagagctttttaagtaaaatcgccacttctttttttattatgtttcatatttcagtagtgaaatcaacctgcctttaacagacaagttgctattattttttaccaattcctttttttttttttttttttttttttgagacagagtctcgctctgttgcccaggctggagagcagtggcacgatctcggctcactgcaccctccacctcctgggttcaagcgattcttgtgcctcagcctcccgagtagctgggactacaggcatgtaccaccacacccggctaatttttttttgtgtgtgtagttttagtagagacagggtttcagcatattggccaggctggtctcaaactcttgacctcgtgatccacctgcctcggcctccaaaagtgctgggattacaggcatgagccaccgcccccggcctaccaattcttgtattctaaactttaaaatgtcttatcgcaaatgccaaataatgtgatattccccaatctttaaatgacttttaatggattaaacctataaaatgatataaaacttagttctatgtaagtctaaacattaattttccttttaacaggcatgaaggatatgtaccaagcagttatctggtggaaaaatctccaaataatctggaaacctatgagtaagatattttatttgtttttggaaaatacagtcctaaggaatcctccttaagttaggaataaattattggttgactgtaaaaataccagatgatccctactgcaacagcaatgttcacacataccatccagctcttgatacctaaataaggctttccactaaaaaaaccaggactttctggagaaaaggcttggggtagggatagaacaaaaaggaacttggaacatctttttgtgccagaaagtaaagaagtacttaaaaagaaatttttcttctttaatttttttttttgagacagggtctcactgtcacccaggctggagtgcaatagtgtgatctcggctcatcgcaacctcaacctactgggctcaagcaatcctcagcctcccaagtagctggaactacaggcacatgccaccatgtccagctaatttgtaaattttttgtagagacaggatctcactaggttgcccaggctggtctttaacttccgggctctagtgatcctcccattatggcctcccaaactgctgggatcacaggtatgaaccgctgtgcccagacaaaaagatgtgggcgtgtcagatgagcacagaagttggctctaacaggctccatttgatgaaatctgggacaatttgagtatcaaaataaataatgactattaaaataagtaatagactacaaaccattgaataatataagaatctgtaataaatagatagactgatagataaataaagaagtaaataaataaaaaggaaagggttttttcttatagtagaatgccaactaatgaatgataaagtttaaaaatcatcattttgtaacccagagtatcaactgattcaggcaagaatcctcaatgaatgtcaccactagcaagttaaagtttgatgagctgtggcatatttacatagtctcaaagtatctcctcacaaatcacttgtaattacaaagtggaggtaactagcaggcccgtctgaaacagtcaatccaaatgcacataaataatggagcaaaaaggtatcttgtgtctccttatgtgatgcactgagaagggcacacatcacttctgtgatattcctgctcaaaaaatgcacaacatgaatttacttataaggatatattcataaggatatattagacaaatccaaattagggaatattctctaaaattaatgtcctgggctcttcaaaaaaaaatgttaatatcaggaaagacacaacaggctgagaaattggtccacattaaaaaagactaaagaggtcgggcgcagtggcccacacctgtagtctcaacactttgggaggctgaggcaggtggatcacctgagatcaggagtttgagaccaggctgaccaacatggtgaaaccaccgtctctactaaaaatacagaattatccgggtgtgatggcacacgcctgtagtcccagatacttgggaggctgaggcaggagaattgcttgaacccaggaggcagaggttgctgtgagccaagattgcaccattgaactccagcctgggcaacaagagcgaaactccatctcaaaaaaaataatagtaatagattaaagacacatggtaactaaatacagtggtgatcctgggctggatcttgacccatacaaaaaaatattttttgttataatatacattattgggacaaccgatacaatttgaataagatctgcagttaagtaatagtgttatgtagatcttaaatctcatgacttcggtaattgtactgtggttagataagtgtatactctgtgtcttaggaaatagacacagaagtacttaggaataaaagtcaattctcaaatagttcagaagaaaagtcaatctatgtctatctaaagagaatagtaaagcaaatgtataaaatatcagcaattggctcatctgggttatgtgtatatgatggttcttttacactattttacagcttttctgtaagtttgaaattatttaaaaattttaaaaaattaattactcactaaatataagataccaggcctaaagaataaagctaatgaggacacctattaacgcattagggttcttaattcaaatgtggtcgtgttatttgttgctgaaattctagtagattctttagtgaagaaccgtcattttctggagtctctcaaccttgtttgttttgataaagtatgtgtgagtagcccttccctcagtgaacagaagggtcatcagttctaagaatttttgagctgaaataaaacatatagggtatatgcttaaataaaataaaaaatctttataggcaatacctttgaagaaaaaacaataagcatttatttcaaatgaccactaggctatgtagttttgtttgttcaactttgcttttaatcagaatctctttgtttatgatcaaaggagcaaactcaaaattccaacaggataagcaataggaaatggtgaggtctggagcaaataaaaaaagtcattcacccacctaaaggtattttaagccattttaaaaataaaacactataccatgcaaacaaaacaatctagttatactgtgcactttcagtttgcattctccagattatgaatctcagctggaaaataacatgacttacaagcaaacattcagatatttagtatataactggatatatgaaagattccagtatgataactttttattcgtgaacttagtgttgtctagtttcaggtgagatctgcctaagtacttaaaaatgtaccacctggtaacatagtcatgggttggtaaattgaatggattcaggtctcctgccttggtttgcagccatgaccttgggcaagttacctcaccctatttgagttctgatcccttctccataaaatgaatgctcagacaagatgaaggaaggcaaatcatgactctcttgctggcattcccttcccatgcactgaactcaggcagacatcaccctttgatagtgaagctatttacccaccatgctggtgacaaccttttcaatgcacagctctaggcagccactactatcgctgatggcctgtgtgtgagatgaagcctatattttcccaatcctcgattagataatctctaagagcccatgttggtgtcatgtactgttctgtcttataatgttcaaaacctctaacgaatccatgaattcctttagtcatggctactctcaagtagccaaacaagtttgttaagtggtattccttccctacccagaacttctctcctcctgcatttattaattttcaaaactgattattaaccgatgatcagtctgcctcctcttacctaaaaagcagccagagaggttaggatgtggctaaatattgttaacaacataaaaaaaaaacttcatccctaaaaatcatttatattcttctttaccattttatagttgtttttcaccagacaacaaaattataaaaataatgcaattacttggcagaatgtctggaagagcagtcttaaagaggaaaatactacagttgttttaaaaggatatttgctaaactttcaaactggtattacaattttatagctgcactagcaccctcctccttataacgaactgtctactgacttatgaaacgaagaggaaaattaatgttttctaaaactttattttagaaaatttccaatgtatacaaaagtaaagataataatataatgaatatccatgttccccaaacctagcatcaacaatgatcagtattttgccaattctgtttcatatgtttctttccaattaaacattttaatacctggaaatgaatcatgcatttgcttttgagtttaaacgcactggtagaaacatacgtgtgcagacttgttaaataaataaaatacacttaaaatttttttaaagcactggtagaaatagaaaatgaccatatgattttctagcattgtcttttataagtaaataatgaaactttaaaatatgtcattgacatatgacttttccttgctttcaggtggtacaataagagtatcagccgagacaaagctgaaaaacttcttttggacacagtaagtctccttaacctgtcttttgacataaaataaaatgaattaagtgcactgtctcatgtctggaatcccagcgatttggcaggccaaggtgggaggatcacttgagcccaggagttcaaggttacagtgagctatcattgtaccactgcacttcagcctgggcaagatcaagaccctgtcaaaagaagaaagagaggaagggagggagggagggagggaagaaaggtaaaaatgaaagaaagaaagaattgtactgttttttcagctttgctgcgttttatgccaatgcagtgggttgacatgttggattaacgatagttttcatgtctggtgaaaatattctgggaatttacaggactagcaaaccacaggataagaaacctgggcttggcattgacatggagacatcatcaccgctgcagcagtctttgtgagtggtgatggctggccatggggtgccatcagggctggtcagtcatgccttcttctcagtgtgggtcagagatgtctgtgactctgattcggcctgactcagctgtgagtccagaggaaacatagcacttgttttaacttacatttcatcaacagttatcctctaaagccatgcagtgtgcatagcaggaccgattttactcagggatgtcaagattaagggcgaaagggaagagaaaagtagaaaagatggtatggtggggcaggtactgggctctagttcctgttatgtcaccaactcattgggtgactttggggacctctcttcttccttctgggcctcggtttctcagtgagtagaagggcagaattggattaagtcagggatcacagttacccagccctcatcctgccactttctgctccttgtcctgtgaccaacacagctgatctcagtccatggcattgggactttattgggaaacaagacaaatgcagaaaaaagagcaagggaataatctaaaataaactaaggtaaactccagaggagttgggaaagattccatgaagaaaaagaagttgagctgagtccttactgaactctggtctctccttggctctacatcaactcagcacttaattatttcctgtgggttccccaaaaaaacacacattagaattgctgggaaatgttcaaaaatacagattcccaggtcccaccccagatccacagaatcagagtctctagtgttagttcccgggaatctgtactttctcaagttaaatttacaatgcaaatgtagccaactcaaacctggcgctgccaggctgtgttattggataacaaagtagaacttgattaatatgaactaattgagtggagtgcaaaattagctaaaactctgaattacactgtgtttaaacaagtatagttttgttatattaatcacacatcagttaatgacgtctatggagcacttcaaacagcccacattaatgacttctaaaagatgattcctgtattacagcagttcttgtgaggtgctaagtgctaagtacattttgcttgctctggcagttgaaacattcctccttactgatacatatatatatatatatatatatatatatatatttatatatatatatatattttttttttttttttttttttttgagacagagtctccctctgtcacccaggctagcatgtagtggcatgatctcggcttactgcaacctccgctgcctgggttcgagtgattctcctgcctcagcctcctaagtagctgggattacaggcatgtgccatcacacctaactcatttttgtatttttactagagacggggtgtcgccctgttggccagactggtctcaaaactcctgacctcaggtgatccgcctgccttggcctcccagagtgctgggattacaggcatgagccaccacgcccagcctccttactaatattttgagctactttaccaaattctcttctcctccttaggtaaatatgagggcaaacatcaatgggtccctgtcagactcagcccagattctggatagaattgaatgacattttcttgctatttttcactttttttgtgtgctgtttttgaaacaatagctgtattatttctaggtgtatttagagtctttttatctaataagtataggacctttaagagatgaattcctgcatagtattccatggcgtatatgtgccacattttctttgtccagtctatcattgatgggaatttgggttggtaaaaggatgagttcatgtcctttgcagggacatggataaagctggaaaacatcattctcagcaaactaacacaggaatagaaaaccaaacactgcatgttctcactcataagtgggagatgaacaacaagaacacatggacacatcacacaccaggaacatggatacatcacacaccagggtctgtcagtgggtggggggctaggggagagataggattaggagaaatacctaatgtagatgacaggtttatgggtgcagcaaaccaccatggcacatgtatacccatgtaacaaaccttcatgttctgcacatgtaccccagaacttcaagtataataataataaaaaaagagatgaattgattcattacacctttttatgaactaaaactcctggtgtactgccccatacatatttcgccactagactataaacaatttatcttgttcctgctgtacttaggcacccaaaagtgtatctagcaccttgtagttgttcaataaatatttgttgaatgaatgaatgaatacactgaaggcttaataaatgtttttaaactaacaactccacttaagggggacctgggtgatcataagcatcactgcaggagctttttaaaaatacaaattcctggactccaggcctatccagtcagaacctcaagaggtggcacccaagttattctgggacttacctacatttgggagccactaaaaagcatctcctaatgtgccatatcagttcttccaatgttgcctcctcccagaagtctctcatgccttccctcgccctagctatggaacgtggtttttcttgtctttgaacctttatgggtcaaatgttattatcagtattattacttctccagtggctctgttctcactctgcctccaatctcagcagtttctcttctgtctttacccatctaggtagatggtaaattccttgcaagtgggtaactctcttagaacaccttacaacatctcacacatagggtgacctgaagttcagacattctaaagtgtcattgaagactcaatgttgacttaataattggtttgtttcaagagaagaaaagcaccacctccagaatgaaagatggctgtatttcagagacactcttaaagtataatgcagcataacaagactatgaattatcagtccatctgttcacaataacttaccctgtgtgttgagattatcttctgaaaggtcaccttcaaattatatgaacagaaagaaagaaaaatactcctaacacaaccaacatgtctcagatggagactgacaatggaataattacttccaataagtagcaaacttagcatgtgataataatggccaataatactctaatagttcttgtcctagtattgtattccaggagcaattctaggcacattacctcagttctcccatcaaccttccaaaggtcattttacagatgaggaaactgaagctcatacagttactcatctttataagttccttttaaggccaggcacggtggctcatgcttgtaatcccagcactttgggaggccgaggcaggcggatcactggaggtcaggagttcaagaccagcctggacatcatagtgaaacctcatctctactaaaaatacaaaaaattagccaggcgtggtggcgggcacctgtaattccagctacttggaaagttgaaggaagacagtcacttgaacccaggaagtggaggttacagtgagctgagattgtgcaactgcactccagcctgggtgacagaatgagactccatcttaaaaaaaaaaaaaaatccttttaaacccagagattctggaattcaaacaaatagcatgggccactgtctgtgtgtgtacacagatatgtgcccacaggcaaaccatcattttagttgtgggatagaaggatttgtgttgttgtagtttctatatactttgttccttatactccaagtgtatgccctccgcacaaggatcttgtctaactctgacctttacttagggccctcattgtgactaagttaagtgaatcataatatttggcttaacaaatgttaccagtgcaagtttacagcggggtaggaacagagtgttagataggaagtacttaaaatagacttcagattttttaatttccaccaagaatgaataaaatggtatgtccatttattagtgcttatttcatcagtgctggcaaaactgtcagggtggcgaaagttacattctcagggcactcccttcttcccacctctctcatgaaaccaggagcttaatgttctttttccttccgccctgcagccaaattctcattctggaaagggcctaagaaatatattatcattaagagaatccttatacactgttggtaggaatgttcattagttcagcccctgtggaaagcagtttggtgatttctcaaaaaactaaaaataaaattattattcaacccagcaatcctattacagggtatatacccaaaggataataaattattctacctaaaagacacctgcactattcataatagcaaagacatggaatcaacctaggtgcctatcaacagtggactggataaagaaaatttggcacatgtacaccatggggtaacatgcgccctgaaaaagaacaaaattgtgcattctgcagcaacatagatgcacctggaggaattatcctaagtgaattaacacaaaaatggaaaaccaaacaccacatgttctcacttataagtgagagctaaacagacatcaagatagtaacaatagacagtggggactccaaaagttggaaggaatggagagtggcaaggatagaaaaactacctattgggtaatatgttcactatctagcaaatgggttcaatagaaacccaaatctcagcaacacgcaatatgtccatgtaacaaacctgcacacatactccctgaatctaaaaaatttttaaaagttatatattcccattaagacactgatgaagttttcaggacagttttgtgcctttgtagggaaatggagaagcagcttctaacattctttgaaaggaggcatcctggagtagtagaccaaggctgggctttgctcacataccagagttcaaatccgaattctgtcactttctagttgtgggtcgtgggaatgccacttaagctctctggcactcagtgtcattggcggttaaggataccaatatccagatggcaatattgtggtaagagttggaaaatatctgtaaagagtctgatacatggggagctctaaaagggcagagcttatgtctctgtctccattcatggttcatgtcagcatgagaacagtctgggatccatgtaggagaccaagaaatatctacggaaggacaggagtaaatgaaacggtagccattcttactgaaatctgctctatgccaagtgggcctacagtatttcctccttctgtgggcaagaaagtggagctggaggcataagcctggtttcctgagatcactaactttccattctttctaaccattccagggcaaagaaggagccttcatggtaagggattccaggactgcaggaacatacaccgtgtctgttttcaccaaggctgttgtaaggtatggagctaactctgctcagcaaagtggagagaaacacttctgaagtgtgtgagcactggggaaaagacaacaaagttagacagtgcaagaggtagaggctcactagaaatggtctgttttccctctttactccgagaaaaccaaagccatggagatcaaggatagaacttaagagacttagaaagtgacagagctgggagtggatgccaggtcctctttcaattagcatctccaattttagagttctaaagacataaaatacttggcactgtattggatgagtatataatttaatacatagaataacagaagagatatttctatctggaagcaaaaatatatgaactccagttctggctctgctcataaaactacctaccattaactgagtctttattatgtgccagaaaatatgcagaccatttccaatcctaagaagccctgaaggcaggtattactatgctcatttcacacagaagaaaccgaggttcaggagctgatggtgcctccctatggccgtgggtctgaaggggccaagccacatccaggctccagccaactggactgcaagatccttcctgcttttctgcccctctgtacctgtttcttctctgtaaaacaatgcctaagaacctatctaggtctcaaattcccttctaattagaacatttgttagaactaagctgtttgacaatgaccaaagtgcagtcagaattaagagaagagacaaataatttttaaggtgtcttcggaaaatttttttggaagactgaggatgtgagcaggacgtggagcaagggcaggtggcaaagaggaagggcccgatccagggatgggagggaacacagtgtacatcacagaggggccgtgcctctaccatggctgggagacagtaaggaggtgacctgcaaccccacaggtatgacggagaagggatgaaacaaagtctgtgtcgaggctccccacaactacccccagcttcagggattcactaggaggccttccaggacaaagacttattgagatttaatacagcaaagtgatacaaagcaaaatcagcaacgggaaaagacacatgggacaaaatctagaggaaacaaaacacaagcttccaagagtcctctcccactggagccaaacaggacgtgcttaattccgccagcaacaagttgtaaccacacgttagcagtctaccaggggagctcattagagactcagtacccaaggcttttattggaggctgtttccacagacagcccctgcctagcacatgccaaagttccagatacccaaaaggaaaacaagcgttcaccataaaacacattgtttctagcagacggtttaggtacagctcgccacccttatcagttagggaaagagccctcccgaaatccaagttcccaaacaccagccaagggttaaccatgcaagcaggtctttctaaggagggtagtcaggcctgttatgttcatcctctgcagcttatttgacttatgaagtcaaataagggtgaaggggtcagagaggctttctcaatgtatgctgacaatcagttaaattcatagaataggcaaggcaaacacatagcaaatatttccattccctcattttgtggcaatggaagaaccatcaccaatccatcacagcattgctgtccactgggtccagacacaacctcagagtcctttttaacacagtactgcagcacccaggcccaatctgtcaagacagacttataagttgaacaatatctgccaccttgtgagaggttataagacaaagataataagaacttaatactcgtagacttttttgtgtctcaacattgcttcttaataatcattacatttgtgtttcatttgtttaagtgagaacaatccctgtataaagcattatcacatcaaggaaacaaatgacaatcctaagcgatactatgtggctgaaaagtatgtgttcgattccatccctcttctcatcaactatcaccaacataatggaggaggtaagctctagagcaggggtggacccgggccgcccagcaggaggtgagcagcaggtgagcaagcattactgcctgagctctgccttctgtcagatcagcgtcattagattctcataagagtgcaagccctattgtgaacagcacttgtgggatctaggttgtgtgctccttataagaatcaaatgcctgatgatctgagatggaacagtttcatcctgaaagcaaccccctgccacatccatccatggataaactgtcttccacaaagccgatccctggtgccaaaaaggttggggactgctgctctagaggacaaagccagagggcacctgggttagacttttttgaattgctatcaaggaatacctgaggctgggtaatttataaagaaaagaggtttaattggtccatggttgtataggaagcatggtgccggcatcttcttggcttttagggagccctcaggaagctttcagtcatggcagaaggcaaaaggggagcaggagtatcacatggcaggagcaggagcgaggagggagaagatgccacagacatttaaacaaccaggtcttgcatgaactcagagtgataactcatttattatcacaaggacagtgacagcaccaaggcatttgtgatggatcccacctaatgacccaaacaccacctcccatcccaccaggccccacctccaacatagggcttttcttttcttttctttcttttcctttcttttcttttctttctttttttttttttttgagacagagtttcgctctgttgcccaggctggagtgcagtggctcaatcttggctcactgcaacctccacctcccaggttcaagcaattctcctgcctcagcctcctgattagctgggattacaggcatgtgccaccacatcccgctaattttggtattttttgtagagacagggtttcaccgcattggccaggctggtcttgaactcctgacctcaggtaatctgcccgcctcagcctcccatactgctgggattacaggtgtaagccacagtgcccagccagggattacatttcaacatgagatttggaggggacaaacatccaaactatatcagcacccacacaggagacttaatgaaaactggcaaaagctcgccctggcttctttttgactataaataataaataaatatacaaatagaaaaatatgacaaatatttaattatattatatatcttctattagcaagctatcttgtggaaataatggaattttaccacttgcccatctgtgcttatgatgttttcaaggaggatatgatatcaataattaggctttgggatttgttttccagaataaaattagcttttgcgtctgatgatgattattattttttttagtgatttaagttagatggttgctagagcaaagccctaaccactgcttcttggcttttcaatcaacccaggcctggtgactcgactccggtatccagtttgttttgggaggcagaaagccccagttacagcagggctgagatacggtgagcagtacaatcaggaatgtaaactcatgtccctaaaggtctggggcaaattctgaataaactggccatgagcctacctgttcctcagactacaaatcaccattaaaacaagtgtattatatatctagagatgatggcactaatgaatatttacattgtgtgtaagagaagtacatatacaagcacatttctctaggtcaaaccagtggccattggttttagtgaagagttcattaatgaagtgtttattaagcacctactttgtacagagcaccctactaaatgctattagaaaaatattagaaaaccatgccttagcactgtgtttccacctatcttctagaacttttatatcatctagttggttgagtagcagactattgccagaactgcaagttgagagcatctagaagtgtttctctgcataagagagtgttaaaattctttggaatacctttaggcgtggcatgatctccagtgctgcagcccctactatgttttcttgccctacggaattgcttcactcacttgggattacctgcctggactctgaaggcatttggctttgcatcccttggtcccaactgtgtgctgcctgtggagaaggctggtctaattttcatttcttatctcctagcttggtggttctcaaatttcagtgtgcatcaaagtcttctagaatgcttattaaaaatgttgactcctggctcctatccaaacactcaccaaaacacaatccttgatagggtcctggagtctacttttttttctggcatgatctccctctgtcacccaggctggagatgcagtggcgtaatcatggctcactgctgccttgacctcctgggctcaagcgatcctcccacctcagcctcccaagtagctactatgcctggctaatttttaaaaattttttgtagagacagggtctcactatgttgccctggctggtcttaaactcctgggctcaggcaatcctcctgcctcagcctcccaaagtgttgggattacaggcatgagccactgtgcccagctgagtctacattttaaacaagcatgctaggtgattttgatacaagtggtcagagggcaatactttgagaaccactgccacgcatgggcttctttatccctaaccagcaccgtgtccggcacacagtaggtgctcaatactgcctgctgttgagtctctgcctcaaagcagtggaaatctggctgtttaggtaccagaccaagcactggggaaagagtgcctctttagcctccttatgaaaataagggtattctaataaatgtagaatcttgatgtgtccgtgctggatgggatttcagatattacctggtcagcctactcattttgttggtgaggaaattgagcctcggaatctcgtatttgtttgttaaacatttcttgagagcctcccatgtgccagacactgtgctagcttgtgcctctgcacaaattctctttaaatctttctctttaactgcccctctgccccagtaaggcctaatagggttatgtgtatatagcaggtgctcttaatagatgaatgaatgaaagaatgatcagctcaatgaaatttacttagtgtgaaaaatgacatagaaaaatgggacattgcaagaaccctttctttaatattttgattaatatggtttctttaatatcttcattaatgccactctccttctttccatgttaccttcccacacatattttcatagttttctagcatatcctatgttattatgtgggaaaaagataatttatttgccatctttgaattatattaacaataggctaaaattctagttagggctttatagtcccctggtatcccaataccttatatctactgcttgctgaccccagagaactctctctctctcttccagggaaatgggtgatcgacccctcagagctcacttttgtgcaagagattggcagtgggcaatttgggttggtgcatctgggctactggctcaacaaggacaaggtggctatcaaaaccattcgggaaggggctatgtcagaagaggacttcatagaggaggctgaagtaatgatgtgagtgctcagaacaaggatatgcagaaactctggggggaacatcggttcagtgttcttgaaatgccattcaaacgccagggggtactatctccctgcgcaaactcccagcagtggcttcctattgcacagagaatacaatcaaactcttcacagtggtctccaaggcccaccataatctgatcatgcccacctcccccttctcagctcctacccatctctcctccagtccatgacatgccagccacactggcctctgctcatcttcacacacacagctgactccttgccatttttcaggtctcagctccaatgacatgtttttgttttggggagggaatgaatattattttcatccaaaccataaattagacaaaatgaccattggctattttggtaccataatattttcggcatttttgggagactgagtttaggccatctcaccccttgtctttttcctccaggaaactctctcatcccaaactggtgcagctgtatggggtgtgcctggagcaggcccccatctgcctggtgtttgagttcatggagcacggctgcctgtcagattatctacgcacccagcggggactttttgctgcagagaccctgctgggcatgtgtctggatgtgtgtgagggcatggcctacctggaagaggcatgtgtcatccacagagacttggtatgagcatgcagggtgaacacccacaggtccagggtaaagggacagttctcactgaaatgactgggaacgcattaataaataatacattacagataatctcctttcctttctcaacttctcccttccttcacctactttgggtggtcctagtggaaagggcttcatgaggacttacttctgggctctgatcccagcccaaactctttcacctcctgcatttcagtttatattcttccaaaatggagataactgccactccttcttaacctctctgtgactcaatttcctcctggtaaattgaggaaactgagtttgtctgaaggtattattcaagggtctaccagaatcacactggggaagcccttaagctactctcagaatctctggtggctgggactcaggaatattcattttaacacattccccatatgatttgtatgcacattaaaatttgagatatgcagctgggtgcggtggctcatgcctgtactcccagcactttgggaggccgaggtgggcgaatcacgaggtcaggagttcgagaccaccctggccaacatggtgaaaccccatctctactgaaaattcaaaaaattagctgagcttactggcgggcacctgtaaccctagctacttgggaggctgaggcaggagaatcacttgaacccaggaggcagaggttgcagtgagctgagatcaagccactacactccagcctgggtgacacagtaagactccatctaaaaaaaaaaaaaaaaaaaattgagacacactggagtgttatctccaatggctttttcaatgcaacagtctataatactaattaggggtcaggtactctccctattgaagaacagttttaagaggattaacaacatcaaaacattcttaatttagtcaactgggagatgctttcttcctgttatccctgatgttaacatttcctatcacatcaggttgcattagagcctatctttggttagacaacaccaaggatttctaattagaactcaagaatgaagataaacttactcatcttgatagtggatcttacacattcaactttccagttaacttccagcggcatttgtgaggcttaattaacatttgtaaagctccatgatgcccttgtatgacagcactgcagtaaagcaaaggactgtgattataggagactccttaactactgatgactcatcaacagttttcctctccgcctttgtttgcctgtctcctctccaggctgccagaaattgtttggtgggagaaaaccaagtcatcaaggtgtctgactttgggatgacaaggtaaaagagggatgtggtgccggtgaagtctcaggaatgggactgaggcccccggaacattctgaccttctccctccactctcttcccaggttcgttctggatgatcagtacaccagttccacaggcaccaaattcccggtgaagtgggcatccccagaggttttctctttcagtcgctatagcagcaagtccgatgtgtggtcatttggtgagtgtcatgctgggccccactgccccatgatctgggcttcaggccagctgtttcctttatcaaatgcagacaaccctacccacactgaaccctgtatcatatcatgagggtgtcccactggagggttgtgtaagaaaggccccgaaaactatgaaagggccttcatcattttgtttgtttttagagatactggacatggtggtgggagttaactaaaagtggaaacaagagttctggtgccagctgctgtgaagtcaaaagctggagaagtcaggagattcaaatatgagccccttgaaggcagggaccatgttttgtccaacactacatttccatacttatctctcaataagtattaatatttattcattcattcaacaacaattaactgatcatctattctatgccaagggctaatctaggtgctgaggatgcagtggttcatagaacagaaaagacttctgttcttttggaactaaatttgagatgggaggggagacagaaaatcacaaaagatcataataacagtcataaacaataataataataaacaagctaagggatagaagataaagccaggcaatcataagtaggtgctatgaataaaataaaacagtaatggggcagagtgactaggatagagagagggtctgctttgaatagtgtggtgtgggaaggcctttctcagaaggtaattcttcagcagagacttgaatgataggagggagctgtcaccatttgaagagccagggaacagtgtccctgacagagggaccagcaagtgcaaaaacttggtgcatccaaagaacaaggggtactgacttattgggagaacaacaggcaatgaagctggtaggccatcataaggaattagaatttctaaaaagtgcaaatggccatgaagggatgaatgatgttggtattgcaggatgtgccaaatgttcttgctggatttgccatgtcacctgaagtcatagtttgtgcatactaaagtgtgcaaaaaaatataccagacaacctctttgatttggattacaagaattatactgtggacagaaactacttgaagattgatttttgccattcggtatgaaggaagggtttgacaagggcttactagtagtagaaaccaggggggagtttggctaggtaaatcttttaggagaagaatgagtgttaaaaatcttctgcagcattttagtctatccatctctaggagccaagtggtttgttcattatgagtcctacctatttcttaaaacagtaccctattaaccaacccttgcagctactttgttaaccaggtttaagttacagaatggacttgaaagaaattgtactaacagcatttttggatgactcccctctccccagtgtgtataactaggaaggttggggctgatgtgcagtcatctcactatgggtgatgaaactgatcacactgcaccaagcaagcaagggccccacaatgagacatttggagcaatggccactttagcacattcaccttctgactctgaatggggtttattcagccaaagggtgtcagcctgggaatttcctggggcatattaccattacagggttgggctgaaattagtccctgtctaggatatattatctgaagagagtccagaaatgaggttgatggatggatgcagaattgagagatcaatggaaaaaagtgtgaaaaaactgggggtaccagcctaagcaacagaaacctggatgagctgaaaactccatgcctgcatcagcccattggactttgtcctacgttttaagtttctttgccctaattagcagtgtgctattcagaacaagtcaacctctttgtactttgctcaatttttttatctatacatttctcatctgtgtattaaagcaatcattctgaaaccatgtttcagcatcggcacattttcaaaaaaattttcactaaaaattatggtgtcttggggtgataagcattcttatttagggtcaggttctgaatttccaactcctgaggcacctctgagtaacatctagagattctgatccactgggtttgggctagggcccaggaatctgccatttgaacaagactctgagatgatttttattcaggtgttttggggatcatgctttgggaatgtctactctaagattctctggaacaacctttgaaaagctctgaattagctgatttgcaagcagccttcttgctctgacaacctgtgaatatatcagcacatgataaagacaaagctaggtgtcacatttctaccaagggcagaagaggaaaagaaagggattaaatcagaggtcaaaaatagacaagcaaaagatgtgttttgcttggtctacatggcattttttaaattcaagaagttcaactcttaatttttgacgtcttttttaaaaaaatcagaaaatgtgccaattctgatccctcattttcatgtgccatactttggttggagtcaaatcatagctgtctccttaagacagaactgtttatctcattttccacaatcctccccaatcccaatagtgtcacacctcctgcactccattcatttacatcctgcatcttggcatttgagtctacaactcttagttgtagcatttgagtttggtacaacaaagggtccatcttgaaaatccttctccactacaaaggttgggaaatttcagttctttaaaaataggacaggcctaataagcctcaggtagacttgatgcacttctggaggtagcacatgaatcctaatgcaaggagtctgtaatttctagaggcaggttggtttgtttgctgtctgtgggctttgtcattcactgtgctgtgctcaccatttcttgtaggtgtgctgatgtgggaagttttcagtgaaggcaaaatcccgtatgaaaaccgaagcaactcagaggtggtggaagacatcagtaccggatttcggttgtacaagccccggctggcctccacacacgtctaccagattatgaatcactgctggaaagaggtcagtggaggaagtgcttccccatgcattgtcgtatacaatttgaggacctccctccttccctagagaaaggaaccctctcagaaggatgaggcaggagggataactaatatagattagcaacaacatgactttgaggatctgttaacgggatagatcccccatccctaaaggagctgaaggcgaccttaaatattatttggtttgctacataatgtcacaagctataagcatagcttcagagaggaggatggggtgtggcctatgccagcttccttctcgattttctgagaagagaaaaaaagtctgtaacatcataaaaccattaaaagcacaggaagttagttctataacttggggaacaaagttcacttgcactatgaaaatattaaaatggcttaatttgagttcattttattcattctgcatttaaaatggggagccaattcctctgtacccgcccaggtggctcatttaccccaaccttggattgcaggccatggcttgagccccatcactatgagtcttagtctttgctgtctttgctgagttagaaaatcatacatttcagccaaagtggaaagttgctgaaacagagaattaataaaaattctgatcattgtacgacaacaaggtggaatacaaaaaatttggaacactaggattttgtctcagctttaccatttatttgccattaatctttgacaattctctgaacttcctttttcttactgttaagagaattaaataatgcttggtctgtgagttcatagagcttttataatcagaaacaaagaaacaatagagacataaaggagggcataaaacaaatcttatccacttcataaggattagctacaataataataatgatggctgacattcagttggcactttttccctcttttaaccatcatttattgatttttttaaattaatagtctttattttttaacaaagagtacagagttctcatatgcccacctcacctgaacagtttccctgttcactaacatttggcatgagtgtgatacatttgttacaattagtgaacctctattcatacattaactaaagttcatagtttacattaaggttcagtctttgtgctgtagagttctgtaggttttcacaaattcatgtatccatcattatagtatcagacagaatagttttactgcactaaaaatctcctgtgcttcacccatttatccctctcctcatccccaaaccactggcaactactgatcttttcactgtcttcatagttttgcctttctcagaatgccatatattggcatcatacagcatgtaggcttttcggactggtttctttcatttagtaatatgctttaaggtccctccatgtcttttcgtggcttaatagctcatttctttttgttgccaaataatattccattgtatggatatatcatagtttatttatttacctaccaaaggaaatcttggttgttttcagtttttgtgtttgtttgtttgggtttgtggggttttgtttttttttttgagatggggtcttactctgttacccaggctggagtgcagtggtgcaatctcagctcactgcaacctctgcctcccagtctcaagcgatcctcctacctcagcctcccaagtagctgggaccacagacatgtgccactaggcccagctaattttttgtatttttggtagaaacagggttttgccatgctgcccaggtgagttcaggcaatcaatccacctcaggcctcccgtagtgctgggattataagtgtgagtgctcaggcagactggtttccttcacttagtaatatgcctttaaggtccctccatgtctttttggcttgatagctcatttctttttattgctaaataatattccattgtatggatatgccacagtttgtttatctatttacctgccaaaggaaatcttgcttgctttcagttttaaacaattatgaatacagctgctataaatgtttatgtgcagatttttgtatataaattttcaactcaattgggtaaatgcctaagagtatgcttgctgaatcatatggtaagactatgtttaactttttaagaaactgccagaatgtcttccaaagtagctgtattattttacattcccaccagcaatgagagttccttattagcattcattgttttggatttcagtggttctaatagatgtgtagtcatattacattgttgttttaacttgcattttcctaatgacatatgatgttaagaacattttcatatgcttatttgccacctgtatatcttcttggtaatatctattcagatcttttgcccatttctcaatcaggttgtttgtttacttattgttgagttttaagagttctttgtatattttggatacaagtcctttatcagatatgtgttttgcaaaattttctcctagtctgtggcatgtcttctcattctcttgacagtgtctttcacagagaagacttttcaaatattttaacaaagctcaacatcaacttatttattcatgaattgtgcttttgatttacatctaaaaactcattgccaagcccaatgtcacccaaattttctcctatgttactttttattttatggaagttttataattttgcattttacatttaggtctatgatccactttgagttaattttcctgaaaggtgtcaggtctgtgactagagtcattgttttacatatggatgtccaattattacagccctgtttgttgaaaagactataccctttctcctctgttcctttgttaaatgttagtttactatatttatatggatctatatctgggctgatccattaatctgtttgtttattctttcactagcaccatcctctcccattactgtagctttagagtaagtcctaaagtcaggtagggtcagtcttctagctttgttgttcttcttcattattgtattggctctctgggtcttttgcctctccgtataaatgttacagtcagtttgtcaatatctaaaaaaaataacttgctgaatttttattaggattatattgaatctataagtcaagttgggaagaactaatattttaacactatagtgtcttcctgtccatgaacatggaatatctgtccatttatttagatcttctttgctttcttttattagaatttttaattttttctcatttagatcatgtagatattttctgagatttatacccagatatttcattttttggtgttctttagcattaatttcttgatatatttttatatgtgatttattgaattctcaaaacaatttcatgaggtagatactattattatctccattttacaaatgacaaaactgaggttcaaagaggttaaataacctgctgaatgtcacacagctaattagtggtaaaactgagattaaacactagtcccttggattccagaatacctgctgttaacaactaggacaatgtatatggaatacagtcaacatggaagcacatacaaaaatccacaggggatgctgctattaaattctggtttgttttggatttacctatgacgcacaagtacaaggaacttacagagttcttttttccctctccagagaccagaagatcggccagccttctccagactgctgcgtcaactggctgaaattgcagaatcaggactttagtagagactgagtaccaggccacgggctgcagatcctgaatggaggaaggatatgtcctcattccatagagcattagaagctgccaccagcccaggaccctccagaggcagcctggcctgtggcatcagtccctgagtcaccatggaagcagcatcctgaccacagctggcagtcaagccacagctggagggtcagccaccaagctgggagctgagccagaacaggagtgatgtctctgcccttcctctagcctcttgtcacatgtggtgcacaaacctcaacctgacagctttcagacagcattcttgcacttcttagcaacagagagagacatgagtaagacccagattgctatttttattgttatttttaacatgaatctaaagtttatggttccagggactttttatttgacccaacaacacagtatcccaggatatggaggcaaggggaacaaagagcatgagtctttttccaagaaaactggtgagttaagtaagattagagtgagtgtgctctgttgctgtgatgctgtcagccacagcttcctgccgtagagaatgatagagcagctgctcacacaggaggccggatattctgagaagcagctttatgaggttttacagagtatgctgctacctctctccttgaagggagcatggcgagacccattggatggattggggtgaacagttcaggtcccatgcttggagcattgggtatctgatgtctgcaccagaacaagagaacctctgacggtggagaaccatgtggtgcaagaagagatcttaggtctcttcttttataccaagctcatcttttataccaagctgtgcaggtgactatgcctcctcttctgcacagaatgcttccaccagcatcctgagaagaaatgattacttctgaaaaacatccttttttccagcctctgggaatcagccccccctctctgcactatccgatcctcatcaacagagggcagcattgtgttggtcagtgttcccttggcgagcaattgaaacttgtttaggccctagggttgagcaattttaaggttgagactccaagtctcctaaaattctaggagagaaataaagagtctgtttttgctcaaaccatcaggatggaaacagtcaggcactgactggggtgcttccaagaggcatgagagtgcctactctggcttgagcacttctatatgcaaggtgaatatgtactgagctaggagacttccctgcaaaatctctgttcaccctgggttcacatccccatgaggtaatattattattcccattttacaaataatgtaactgaggctttaaaaagccaagacatctgcccaaagtgatggaactagaaagtctagagctggtattctagcccaaatctgtctgaccgcaatacacagattctttattcctattcgacactggcttctactgaaaatgaaacggattgcagagggaataaatacaaagatggaaagccagtaaagaagtcagtatagaaccactagcgaatagtgttgctctggcacagaccactgtggttgatggcatggccctccaacttggaataggattttccttttcctattctgtatccttaccttggtcatgttaatgactttggagttattcagttaatgaccctttaattctcacaaccaaccagtcatgttgcttgaagccatttatagacgagcttcaaagcaactttaaaagattcttctgtagaagtatgagttcttcctttaattatcattccaactttcagctgtagtcttcttgaacacttcatgaggagggacattccctgatataagagaggatggtgttgcaattggctctttctaaatcatgtgacgttttgactggcttgagattcagatgcataatttttaattataattattgtgaagtggagagcctcaagataaaactctgtcattcagaagatgattttactcagcttatccaaaattatctctgtttactttttagaattttgtacattatcttttgggatccttaattagagatgatttctggaacattcagtctagaaagaaaacattggaattgactgatctctgtggtttggtttagaaaattcccctgtgcatggtattacctttttcaagctcagattcatctaatcctcaactgtacatgtgtacattcttcacctcctggtgccctatcccgcaaaatgggcttcctgcctggtttttctcttctcacattttttaaatggtcccctgtgtttgtagagaactcccttatacagagttttggttctagttttatttcgtagattttgcattttgtaccttttgagactatgtatttatatttggatcagatgcatatttattaatgtacagtcactgctagtgttcaaaataaaaatgttacaaatacctgttatcctttgtagagcacacagagttaaaagttgaatatagcaatattaaagctgcattttaataaatatggtgcatagggcctcggttccatatttatttaaatcgcaaactctcagaacttttccttaagtaaaaatggttacattgtttcattttccacagacaattaaagattacatatcattgaacaacattcattcaacaagtaaatatcaaacgttcctatggttcatgcacacagttcagtgtatgcatcctcatgaaaacaaagatggaaaagtcatagtctttacttctaaaaaattcctagtctgattgaaaaggaaaacatatgaagaaataaaattataatagaacaattagggcaacaacaaaaaactgtggtcaaagaagagaagagcccagaataagtgatggaatctatcagggaaaggatgacatcaagggaaacttcttagagccctgctactcaaagtgtggtccctggaccagcagcaatagcatcaccatgttgtgaaaaattcagattctcaggcttcttcctcacctaccgagcaagaattgtcattttaacaagatctgcaggtaatcgtatacacattaaagtttaagaagcactgtcgcgaggatatactgtctaagccagttttgaagataaatttatgagttataaggtaagtaagtgggcagaagtaagagacatactttccaggtagagagagaacaggaagtattgggaagctattgtcagttcactattgctggagcatgcgcgcatgcgcgtgcgcgctgtgtgtgtgtgtgtgtgtgtgtgtgtgtgtgtgtgtgtgtctattttctcagcaagggtaaggatgatagaagaggtgggtaaattgaaactgaatctataaatctatgaaagaactatactttaaaagaccaagaagttggaatttcaccctataggtagaaaagatgtcattgcacaggaagagaaggtcaaatttgcgatgtgtttaagaatatattctggcagcagcatagtgaatggatttgagaaaggcaaagccaatggaaaagaaactaatttggagattatctttgccttgttcacagtaccatattatttttcctaatcattcactgtcatctgttgtgtgggtgacatatggaaattgtaatttggagtacgtcattcactttagatagcaataaaatagctttccttcttaaaaccccagtaatataaaggctgggtggttatagttttggtgtgctgagcactctgtgcctttcagtccaccaaatgcccagctccattgcaggagccaggtcatgcgccagtcaaccactgagcatggaagagaaagcccaaggcttccatgcagtccttcctagaactcacctctgtgcttgaatcccactgccaaatcatccacatgagaaagtcaaaagcagattggaggaacagatctgcttctcagaggatttttcctgcagaccctgctcttctcagaatctcccaacacctaaggccacccttttgaggaaaagacagaaatacctcattcagcaagacagggagtatgtgcatcatcaggtgcagaaagagctgcagattcccaattagagggcttgggaaggtggcctggtcaggaacagagggctaggggtggaagctgcatttgaacagtaagcacatggttttactttagaatagatattaatttgcgtgggctttaatggggaaggtgctgaaattttggtgcactgaggctcacttcccagagccaccccttggtaccagcactaggggtgtgtgtatggttgtgtaagagtgtgtctgcaatgactttgagattctccccaaggtacaatgtatagttggcttgtagtataacagagtcatacagacaatgagtggtagacggagttttagagttcatttacttatttcataaatggttaccattcatctactatggctctttgttaggtacatgatctaaaaagatgactaagatatctcatcagttagggaccaagcacgtcacaatcaaattagtataattcgaggag

SEQ ID NO: 12498 - DNA, 5788 bp, Human
ttatttttatattgtgtagattcaatcttgtttccttgcctagagtgggccgtgctttggagttcttatgagcatggcattcctgagaacttctctaactgcagcctcgggcatagaggctgggcagcaagtggcagcagcagaggactcctagaagccttctacttgactctacttggcctaaagtcaaactccctccaccaaagacagagtttatttccacataggatggagttaaaaaatatattctgagagaggaagggcttgtggcccaagagaacaccccagaaataccaccccttcatgggaagtgactctatcttcaaacatataacccagcctggacatccccgaaagacacataactttccatttcatgcccttgaaagtgaatctttcggcctaataatgagaacaaactcattttgaaagtggaaaaattgagattcagagcagaagtttgactaaggtcacaaaacagtaggatgcctcactcagctccctgtgcctaggtcagaaaagcatcacaggaatagttgagctaccagaatcctctggccaggcaggagctgtgtgtccctgggaaatggggccctaaagggtttgctgcttaagatgcctgtggtgagtcaggaaggggttagaggaagttgaccaactagagtggtgaaacctgtccatcaccttcaacctggagggaggccaggctgcagaatgatataaagagtgccctgactcctgctcagctcagcactccaccaaagcctctgcctcagccttactgtgagtctggtaagtgtcggatggtagaaccagggttgggactcgggacctccaacagcatacgatgtggtgggggtgggcagcctgggtgggggtgggcattactctggggctggattcagctggactttcattctagggggactcgagtcagagtactgagagaaaagtgccttggcacagaagtgcagaacagagagtaatcatcctatgtcccatcttttcttgtgaccatatttttggatttgtgtgtgagagagaattatggaagggaggaggggaatagcattcaacttctttcctaaacctcttgggttttgacagaccatcattttgccttctttatggagggagaggttcagggaagagcttctaccttttggctatgctgcacagagggatggcagaatggggaaacctttctatttggagaaacctaggcagagctgggacaggaaaactcaacttagaagtataagacttggaagaacaacctccaactctcagcaaccttccagctcccgcagccccaccccagacacaaggactgcagctaaacctcagaaggtcaggagagaaagcagccctggggttgaataggccaacctgctggctttacaggggggaaaaccaaatcccaggagactaagtgacatgcccagaaacacacagcattccaatgggagattgaggcctagagcatgtcctgtggctccagtctggaggtcacaccatgacctcttaggtcctctctggcacggcctattggttttctaggacttggtgttctccaagagacatttcattccctaaggccttactcctcactgtgacataatcccagaacgcatctctgctccttggtcagtgaagcgatgagggtggacacaaggactagacaagagcagacagtgagctggcacctgacccacccttgcagaacagccctgcagacagatctccttgttggctctcacctgggaacaaggaggctcctaggaggacctttctctgcccctccacatttccacccttctctctctgctgcttttgggaaatgatagtccagaggtggtagaacagtaccctgcccaagggaagaggggatgctaaaaaaccagatacttctgcagattcccaaggtttcatctatttcctttgccttcagcctgtgcatcagacctcttctgtctttcaggttgacagtagcttctaagatgtcccagcaacacacactgccagtgaccctctcccctgccctcagtcaggagctcctcaagactgttcctcctccagtcaatacccatcaggagcaaatgaaacagccaactccactgcctcccccatgccagaaggtgcctgtcgagctcccagtggaggtcccatcaaagcaagaggaaaagcacatgactgctgtaaagggactgcctgagcaagaatgtgagcaacagcagaaggagccacaggagcaggagctgcagcaacagcactgggaacagcatgaggaatatcagaaagcagaaaacccagagcagcagcttaagcaggagaaaacacaaagggatcagcagctaaacaaacagctggaagaagagaagaagctcttagaccagcaactggatcaagagctagtcaagagagatgagcaactgggaatgaagaaagagcaactgttggagctcccagagcagcaggaggggcacctgaagcacctagagcagcaggagggacagctgaagcacccggagcagcaggaggggcagctggagctcccagagcagcaggaggggcagctggagctcccagagcagcaggaggggcagctggagctcccagagcagcaggaggggcagctggagctcccagagcagcaggaggggcagctggagctcccagagcagcaggaggggcagctggagctcccagagcagcaggaggggcagctggagctcccacagcagcaggaggggcagctggagctctctgagcagcaggaggggcagctggagctctctgagcagcaggagggacagctgaagcacctggagcaccaggaggggcagctggaggtcccagaggagcagatggggcagctgaagtacctggaacagcaggaggggcagctgaagcacctggatcagcaggagaagcagccagagctcccagagcagcagatggggcagctgaagcacctggagcagcaggaggggcagcctaagcatctggagcagcaggaggggcaactggagcagctggaggagcaggaggggcagctgaagcacctggagcagcaggaggggcagctggagcacctggagcaccaggaagggcagctggggctcccagagcagcaggtgctgcagctgaagcagctagagaagcagcaggggcagccaaagcacctggaggaggaggaggggcagctgaagcacctggtgcagcaggaggggcagctgaagcatctggtgcagcaggaggggcagctggagcagcaggagaggcaggtggagcacctggagcagcaggtggggcagctgaagcacctagaggagcaggagggacaactgaagcatctggagcagcagcaggggcagttggaggtcccagagcagcaggtggggcagccaaagaacctggagcaggaggagaagcaactggagctcccagagcagcaagagggccaggtgaagcacctggagaagcaggaggcacagctggagctcccagagcagcaggtaggacagccaaagcacctggaacagcaggaaaagcacctagagcacccagagcagcaggacggacaactaaaacatctggagcagcaggaggggcagctgaaggacctggagcagcagaaggggcagctggagcagcctgtgtttgccccagctccaggccaggtccaagacattcaaccagccctgcccacaaagggagaagtattgcttcctgtagagcaccagcagcagaagcaggaggtgcagtggccacccaaacataaataaccacccgcagtgtccagaggccctcagatcgtctcatacaagggaagagagagccactggctccacttatttcgggtccgctaggtggcccgtctcatctgtgaacttgactctgtccctctacatgtctctttaatggggtgagggtgggggagagagggaattattgtccagtgccaaccccaatgaccccaatcccaacctcaggtgagcatggcctctacttgagggactattgttactataggaatccttacttccccagtattgaagctgaatcagtgagtgtgtacaatgatacataataaatcctggaagtcttgggatcctatattctctttagcattttcttctatcacaccacataaaaacctgtgtatgggtcaatggctgcaagagactcccacggcccattctcaaaggaggacagactctttttaaattttggtcctcaaaccactcaatagatctaacagttcctgaaaaagaaacaaacccccccccaaaaaaaatcagcttcacttgatgtacttgaaaacaacacttgccagccatgaaaaggggatacgttgttctggttgcatctcagtccaacactaccttccaccacaacaccacactcaacccctggcagagcccaccctacacttctgctccagactcagctcctctcaggagggggactgggaagatgctaggaaagcttgggggctccatctgggttctagtcccttccctggaaacatttcctggctcttcttcttgggttttctctcttagaaaatctcatgatttcaaaaagtcttatggtctgcctacttggctgaggaagactttagcaaagcaatagaagtagaattgggcaaggtgggaagaggaggtgttccagattgtctctgagggaaagtgacagcgttattaaagtaagtaaaggttggaccagcagcagtcatggaagccaaaactactgactaagctggagaaatacagacccagtcactgcaggtgtcaccctcctgctacctggctccctgacatttccatagcctttactgccatcaatcatatcaggacctggggctctcctttcctgggaaaagcgctgcttttaattcttcaaattgctcacttttaactatttgaccacagcattttaggcaggctgtctcaagctatttgaagctattttactgcaggcagttaaggatttatcagggacttccctactgaagtgtccagagacactcaagtttaatagatctgcacatcatggcacttagcattccttcctccccacccaaccccagcaacactcactgtgtttcctccttaggtgttttctctttgagttaagaaaaccgccattgccatctgtgtattcacaatcattcctcattcttcctcctcttccctacccccatcaaggatcaagtccttgctatctccaccaataccttctgagctcggcctgaagtcgtttctcacctgaactgttgcaacacccttccagctggtctctcttgctctctatctccacataccctgcgatccactcatcacccagagcacagggtgttctacttaaaattcgaatctaaccacatccctccttaggttagcacttgtcagtggttctcatgactgagaccatgagaaggcaggctcaagctctgggcagggagattggggacagaaggtacagtaatcagaagcacccagtgtgtgtgcacattttccagttgattttttaaaaatagacattttaggacagtatcaaatttgtagaaaagttaagaaaatattagagttatcatatatttcacacagtttcccctattattaatattttacatgagtagggtacatttgctacaaattatcgcagctcaatacggtgttattggctgaagttcctggtttattcagattttcttagtttcacctaatttctttttgctgtttcagtatcccatccagcatatcacgttgcatgtacttgt

SEQ ID NO: 12499 - DNA, 9474 bp, Human
ttgaggccggtgctatgttcactcccagtttacaggtgtaaaaacaaggcacaaagggtttaagaaagtgcagagggacacccaggtgcttggtcatgaacctgagccctctgtctccaaagtccatgctcttaaccaggggttggcaaatgttttctttaaagggacaaatagtgactattttaggctttgcagggcatacaatctctgttgtaactactcagctctgtctttgtagtgtgaaagcagccgtggacattggacattgacacagacataggacactgggtaaatgcatatagctcccacctgaattgccaacccttcttacccatcctagcatcattcatgccaagcctaaagcctctatcccaagagagtagagtgggtcggagcacataccagaaggaacacttctttcccagaactgggtggaagcacattcttggtcaaccattgtgcaaccagggtggagggaggggagctgcttccgttgtcttgagaaggtatctcgttcttgccagacgctgagttagcacctcctttagacagggaacaccctgttctcctggatgctgtgtccccccctccaaatgttggagaaatgggactgcttttaaaatagtaacaagagctttcctgaggctcttcttagcatgggagtttgttcttcctcctgcggttgctcatttatccataggttctcacagaacaatattgcccaggattgctctccattctcctcatgcacagtgcttaatgcatggactggagaagtgaagctcattcctctgtaaaccaagcacactcacctttgtcagcctgcccaccctcccagaaggtgtatatggatttgagatttcaagcactgagatcagaaattaaaatgtggaattgacatgttacatcatcacacttgtaagggcacaattttatgattcacagcttccatatgccccttgactttccctacacacccaattaaactgtctgactcttgattcttaagaaatgtcaaaatctgtgggaataaaaatccagtgaattccttaatgatttttatatcactcattttccgttgtttaaattaagctctatgtaaatgctccaaaacagcagggagaaggtgtctataaatttcaactggaaaggcagatttacatgagactaagctcaataggaaagcaagcactggagagagaggtgcagatatggaaagaaactcctggcagaagtcaggtctctgagcaccctgggcaatgtctgctcccttcattttaggtaaacggcatgtgggcaggtgatcacacagtacacagaacaaatgttgctcctacagtgtaaagactcaactcctctgtccctcttgcctgacaaaggagggttagatccccaaagcagaccccgttcctatgtccaggacacaagggaggacagccaggagctccagaagaactggtccaaatgcagtggaaaaaacacaacaggctacttcttgctcaggccatcgggcaaatgcccatacgccctcaggaaggatcccactcagagggtgaggctggtgcaagtggagtagaaaacctgtgtgggaagggggcacacagggagtgtctgatgaagaagaaggaggggacaattatcacagatcagctccttgtctcctttgtttgaggacatgactaactcatgacttcagtgaatgtatacccgggcttattgtgttaggatcaagtcaaggctggaaggcaggagaatttctctatgactaaaggaagccaaaaagcaatcttcatatttcatacctttctagaaactgggtgtgatctcactgttggtaaagcccagcccttcccaacctgcaagctcaccttccaggactgggcccagcccatgctctccatatataagctgctgccccgagcctgattcctagtcctgcttctcttccctctctcctccagcctctcacactctcctcagctctctcatctcctggaaccatggccagcacatccaccaccatcaggagccacagcagcagccgccggggtttcagtgccaactcagccaggctccctggggtcagccgctctggcttcagcagcgtctccgtgtcccgctccaggggcagtggtggcctgggtggtgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcaccgtcaaccagagtctcctgactcccctcaacctgcaaatcgatcccaccatccagcgggtgcgggctgaggagcgtgaacagatcaagaccctcaacaacaagtttgcctccttcatcgacaaggtgagccagtgccatgccctccatggggcacttcagggtccccagaccagaggagcaacaccttcctgccagggagacctaggagggagggagaagaggactcagcccagctctgcagagagtgcagatggctgctggtgcccagcaagcagcagggatgggcatcactcccccatgggatctctggagtggccctcactcctgcctagggagaaccataacttttcataaccctgaagcacagatgaggccatcagagaatggagtaggttaactcttccctttgaagcgtcaaagaaaatgccaggagtacacgggctggtaaattacactctggggtctggataagaggaaaaaatattggaaacaaaagaaaggatattttggctagattaagaaaaaaaagacttaaaacgtttatacgttatgtggaaatgttaattaatcctcaaaacaaagaatgaccataacatcaggatgttttagaggagagacttgcacaaatgggaaataagacgggaatcaaatcattgggcaacatttaacatctcttctaactgaggtcctatcagtaataaaaactgtgtaaaatttatcagatgaatactattttataactatgtttgtaattttggctgggaaaagaaggaaaagacatgttgaaactcattaatatgtccaataacttagagagtgagaacacctgaatggtccgtgggacaattcctctagtgagattggtggggtacaaaggagaaggggttgggggagcagagctcagcctgagcctctctacatgcactgtagtagcccagcaccatgggaacctcccggacctgccaggaaaccggataccagacactttttcttccttcccttgcctggaaaatgatcatcttgtctctctttcaggtgcggttcctggagcagcagaacaaggttctggaaacaaagtggaccctgctgcaggagcagggcaccaagactgtgaggcagaacctggagccgttgttcgagcagtacatcaacaacctcaggaggcagctggacagcattgtcggggaacggggccgcctggactcagagctcagaggcatgcaggacctggtggaggacttcaagaacaagtgagttaaacaggagaaatggactcagtttcctgcagcacacacttcaagactattgggtgaccagggccagaagggggtaatattcctaacaacccatgtccatggaaatgaagagcacaaattagtccctaggagcaaacctgcaagaaccacagatggttatgggaggatggggagattaaagaagtggcaaatttagcagaagcaaaaatcgtctcttaggctctctgtggcaggaaagcccaattagaatatattccattcgggaaaatgttgaatcccaggctgcttttctgtttcatcctacccactggctcaaatgtgtcccatgcctttcttcctgtagatatgaggatgaaatcaacaagcgcacagcagcagagaatgaatttgtgactctgaagaaggtgagcagatgaagccgggggttcaaattcatttagaaggagagaagtggctttgtgtcctcgctcccctgggagaggagaattggcatggagactagaagatgggtagattggaaaggtgagctcaggtaactccaggttgttggctctttccccaggatgtggatgctgcctacatgaacaaggttgaactgcaagccaaggcagacactctcacagacgagatcaacttcctgagagccttgtatgatgcagtaagcatctccaccatccttctgtttactctgatggggtctgcaaaggggagaagatgtatagggttgggtatctctgtaaatgtcagaagtgaagttgatcttatgaccttctgttctgcaggagctgtcccagatgcagacccacatctcagacacatctgtggtgctatccatggacaacaaccgcaacctggacctggacagcatcatcgctgaggtcaaggcccaatatgaggagattgctcagagaagccgggctgaggctgagtcctggtaccagaccaaggtgagcagggagtgggcagccgctgaggaatccctgtgtccatccctgaataccagaggactgcagacttcactggggacatcccctgacaggaagctggggtcctctcacaggacatgcactctgcactattagagtagacatttgcagaacttatgcccaagtcaagaaggaaaaagaacccaatgcaggaggaaagctaccatagacaaggacatagtcatctctgcatttagcttcaccctgattgctggcttttagaaattggtacagaacatttctactccctaaagaaactaggcaggcagtggtgccataatgaggatggtctgtgactccagtgtttagtatccaccaaccacataatatcaacttttcctcaagtttcttgaggagaagcctttaggtccacttcatgacacgcatgatacacaagtgaaagtcatcgctcccaggtaagaacccgtagacactgtctctctctccacctctgggctgcagtacgaggagctgcaggtcacagcaggcagacatggggacgacctgcgcaacaccaagcaggagattgctgagatcaaccgcatgatccagaggctgagatctgagatcgaccacgtcaagaagcaggtatggtgagggacaatggaggagagaagcatttccttgtcaggtcgtcaggcagccatcaaccattatattagggaaaatcccctggaacttatcaaaaccagggagaggaggctatcatttcctacccttagtgggtacctgctgcttaggagacatagatcctacctatggcatgacacaaacacatgagagaaccagtcacgatgctcagagctgcaaaaacatggtttagagcaggagtgtccaatattttggcttccctggaccacagtggaacaagaagaactatcttgggccacacataaaatacactaatacaaacaatagctgataagctaaaacaaaacaaaacaaaacatacagccttgtccagtggctcatgcctgtaatcccagcactttgggaggctgaggctagtggatcatgaggtcaggagtgagagacaagcctgaccaacatggtgaaacgccgcctctattaaaaatacataaaaattagccgggcatggtggagcgtgcctgtagtcccagctactcaggagactgaagcaggagaatcgcttgagcctgggaggtggaggttgcagtgagtcgataccgcgccactgcactccagcctgggtgacagagcaaaactctgtctcaaaaagaaaaagaaaaagaaaaaaccctcataatgtattcagaaagtttaagaatttgtgttgggctgcatttaaagccatcctgggctgcatgtggcctgtgggctgtaggttggacaagcttggtctagaggaattggatttatttccataggaagactgacttggaaactgcaaaggaacaaattgaaaaagaaaagggcagataagaaagcacaaggaacattgtttcaaatctgctcaagactcaaggtgaaagagagagtagaggaagggcaaaggacaaagaacagtagatgagagattctgagggggaggaaggcaaggtctcagcagtctcatgtgaagactcatcacctcacttcaggatggtcttaattttgtgtatgttagtgtggcatctatatgaggtaatcataagtggtcttgatttgactgtggagacaacactccaaacaaaccagcaggtacatttcttccagtgtatgtgtccactgcagtgtctcccattagtaaatatccacattctcccacagagtggttcacaaaaagggttatgagtttttgtcaaatgaaccagactggacaaaaactgcaaaataaaaaaaaaaaacaatagataggaagagtcagagctcattcaccatcaattctgggctcctggccccttcttcactaggaaataaccagccaggtttagtctcctctggaagaccggatgacaagtttcttctattcctttcctcttccagtgcgccaacctgcaggccgccattgctgatgctgagcagcgtggggagatggccctcaaggatgccaagaacaagctggaagggctggaggatgccctgcagaaggccaagcaggacctggcccggctgctgaaggagtaccaggagctgatgaatgtcaagctggccctggacgtggagatcgccacctaccgcaagctgctggagggtgaggagtgcaggtgggtaactgacacgaactccttcaacagctgagtccatcttcaaggttcctggcactgagcacaactttaaggtgcactgcccatggccataattgctcttcctgagagaaaactaaaagagcagtttcccatggactcttccacccaccgaggctgcccacgctggtccagggaaggaagagctctctgaggtctcaccctccctgtgttcctctccacaggctgaatggcgaaggcgttggacaagtcaacatctgtaagtacctttgcttgccttcctcccctgccctcgcactcttctgactgggctcaggctgacaggatgagctcaccatggcttcttgtgtccttgtcccctccccatcacagctgtggtgcagtccaccgtctccagtggctatggcggtgccagtggtgtcggcagtggcttaggcctgggtggaggaagcagctactcctatggcagtggtcttggcgttggaggtggcttcagttccagcagtggcagagccattgggggtggcctcagctctgttggaggcggcagttccaccatcaagtacaccaccacctcctcctccagcaggaagagctataagcactaaagtgcgtctgctagctctcggtcccacagtcctcaggcccctctctggctgcagagccctctcctcaggttgcctgtcctctcctggcctccagtctcccctgctgtcccaggtagagctggggatgaatgcttagtgccctcacttcttctctctctctctataccatctgagcacccattgctcaccatcagatcaacctctgattttacatcatgatgtaatcaccactggagcttcactgttactaaattattaatttcttgcctccagtgttctatctctgaggctgagcattataagaaaatgacctctgctccttttcattgcagaaaattgccaggggcttatttcagaacaacttccacttactttccactggctctcaaactctctaacttataagtgttgtgaacccccacccaggcagtatccatgaaagcacaagtgactagtcctatgatgtacaaagcctgtatctctgtgatgatttctgtgctcttcgctctttgcaattgctaaataaagcagatttataatacaatatattcttttactttgccttgctttggggccaaagttttgggcttaaacttttttatctgataagtgaatagttgtttttaaaagataatctattctttatacacataactcccctcctttagagaggttcatcaaacttcagcttggtatcatgacattcagagtgtatttctagatcaaattccatatgaacttttggcaaatggagtgggaggcatctggtccaccagcattgtccactccgttttaactgaccataccaggaactagcatcccattccctctgccttggtttccaggaccacttttccccttacgccagggctcagcctaattgtccagttaagaaacatattctcggccaactagagcaagttatttgacaaaagaatcagatatgtgattaatcattataattgccctcataagcaagaaacttgcctgacaacatgtatcaagcacaattaaaatgtgcatacactgaaccgtaattatacttctagaaatatatcctgaggaaatagaacaaattcagaaaggtgtatgcacacagatgtgcatcacaagaatcttcacaacagggaaaagttggagacattcgagttggtcaaattaagagctcaaagactcaggccaaaactcagatgcttattccttgaagagtgaagacagtagaagaaaaaaatgtcctccttctcataggagaaggctctgttagagatccacagatagcaagcctaaggctctgatagagatccaaagaaaccaaatccatgttgctcagaagagatggtcctattcttctctttggtgtgaactgtcctggtttaacttctatgaatggagaagggaaaactcagaataaggttcaaggttggtctattgacttgtcctgtccccaggccacttcagtacttgttacctccatgagtgacaattatcttcctaactctaagattctcgtatcactgaagaaattttcttggattatactggtgtttctggatcctgctgtattggtatccaactgtgttcatctccaaaagttcccccagcaatatgggaagtttctcacattggcacttcctcacattctccccagaactttcctgacagcagaaaggtgaagactgacttccaaaatctaagcaatcttaccgcatatatatgtacccttgagaaataatgaaaaagaaaataattgataagaaaaattatctagaatataacaatacagcaaaaggaggttaaaaattatccatataggtttaaataaaattaaaatcttatggttcatgggcattaaaaatgtaacaaagaaatactacaaacaactctattggaaatttgatagcttagtttgagaagaattgttactaattcttctgtacatgttgagtagaattcagtagtaaggttatctgctcctagatttttctttgttggaatacttt

SEQ ID NO: 12500 - DNA, 53336 bp, Human
aataaaaaggagaaattaaaataaaataaagtaaaattgcttctacttttaaggatgatctggaatgttccttttcataggtggcatgtgttttgagagatagcgagagagagattgattgatccacgtcaggaatgccctcccttttactccatcctccacggccctgcttaaatcccagttaattccatgacatcttctgtgcttactctacttcaaagtgatttctctctctctttctcttcaaatggctttttattgttcactgctatgctagtgatttgaaagaccaggtgacctctcacccgtgatggagcttttgtacagcagagctgtgctttatacagaatgatcagctacaaagagctcttaggtgcggcccaggcacaatggctcacgcctgtaatcccaacactttggaaggcctaggcgggcagatcacctgaggttgggagttccaggccagcctggccaacagggataaaccccgtctttactaaaaatacaaaattagctgggcgtggtggtgcatgcctgtaatcccagctactcgggaggctgaggaaagagaatcgcttgaacctgggaggcagcggaggttgcagtgagccgagatggcaccattgcactccagcccgggcaacaagagcgaaactccgtctcaataaaaaaaaaaaaaaaaaaaagaaagaaagaaagaaagagagaaaagaaaagagttcttaggtgtgaggccctgcaaggagcaaatggcctgggctaccttcactgatgccctcagcaccttctaaggtgaggctaacaccagctcacattgatgagctagtgctgggcctggagcaaaatgtgtatttcatttaagctgcccaccagcttgtgaggcaggtgcattaccgtgacggcggggctcctcagagtgtgtataagaagaaaactgtgcatggccaaagctatgcttgaaaaccctcaggaaggcaccacctcaaggaccaacacagcatcacttagtaaaggcaacagccttggaacagatgactcgtgtgtgtgtgtgtgtgtgtgtgtgtgtgtgtgtagcattagatgaagtagtaacttgtgtttagaggttgccttattgcacaaatatagttgcttttatacactggactcaccctctgccaataagttgttcagttatgagaaatgaacaatgtctgaaactaagaaaacagcaaattctcacctcctatctccagggaatgtgctctttggctagaatatatggcagaatcaatagtgaataaaatatattgtggaaacaatagtgaatggaatatatgacactaccaatagcaattgttaagttttttttctttttaatttttctttttaggtttgtctagttgaatgcatctaagttttatgtgcatatgaagaatcactgttttcctattatacagatttggaaactgagattcccagcttttaactccttgcctaaggttgcatagcacagaaatagtcatatcagaaactgagccctgtctgcacagtgtagcaccttgttcagccctgggtgcctgactcactcactccttgaggaccctctcatgacaactgtaaagaggcagctgaaagaatcccagtctttgatggtgggaggggaaagtggttggaaagcattaaaaaaacatgctccagcagttcactgatgtgggaaattgtctgtatttcaggtcaaccgtcaggatagattttggtctgcaaagccccagctgagcaagaatgcagtgtagacatatgggtgcccagagtttaaaggaaaattactcagactcacattggagtttaagaccccttcattgcctctcctactgggttggggtgactggagccagtggggaattaccaaccctgtggctctctctgcatctcaagcctccagagctgggcttccttgtttacttatttagagcccagcagaggaagtggtaaaggaaactagctgagtcgttttctgagaagagaccatatttgttcgcagaggaagccgttgctttctgggatctggctacggcagaaaagacatcggctccaacaggggtgttccacagggtagctgggagttggaagagccaagaacgcctccgagctctggatttgagcttctctgcccatgggtgaagcgcccatgctcagcttgtgagcttcttcccgggagagcagccatggcactgaggaatgtgccctttcgctcagaggtcctgggctgggaccccgacagccttgctgactatttcaagaaggtaagccttgctcttgtgtgaatggtcatgatgctagtgcccttggtgggctgagctgaggcttgacgatggaattggggcagaatgtgggaggtgtataagatagcaatggaaccctatggcaactttactggttgagtgagcgccatatagaccgctgagttttcctgaccatgagttccggagagaaggatgggagcagaagccctcaaatgagtatgtgcctattatgtgctagggtttgaattcggtgtctcacaggcactgtcccatttagcgctccctactatgttgtgaggtcagcattgttatccccttgactcagctgcaaaatcagctcagggaagtgaaatggtccgaagccctagggactacatgtgatagaggcaagactcaagccacacctatctggttttaaagtccatgctctgagatgcagagaactgttgtaactgctaatgagatcaacgctacttactagaaaggggagacgtggtgtcctggaggcaggagaaagaataggcagggtgggagggctggatagaggactatgatgagcagtgccagacacagcatttgggctttcactgctcacgaccctaaggggggtcctcaagctcccgcctggggcagtctccttggagccttatgagagtcttgtgaagcaggacagaaaactgatgtgagccccaatttatagctatgaaaactgaggcccctagaggaaaagaggcttgtggcggtgctgggaccagagcgttgctgtcttatcttctggacttagaggaaaggttgaaggatccctgtgcttggtcattggcagaaggggacaacgcatctgcttgggcagatctcaagccacatgacttagttatagtccctctaccctgaccatgtggtaagatgacttgtgcgagacggttaagcttctaacaccctcatccctgcaggctggcatcggattctgttgatattccagactgtcataaagatgagattgtaaagctaagatggtagaagtcatctaattcagcttcgtgtttttcctggggaaattgagattcaagagggtagacgaggttccctaggacgtatagccaaacctggggtctatgcatttccgaggcatttatagtcacagctgttctcccccaacctgaagaagaaaatgagaacatgttgaactaggtgtggtatggtaggggtacagttcacagatcctgttttttgccatattttgtgctttcatttctgttattttccttctgcaaggtcataataaacttagatttcagcaaatattgttgcgcaactggttttttgaaggatgtttctaaatatcttgctcaaatatagaccaaataagatagggcaacaaggtaaaatttgccaagagggaataaagtggcatgttaccttgataaaggaaaaagaaaggaattgagaattatgaagagaaagacttgggacgggctgagaggcacagataggcctaacattcaggtgtgaccaggagaattatacaatccaattgagcaacagagaattgatccctaaaactcccatcagtacagggagatggaccacgggtcagggatggtacaggaagacctcactgcctgagctgggggaagggagagttttcttcctggagatctcagaccccaggacaaatctacagcacccaggcaggttccttcttctgccataaatggactgagggaagaaactaggagactgaggcaaatctgtgatcctggaagttctagtccctccacagacttggatagaaacccttcagattctgagtacctcagccccctgaaagaaactaccaaacgaatggaccgcagagtcatttgggaatggatcttagctgtcaaacatgacatgtaaagaattgatctgcagatgcaaactctacccaagtagtggggtcaggcctcccttggagacagctctcgactcagctctgaggtcggacacactttaccctggctctgccacctgctagcttggcgactttcctgtagttgctttgcctctctgtgcctcaacttcctcatcagtgaaatagagatatgaacagtaactaacccaatgggttggttgtgaggattaaagcaaatgatgtgtgcaaggcactcagcagacaaatggatcctaatgcgtgttccttctgcccttttaccttctctattaactggctcctagctggggacacccatgcagactggtgggactttgcgtcttcttgtctctgacatgggtacctcgtcctgtgtctggaatataagctcctgaggacagagaccatgttacatatttgttcaatctctccaattccttttgacttgcaggagaacatccttgggtcgtgcagtggagaggcactggctcagagctgtgtgtcctaatcccaggtggggtcccagctggtatcccagctcactgtgtgaccttagaccagcctctttccctctagaggcctcagtcttccttactacaaatccaggtaacttttctggaccagtgcctaccaatgctggatgccataggaatcgtctagggtgctccttaaaaatacagatttgaggtccacaagcctagatcttgctggagcagaatcaaatgcctgggtcccagtctgcaggactctctgctgatctagacacaaagttagcactcttcaaaatcatctggtttatctcataatgataacagtgagaatgatgaattaaaggcagttgactcttccaagaaccacttaccccccactgcctgtagataaaggggataccagggctccatagatgggatgtgctttcaatatcaacttctaagtcagctttctgagtgtgataatcatcccacccttccaagctaagatttcataacaattgtatttattctttggatttgctagctataagataaaaatatggcttaaaatgtgctccaaaagaaggctgccacaaaccatgaggcccacccttgtgagaagaacctaggatcctcaaggagaaacatttaacctcaaatgctccaccccaaagcagcaagttgagagatacttcaaatgtgaacatttatgctgttgaggacaagttgaaactagcacctcatatgattgctgattggtctaggaaaataaccaagatcttaaaaatgctcgttcctatggatcctatataactcggttctgaggttctgacttaaacaatttatctcaaagagggagaaaaaagttcgcaaaatagtatccatgattgtctctattttgattgggatgaggtactgcaaacaaatgaagctgcattttcatttgctcattttacttactgtatataagttatgctgtaattaaaaggggaatatttctgaaagagacattaaagcctgttctgaaacttgtcacctaaaacccatggaacctcatgcaagttacttgctgtctgtgcctctcattccccatctgcaaaatgtgagggttaaatgattgaagactagtttaactacttggtacactgcctgccacacagaaagctttcgataattgttcgccgtttttattatcattattgaaacagcagcttggtaaataatctaaatgttcagcaataagggcatgattaaataatgttgtggtcattaaaattattttaaattgagtttgcataacactaggcagtgtttatattatccctttaggtaatttaagagaaaaaagtcagaataatgagattgaatataaatcataacctcaattatgtttagaaacatgctaggaagaaagcatggaaagaaacaccgaggtcgtctctgggcatcgagacaatggatggtatttcttttcttcttttagctctccttcctgaggagcatagggcagagctctgcatgccttgaaggcagtctttctgtaagggttggccccgaagccttagagcaaggcaatttctccatttcaggcagtcccaagggggtagtgaaagcgaggctgaggtggggactgggccctctgttagccaagggagggcagtggggagcctggctagccacaagtaccgcaaagtgctaagtttctggggcaggcaagggagaggaaccaatggtaagagactgcccgtcactaacaacaccttccccttctctttgcagctcaactataaggactgtgagaaggcagtgaagaagtaccacatcgatggggctcgcttcttggtaagctctggctagtccaacacactgaaaccaagactgttcggcacttttccccatggctgcagggccaactggcctaccctttccctggggacacccgaggatccctttgctttttccagaaatttggtagggccccctctctcactacctttcaggatcctatcatccagaacccctctctgatcttccacttacaccttaaggaggaatccaagtatagtaaacaaataatctggaaaatctatttaaatgccatccatcctttgagaagcccaaggggaagaaggaccatatgggtgaacagaagcttctcacctccaatctctcactctggagcacatactcatgagtggaataaaggatggcatcaccctcattgtttcaattacttccttctttctcactaccaaattcataaagctgattttgcatcaagcacacatgtgatatggctgtctccactgtattatacttcaaaaagcttgaagtctaagaccaaggtgcaggtatgtattaaagactaagccattaaagggaaaaggatgcagctctaatggtggagacagaggtgctaggttgtggtcggggaggtggtttgagcattttccctgaaatgacacctttgcccatgggttaagaaagaccctgactgcaccaatccatcctttctgggaactttgctttactctttgaaaataagacttcaagggtctcatgggggtagatgttcctaatttaaattcagagtgaatagagtaagctaagttgtgtctccctgtaagacactgtcagtaagggaacttgaccatgagacttcaggccagttggatgagaccagagagatcacaagctccagcttgcccccagagaacaccaatccatttcttatattacatctctgctaccaacatcttcttgaattccttcagtgatggtgagctcaccaccacccacagtcatctgcccctttctaggcagctctcaagtcttgtgctgaaactaacctgtgctcctattggtctgagttttgcttccaggtgccatgtaagacatgtttattcactgtccacctaaatcattcattcattcgcctattcgttcacttgacaagcagtttcccgaactgcttttacatactggagagcattataggtggtggggatagagaaatggctaagatgtgatttctgccttctagaaacttgttttatagcagaaaggtatgttcagaaaggcttccaactacctcatttgcagatgaggaaacacatgcagagctgtgatgtgatttgttctatgtcacatacctactaattgaactaaggcatacacttaatttagtctgataccatttgactttttaacagtattatttatttgtattgagatttgagtcagtagaattcctggagctttagtgccattcttgcaaattactgctaaacccaaatatttcattctggtgctattagcactgagaacagagacttatcacagttgaatggaaagggaggaagacatctttgaggatggtgcctacgacgccctgttgcctgggtcaccctgagcaagtacttgccctctctgagcctgccttgcttcctaccctgttgactgagcacattggactgggtcatagtgggtgatggcccctcccggctctgtaattccccacaacagtcctggtgcgagtgtcaggcctggtagaacagggttgtttgagagatggtatctaggcagctatgtttcctctgctccaatcagtcctctatcagtccttcagacaatgtggcacattctgttcattgtatgaagaggaggaagtgcaaagtagggtgataggaaccagaagaaaagaagaagaatccagtgcctgtccctgcaactgggggatgtaaaggcagcttctgctgaaacccaccctccacccctagtgcactgggtacaatttgggacgcttgatctaagctctaattactaatctatcaccctttccagctctgtaatatccagggccactctgctattgaaggcaaaagtgaaaggccctagttatttttccttccttccttccttcctttcttccttccttccttccttccttcctgccttctttccttcctttcttccttcctcccttcccttgtcctcccctctccccttcccttgtcctcccctctccccttccctcttttcccttccctttccttccctgtcttctttcttctccctctctttcttttcttccttccttccctctctccatctctctttctttctctctttctttctctctttctttctctctttctttctttctttctttctttctttctttctttctttctttcttttctttctttctttcttctttctctctcttctttctttacttctttgccatttttgttttccactgaaaaggttagatccttatctggtagaagctatgcttctagaagttataaaaagaagagaaaaggagcttgagacttgtgtcagttgggaaggcatgtgaccccatgttgcagaaacctgaccacagtggcctaaccaaataaaggtcagtctgtttcaagtaataaatgtataggcgggtgccaggggatggtgaaagaagacatcaagaacccaggcttcatctaaccgatggaaaaagcctgtggcttctgtcctaacagttgtcagttggctactccacctttaggcatcatatctccatggcaggcagggagacggggagaaaggcaaagaggagaaggtgtatggtgaatggtaaatgcatgctcccttttttccaggaaagtagtaacttttccagaagctccatccagcagactttggttatatcttactgtccacaacagagtcatgtgacctccaccatctgcaagggagcctggagagttaaatattttgaacaagcacatttactgccctgaatgaaacccaggacctgtcagtaggaaaacaaagggagagtgggtattgggtaggcaagcagccatgtctgccacattgcctctcccaccagggcccagtttgtggctttcctctttctgtacccctcttctcaacacccacagcatataatcatactcccacaaagccataaatcttaactccaaaatcatcatgcaaataacccagagtttactggaggcttttggaaaaggtggaggagggggttacatcacatagcaaaactctccaaaaattctgtttcaacatctctcatctttcctcacagttcttgtccccgttctgaatgtcttcctctttcctgacaccctgctcctctgtgtctccagccaggctcatgtccacctcctcctccacaatcttcctgaaattccctcagcttacgccctcgtctcagcagagcagaagctggtggccagctgctcagtgctcagccgccacccctctggcagcccttaggaaggcttcaactcctcacaccacactcaaaacatgagtcttggtacctccctgagtgggagtagttcagaagcagggagatgctgctcagtgatgaaaaaaaaaaaagagaaagaaaagaaaagaaaagacaggaaaggaaaggaaaggaaagaaagaaagaaggaaagaaagaaagaaagagagagagagagaaagaaagaaagaaagaaagaaagaaagaaagaaagaaagaaagaaagaaagaaaaagaaagaaagaaagaaagaaagaaaaggagtagttaagaagcttaaccaaaagcccgatgccctcaggacttctggctgactcccttcaccagccccaccctgccgcaggtggtctgatcagcgtccagatcagaaaccatgcctgtgagctggatcagatggatccagtgaacacattgctaagatgccctagccccagcctctgtgccagctgatctcaaagaagagtgcccagatctttccagtggtcagaaaacctgacaggcagctcccagaacggaaaagaagcaaaaacactaaactctaagactcacccagacccctgctgcttccccaccaggggtagtaattcctcatcttactcctccatttctcagtcacacactgtgccaggcactgtgccaaaacacattacatacatcatctcactcagtcctcacaatcctgataggtgggtatcattattattattatggtccccattttacagataaggaaactgaggctcagagaggcaaagtgcatgccctaaatgacacagctgctaagtgaatgaaccaaaattcaaacccagcccatctgattccagagctcccaccctaactacccagccctctggccttaactagaatggtggtggagccctttgttggctcatcattggttctatggaaagcatgcccagtctcttttctgctcccaattctgacatgctctcctctcctcctcccttccagatgcctcctttcacctttccccccataatcctctccaacataggccacaggggccgtcaaaaggatcagacgtggtaggatggaggtttgcaggaagaaaatagactgtggatgtcacagagtggaattccagccccagctcatcccccacaagtggaaatccccttgatatccctgagcctcggctttctctctttcaaaatgggaatgctggtaactcctgcatcacagagttgatgtgaggattcactaaagcattaagaggtggaggcccagagttagttcttgacaaatatgagtttctttctcccctcccttctcagttccctcaagaaagccttttcatggcatccccatatcttgagaattctaccaacaaccctggtgaaagaggttctctgggatgtgatgttggtaaaagaggcacagactcctccaggctggcttctctgcagctgaccttgtggagactgagagggcctgaggtctggggtgtagggaagaggtcctaacatggccaaatgcagcccacacaacgagtcgtttggtttcacagatttagctctcacagtgtttaagtcaaaattatttgccaacatttggaactcagagcatttcacataaaacccagacttaaggattccctttgtaaaagcagatccagcaacagcaggcccacaggcttttaggcaaaacatctagaggctgcctacttggggagggtgggtgggcagggcggtttctcctctgtttgccacagtccccaccactccctatattgtttcacgtatcactcttcccctcctgctcagagccctttctgtgggttgtaacctgcctgccatatgtgtcttcatttcagaacctgacagaaaatgacatccagaagttccccaagctccgggtgccgtaagtactcctccaactctatgggtgatctgggagcagaggtgggaatggggagtagtgtgagtgggggctgggtcagttctatgtcattgtcggcttgaaataagaaagcaagtaggaaggatgagggcaagggcaggatgtggggaacagaagttacatgaagagctggaaaacagaagtcacagatccagcccagctggtgacctggatgctcttgccaaaaacaagcccaactctggccaatgttttcatttcctctcttctcatggggtgcttgggcctgtgaaaatagcatcagtgtcaaggtttcatcatggcatcaccactgactcagtgatggcttaagttttcttgacctccatttctcacacagtaaaatgagagccaaagcagatgacagcaatggatataattatgtgttgatactgagtgcttggaaatatctgacaggggtgttatgttgagaagaatcccgaggaaagggagctgtgattgatcattcatgtctgccataggtgctgaaaggggaagttgcagtatgcatgtcatgccatgtatttttcatccctctagtaaaggtctcacacactcaaatacctacaggagccaggcaggtgctataaatggtaaaattggtcaggttgaaaacacaaagccccgttgttttgttttgttttgttttatcatcattggacaaaacagtggtaaatattctgtatgaagaaatagttctccattataagaaaaataatagcacggttatcatatgatgaaaaaagtagccatcgcaaagcctcattgttggtgaagcaatagagaatggtggggattgtggcaaatcagatatcatatgttccattcaaagagtgcagcagctcctcagctccagctaatgtggacccaacaatgtcctatcttcaaatttatcaagaataactagaaatatgggtttcatgtgctatatctccatttttaaacattggctcaaatgtttcaagtattgtgaatgccacagtaaacacacctaagggctacatatagtctgtgtgttaccagtttgagttctcttctctggacattctataaggacccttctcttactctaagggtctcagagctcatcataataaaagggaagtaggccaaaggagtaggaggtggggagatctcatgaataggtaggaatgctggcagctcaattaaggagaatatttttagcatgactatagggtttcccttgtccggaagggggagggaaaagagaggaataaggatttgcctttggtgctgtctatctccagggacacgtattgttgaagatggcttgatctttctaaggatatcctctaaccacatgtggctacttcaatttgaattaaatttaaaattcattcccctgaggcactagccacattttaatagctacgtatagctggtgactactatgctggagagtgcagatatagaacatttctatgattgcagaaatgtgatgttgtagagataaaccatagttctttgcaaaagagggaactttccacacaggtgtcagaattggtggctggtgggctagtcccagactgcaggtatgttaaatttggtgaccactgtgctttgaaatcaggaaaactttcacaaaatccagcctctttagaaacaagtgaaagatgtggcaattgagggcttatattctactgtggcaatagtcagccggatctgatgtctgctgccctgtttagttgggatttgtgctccccagttcaccagggtcccaccattccctgagggatcgtcctaaggtacgtcaaccatttatatcatatcatgggaactttggctttcgaacaagattaagtaatagggatcagatttactttcccaactgaaataaccaaataaccaggcaaaatatatgaaagagcaattttcaagacattgagcatcagacaccgagggatggaaaacaaaggcggtgaagcctatggttgcttgctgctttgagaatctccaggccttggcacagggagcagggagcacagtgctgggtctggtggacgacttgagttgaggaggcagcggagagtccaggagcctagagttcattcaacgggtgtcagagaggagagagctgcatagagagagcattctggagagcttcagaggggcccctctttagcaaagcacagatcagtccatgcatgaaaggagagactacctgtaggtggcaaaagaactacccaacagtattggaggaaagagtagccactcacagggctggaaatggtgcttatttctaccagcctggctggaaaacatagtcattcggtagagtgcctagaaggatcttgccttagtggtggggaataattagccctaatctaaaaattgttcaggtcctggctagaaaaccttaaaagcaagacccaaaagaaacaaactgcttctaagtaacttaactgcatctcagaacaaaacttaaacctatttataggaatgcaaaaatattcactacccaacaaaataaaatttatgatattaggcatctaatcagagactaacaggcacacaaatgagcaggaaaatataacccacaacaaagagaaaaactaaaacatcaaaactgacccataactgacacagagattagaattagcagacaaggagaatgttgagtgtatttcatgtgttctagaagttaaatttgggcataagaaattcaaaaaaagacccaaacagaacttctagaaatgtaaactataaaatctgagattagaaatacactgcttgggattaacagcagattagatattgcaaaagaaaatagtagtagacatgaagatacagtaatagaaattgtccaaattgaaactcacagagaaaaaaaactaaaacaaaacactgaaaagagcatcaaggggccgggcacagtggctcacgcctgtaatcccagcactttgggaggctgaggtgggtggatcacctgagttcaggattttgagaccagcctggccaacatgacaaaaccccatctctactaaaaatacaaaaattcaccaggcttggtggcaggcgactgtagttccagctactgaagaggctgaggcaggagaatcacttgaacctgggaggtggaggctgcagtgagctgagatggcaccactgtactccagcctgggtgacagagcaagactccatctcaaaaaaaaaaaaaaagcatcaaggaactttgggacaatttcaaagaaccaaatatatatctaaagtccctaaaggagaggaaagaatgtgtatgtgagcggggaaggagagacagaaataaaacacttgaagacataatggctaaaaatttttcaaactggatgaaaattataaacccacagatccaagaggctcaacaaaccccaaatctaagaaacaggaagaaaactagctctgaggcacatcacaatcaaattgctcaaaaccaatgataaaaagaaaatcttaaaagcagtcagaaaaaaaaaaaaagacatattacatacagaggaacaaatgcaaggatcacaacagctttctcgaaagtaaaatagcaaaagaaaaatattgtcaacctagagttcaatactaggcaaaaatatctttcaaaaatgaagacgaaataaagactttttcagacacacaaaatctgaactgtactgccacaggtgctttttaaaagtccttcaagtggaaagggatgtgtacataggaatgaagggtgccagaaatggtaactacttaggtctgtgtatgtacgtggcccttgagggcatttgagtttgcatcttgtggtccctatacaagattaatatttcaataatactttattcatttaatgaactgctgttagataactacaatgtgtcaggcctttgttaaaattattcaggctgcaaagacatgggacagaatcctcatcctcaggacactcacattctaaagggaggtcagacagacaagcaaagcaattacactacaattacaacagtgcaatggtacatgcatgcacaagttcaagcgctcgtaggaaggcaggagtaattttccccacagtattcagggcagacaagggaggaagggaccctaagttaaatcttgaaataggagggatggattgtaggacattctagaaatgggaacatattacagaggcaccacccagtgtgcctggtggagcggcagtggggcagagcagctggggcatatacctgggggagtggaaagcaaagaggctgaagtgagtggttgttgtggggtgtgtccctcaatttataaaggtcccgtgagccattctcaggagccagagagtgttagtgaagtgagcatcaaggtaaatttgtgtcttatctctgtccagggcatgtaagtgatgatttggaggacagcccagctggggacatgggactgagttagttggtggtgaccaagatcctgccagtgagctaggagcctcccctagggctgtagctatgaagatggggggatggaagagatttaatcagaacagtggaaggacagagataaagaaggcactttcagcttggaagatcctttttcatcttaaggctaagctcaactgatgtcttctggcttttttgagagcctggagaaagtggtaggggtgggaaatggtttctggttagtgtgaacgggagaattatcaacacattgcgaatgggctggggtgggatctttctttagctctctggaaactaaaacaaaagcttggcctgcgatgtaatcccctcctccaatgtgtttgaatgtgcaccctagaaagactgtgaagcctgcccatagaacatgaagggttaatatggagaatgatggagaaaatatcaagggaaggtccaggctgccctgatgaggtgacttagagactcactgtccctcttggcagaaatgtataacaaggaccaattccagctctacttccaatgagttgtgtgacctgggacacatccctagaccaccctcagcttcctaaactataaaaggaaggaatgggttagagagactctacaagctcaccaattttaagtgctactatttggggtataaataggcagacaggagagcttagtgagaaaaagcgcaggctctgaggtcagatgcttgagacccaatccttccattcacaggctgtgagacttgagggcaagctagctcagctctccgagcctcagcttccttatctgtataatgctaataatgatagaacctacctcagagggttaatgggaaaattaggggaaataatgggaaaataacaatatgcactgaataagtgttggctattcttgctttatgtaaaatcccaattagaacaattttagctttttaactattctatctttctggagaggaggaattaaagaatagagaggacatagggttttggagtgagggagatccaggctctaaagctgactttgcctcccaccagctgtaggaccttggggaagtcatttaggcaatcagagcctcagcttccttgtctgtagaagggaaaagagctaacttttcaggagtggggaatattaaaggaggcagcacacagaaattgcctggtgctgtcctggatacttacaggcgttcaatactttattcattccatctcttgtacataagtttatttgtcttgttcattaccccaaaggcctttggaaaagaaattgtgttcatgtacagaaaaccaaaacaatattacactcttctgaatgtctctatttccttccctgacgtttacaatataagtattaaatagatttttaagaaggtaagttgtggtaaggaaggctctctcagcctgaaaatgcagtcactctctcaggacatggttgatcccaagacacctgcaacattgtaaaggtggaggatttttaaagaaaaaaaatgaaggctccctttatagggcctaggttggccctcatggtacagctgacaacggtctggttaaatcgatagaatacacgaatacacgttcaaatctgctggtgcctatttgaagttcattaaaggatgggatgttataagttttatatttaaatgcacagtgtaactttacggagaagagagtgacggggtgggtggtgcaggcagcaattaggtattggatgatgctctttctgctggttatccctgtagccattaccaatggtgcaattaggctgggaaaacctaagactcaagctgagaagtaatgcagaaatatttgtctgtcttcctgtaaggctgtgagtctaatggcagaaacaacgtactgaggcatctcctttgtacctatttctctacctgagacagagaagacaggaaaggtgtggaggaagggacgcagaggcgaaaggaacattctcatgcctgttaaagaatgtggccactcaaatgcctgtaatcccagcactttgggaggccaaggcgggcggatcacaaggtcaggagatcgagaccatcctggctaacacagtgaaacgctgtttctactaaaaatacaaaacaattagccgagtgtggtggcaggcacctgtagtcccagctactcgggaggctgaggcaggagaatggcgtgaacccgggaggcagaacttgcagtgagccaagatcgtggcactgcactccagcctgggggacagagcaagactccgtctcaaaaaaaaaagaaatatggccagaccccagcaaaaccaaaacagggcctctctccaacatggtcctcccctgtcccattcagtggctaattgccgtccagggacccagctcttgtcagtcctcaagggccctgccacaggaaaggtgcctcccttggctgtcccttcttctcttccagtgcaagcccacagcactcgacgtgaagcctcctctccccataaatgctggtcacgtgcctttagacagatgcctccctcagagccttgcctattattattattatttttatttttgagttggagtttcactcttgttgcccagactggagtgcagtggcgcaatcttggctcactgcaacctccgcctcctgggttcaagcgattctcctgcctcggcctcccgagtagctgggattacaggcatcaccatgcctggctaatttttgtattgttagcagagatggggttttgccatgttggccaggctggtctcgaactcctgacctcaagtgaaccacctgcctcagcctcccaaagtgctgggattacaggcatgagccaccacacctggccagccctgccttttttatttgtaaaaatgagaataattatacttgtctaccaggaaaatgatcgtgaggcaccaggaaaacactccatgtaaaactacaggggtaggggacatgggtgacaagtaaggagaacactgtgtcctcaaattattatgtcctactcttacactctcgaccgaggcctcaggtgatggtgaaaggctccttcctgagtcttaaaacatctggctgcccccggcttctcaggtgacaaggatagaatttagaaggtttggctcttggttcaagggggctggtctttaaagacggaaagaacactttgttccttggaaggaggattggaatgcagagcgagagcagggctgagagtgggaatgtgtgcagggaggaggggtggggaggagaaggagagttccagggtcccactgagagaacagcacagggggagaggcatctgccctacccaggagccgggagccttgtcccaggagggatcagcaggcagtctgaaatctgagcccagggaataaggctcccactgtgggagggctttggtcagaagttggccaaagctcttactatgtgagctgtggcaagaatgcgctctacatcataagccagtacacagctacacgtgccacagtagaggaaacaaagatggaattttcacaggacaatgcctattcctactgcatgctttgtgcactgatattttctattctataccccttccccttcccttcccttcccccctctctctctccctccttttccacctgcctggcagccttcttttcttgtatagtttctttcctcttgtgtcatcagcaaagttgatttctagacccactagtagggcttccttcactgttgttcaagtgtggggagaattaaagggctacatcagaggccagctaaggccccgcatacccccactctcctgtttcactcccttcataatcacaaagttccttctcctgcctttccttctcctccttttttaaaacaagcaaacaaacaaacaatttcatcagtgtcaagaatagcaggatttatttcacaagctttttggatgataataaaaatcacgtgggggccggttgatgtcactgagcctcaggcttctcctcagagagtccgttcaggtaggtctaggctgggcctggtgatcagtgtttgcaacaggtacagctaagtaatcatgatgatcaggcccatcagggattccctaatcaggtttaacccctgtattgtgctgataaggaatctggggccaagtgagggcagctgccttgtctgagatcacacagtgggcgccacccttggggccagacattgtagttagactgtctgtgcctgcaggccctgtaccttgtacattaccaggagagaccttagactgagaagatgaagactggcccccaccatgctgtaagttagggatgcagctgggctggaacctaggtcattgtagaatgctgccttcctacacgggcctggcttcctgtggggaggttcagcccatttccagggccagctagtcccttaaacaaaggcaagcagagaggactgctgtctatggctgcccagcccccatcacttcttgctctggtcctgagcgaggccaggggtttatggggtgaagggagaatgagtcacctccctccactcactgtcacttggtcctctgggggtagggtgtaatttgaaggtttgcacctagcaatagccatagcaaccacctccctgctatgcccaccatcactgttgcaccgtccaccagaccctggcagtggtcccacaggcttggaaggtgctttctgtagccccttaaagcaggaggaccctgggagcccacactttgctgcaagccaactgccaggacctgttctgcccccactcagctctttgctgctcctctgctgaggcctgcggtttgacatttccttcctcacccaattcgagccccggcagcctccagcctggctgctagagatactggtgagaggcaacaccgcagagagcaggaggttctttcaagatccaaagcagccttgtgagctggtcagagccctgtcaaactctgtaggaggagggcgttgaggtgagcctcagtcccacctcgctcaagtcattactgaaatgtcacctcttcagtgaggcctgatcattttaaatggcaaccgcatcccacccctgcactcccatcccccccagccccccacccctgcactcccatccccctcaccagccccccacccctgcactcccatccccccagccccccacccctgcactcccatcccccccgcccccaacccctgcactcccatccccctcgccagcccccacccctgcactcccatcccccccagcccccccctgcactcccatccccctccccagccccccactctgcatgtgcatggtgcatatgcagcacatttcacctccttaaagtttcctctccactagcagggatctttgttttgctcattgatgcaccttgagcacttctaagttcccagcacttagaaggccctcagtgcacattgttgaataaacaggtgacagaatgggagtggctgctgcagccagcaccacctgacacggccaggacacaggacactaacggggctcccttgccagctctgtaggagtccttttatcccacatgcccatcgtcttcttgaaacaaccacttaagggaaccaaaaagaaccatgtcacaagcattctgacggcatggtcaggaggcaactaggaagcccccgctgctgctcttaaagcctcgctctctctgcccagtcacaaaagcctggagttgtcaacaatattattacagagagtaaacctttccctccccttcctccttctctttcctcttaagtaccagtgtgtttatcaaaatttgtttatcccattgctctaatgaggtaggaggtttggataccatttctttcttttttttttttttttttttgagacgaagttttgctcctgtccccaggctggagtgcagtggcgtgatctcagctcactgcaacctctgactcccaggttcaagtggttctcctgcctcagcctcctgagtagctgggattacaggcgtgcaccatgcctgactaatttttgtagttttagtagagacggggtttcaccatgttggccaggctggtctcgaactcctgacctcagtgatctgctcacctcagcctcccaaagtgctaggattataggcgtgagccaccgcgcccagcctggagcccatatcttgggagaaatgagggagttgaggggcaggggaggtgatggaggaatcgagaaatggtggctgctaaggacttcctttgctaacttagcaagtttattttaggctaaacttgttacttcgagatggtcattaagcagaagaaatagagatcatgagccgttctcataggcaggccagggactcaacagtatctgcctccagagagcttgcagcagaaagggaactgacacaggggtgtgtgcgttgaaagggcactggcttggaaattagaaaggctagcttgtggtgctggtgtgagttgtgggaaaaggggtggcctttaccactaactactatgtggcttcaagctactccctttttttttttttttttttttttaagatggagtctccctctgtcaccaggctggagtgcagtggtgtgatctcggctcactgcaacctccacctcccaggttcaagtgattcttctgcctcagtctcccaagtagctgggaccacaggcacgtgccaccatgcccagcttttttttgtatttttagtagagacggggtttcaccatgttggccaggatggtctcgatctcttgacttcatgatccgccatctgccatctcctctgtaaaatgaaattggactgataatctgaggttccttccagttgccccaaatctcgaggaaacactaagcctattgactactaagggtctcgctggtctcatcagtgggtactaagtggggctgcagtctcgagttctggatatctgagagattggaatggatgcttgttgctagggcatgctggagatatggttctgtcggcaaagccctcctgccccagctcccccagctccatcctgggatttggggatttgctagttctgacatgaaggaacccagggactaagagtatcttcaagtgtcttggtcaaagctggcctcaagggcatgagtgattcagggagtctctcattctgcaacccctgcctttatagagaatacctccccaaacttttataagaatccgcatcaccaagtgggagtctgggaggggaagatggaaggagaaggcaggccacagaacagcccactagaggttgtgataagaaatctccaaggagcagctgattcctgtgggtctagatgatggtctgaagattcttaggaacaagacagcactgccaggtcatgcaaaagccaggggacctcagccccaggaatagtaagacaagaaaatacacagctatcgtatccagatcctaaggctcctgatttttggagggaaagccaggtgtgagctgacaagtctttaagggggagctctgagctggacttggaaggctcagccagacacagatcagcaaggaggagagagggcttcctgggcaggaggaaggtctggcccggggaataagatggcaagttctgggaggaagtgaagagcagagggtccctgcagaggtgacaaagaggagcctggccaaagttggccctggtgccccaagtttctatagaccaggggatatcaagggtcagggggaaggttgagactgagtgatggttttatctcttcatctgtctctttatcttgcaggattctcagtaagttaagtcaggaaatcaacaagaacgaagagaggaggagcatcttcacacgcaagtgagtgcggctggtgtaaggaaacgcaagatttttcagtcccgagttgaaccttaaaagggaggcacagaactgtttttgccctactttttgatctgcatttgtcccctgaatcccaggggtctggaagatggtgtccaacgaggggaaggggttccctcccctgctctgcatcctgtccctgggtctgggacatcaggggaacttcctctacagcatcagacagtcatgagcttccagtcatgccactgatgtggcttggtgatttccagaattttcagggtatcctagccccagttgctgagcagcaaggatacaaacctctcttgagcagtgagacatgccctccactggggactccctctcgctggaccaggttgaggaaagagggagatccccttaaatcgagaagaccattaatgcagtgctatttacctttgcagaccccaagtcccgcggtttcctgaagagacaggtaaagctctcagggctcagaggtgattgctttaggaggtgataggtatttcagttttcttgcctttctggttcctggggctccttgagttcattcaggtgaccttactgacttgtctgtcagccagttcttacccagaaaagggtttgggtctagatggaggggaggagatcttgctctgcaggccacctggcttatggcccctgttctgctgggaccatcttcagagacacactgaggagctctgggagctctgtagaggaaaacagagggaccccacctctgagtgagcacctgagcttagctagtccccctgcatctgagtttttttttttttttttttgagacagagtctcgctctgtcgcccaggctggagtgcagtggcacgatctcggctcactgcaagctctgcctcccgggttcacgccattctcctgcctcagcctcccgagtagctgggactacaggcacccgccaccatgcccagctactttttttgtatttttagtagagacggggtttcaccatgtcagccaggatggtctcgatctcctgacctcatgatctgcccgccttggcctcccaaagtgctaggattacagtaaagcagcttttcaactgttcagttgcacatagtgttgcaatgcagattcctggggcccagcctgtcccactgagtcagaagctgtaggcataggcccccaggtatctacaggtcttaaagcacttcctaagtcactgttacacacgagaaaggttgagaaccatcgccaccccctggttctctggtagaatgagcaccttgggcagggtcgctggagctgacagtaagtggctaaacctgcaggggtgtgggaggtaggtggaggccagggaaggggcattggtgagggaaggcatcagatggggaagctgctttgactttccctcaagtggtggcttttcttcagtgctgatggtggtgtcatctccttccacagaaagccacgaagaggacaatgggggctggtcgtcctttgtgagtatggtgtgggctgttcttgcacctttacagcagtgtccagggcagctttgtgataaggagccaggatggagccaagtgaagcggggctctaacatgatgccagcacacccacccagggcccagaaaaggtgctctgcacagggccagacaggaaatagttttggctttgggagccatgcactctctgtctcagctactcaactctgctactggagcacaaaagcagccacagacaatgagcaaacaaacaggcttggctttgcgcccataaaccttcatttgcaaacacagagggtaggctgcacgtggccctaggctgtactttgctgactgcacttcacccactgttaccaacccccacccactaccccccgtctccaaaaatggacactcctagaaatctactctcaagtagcttttctcatggacttaagtccccatcggtgacacggagggaaaagaacttcagaaccaactgttggccctgaaaagacctcaaagagggtgcaatccagttgatttttacattgaaaggtcacagttccccctctgagagtctgacggattgtacaacccctccccaggaacctgtatacacagtcaccacccatgaagcagtctcaggctaagaactctattatggaccgtagcccaatctgttcattttacagatgaggcaactgagtccacaggagagcagaacgtgacgtgcgtagaacacaaagttagttagaggcagacctaggacccaggtaaccagaccctcagtcacgtgggccttctggtaagaggccacctctagtgccttcagaaggcagaaacaaactgtcccttgacctattgggattctggtaaaagaaagtatttaatttgaaaaaaaacaaaaaaaagatttagctaagtttatgctttctacctgaaaatgaaggaatttgacagatttctttggtacaaagggaaaatagcccagagtttccgctggaatgtttctgtttactcacagaggcagaatccttgccatgcagcctctcttgtgctgtgcctgaggctagtcttcgatcctctctgtaaactgagggcttccattcactagtggctatagagcttggcagctccgttatgtgcccagctctttgcaagggcatactgggaaatgagtggagataaaggacccaatcataagcattttacagtatggataccccattttaaaaaggtaaactgaggcacaatgcaatttttttttttttttttaaggagtttatttgagcaaacagggattcatgaatcaggcagcaccaaaccagaaggaggctttgctgaagaaggatgagggacaagcatttataaagtgaatgtagatgtaatacaaagaaaatatttgaaccgggtgcggtggcttacacttgtaatcccaacactttgggaggccaaggcgggcagatcacaagatcaagagatcgagaccatcctggtcaacatggtgaaaccccatctctactaaaaaatacaaaaattagctgggcgtggtggtgcgtgcctgtagtcccagctacttgggcggctgaggcaggagaattgcttgaacccgggaggtggaggttgcagtaagccgagattgcaccattgcactactccagcctggtgacagagagagactccatctcaaaaaaaaaaaaaaaaaaaaaaaaaaaaagaaaatatttgatgggttacagttataaccgatctcatttagtctatcttgctggaaagctcctagttatataattatgagttggctggctacttctgattggttgggcttaagttctgtttttctttaatacaggcatttacaagaaatagcccaagttaacttttgcttatgctgcaaatcaagtaaggtttaggtcactgatgaggcccaactggttttgtctgctcagggattcttcaggcctggtctccattttaatttactttaacacacatatggcagaatataattagcaacaacatcatgcatacaaatttaggagccaaatgattgggagaaaataattgttctagaagcagagaggaaaattctgtcatttgagaaaggttgatggggtaaagagctggtgtaaagtcaggaatgatgggcctagggtagacagggtgaggaaagggtcagcagcctggagggaggccacgtgcctgcggacctccatgctgaggctcttgatctgaagcagcattcctctggggctctgcccacctgctcctaaagttataagaaccctgacagggcaggacaaagtctttttttggagttgggaaggcacccaatgctcactttgcccctctgttgttgatgtttttaatattcctcaagtcaaaaacaaacacaggactctctcaacagaacaacgtaaagacagtctgcctgaggccacccaaagctgtcaggatttctaggacactggaacatttctttcctcaaaaagtggccacttcccattgctttttcccacactgcccttgagtgttgaggtctgggctcattgactcaccccctggactttggcatgaccatgatgagcgctcatcactgctgctgatggtgccgcctttgcttgggaggtcattctgatgctcattcaccttcatggactgcttcaaaggcaagcatccagcacctcgggcttactttccctgagatccaagaagaagcaaaaataaaatacaataaaaaatctaaaatttagagattctttccaagagaacagcttcaaactcagtgtcagatttcatgaataatggatgtgttgatacactcaactttcagcaaaaagaacagcacagcctctgacggtcccctcctcgacacaacttaatctgccttccacttaacaggctttgtttatctgtttttccccttagccgggccttcaacgctgcaccaggttataatgagaggacattttttgagcacaggcacccttgaacagaaatggcaattaactagtatcatcacaaatgctccaggcctttagtctttctcatggtgatgcctggagcaaaaaatgtgtttactcaagacagagcctattccggtaccttctattccagcatccttcccctttcttctctctctgttgtgcagaaaggtgttgtgtaaaaaggtggtccgaagaccttcaccaaggtctcaagtccatgacttgctgcccctgtggtacagtgctccctgacctcagattcctcatctgtaaaatgggagtaaccatcttcaggctgcctggccccgggttatactgttgtgaggcttggcagggagagagtaggcacaggcacatcgagggccacagagcctctacaaactgcactgtccctatcactgtgtgggcaggaagaagacgattatgaaagtcccaatgatgaccaggatggggaggatgatggagactatgagtcccccaatgaggaggaagaggcacccgtggaagatgacgcggattatgagccgccaccctccaatgacgaggaagctctgcagaactccatcctgcctgccaagcctttccccaactccaactccatgtacatcggtaagggcccgtttctggattttctggcccgagcagcccaaaggcaagctcgccactgctgcatggaaggctgatgccccagcttgcccatgtagcagaaagctctgggtctcgatatctgctcggcttcttaacagctatgtggctttgtacaagtaactctgtctctctgggcctcaatttcctcatctgtgaaataggataataaatgtacagaccacataggtttcctgtgaggactactaagactgcaaccaattcttgcctatggtggctgatatcagcattgaactaccacctaaggctatttggcagtttcaactcattctgcagtttactcaggtactccaagagtactttcctgttcctccccatcttttgaccaaattatagttacatggcattattatgctagaataaacatgaagatattgagtagggtttgactataactttaaaaaatattagatggtgtttacgatttttattgtctatctgtccttttagcccacttctctctccattcattcaacaaacattgttgatctgctgggagcccaggccccattctcagtgcttagaaatgatcaggaaagaagacatagcccctgcctcctggggcttacattctagtagtggtgttgacagaaaataaacaaatatattcttaaataatatactttcagagagtacgctgaaaattgaaggtcagtaccacaaaaaacgaataccatttaatcctttatgcggtataacccatttccattttaaagccctttcacaaaatgctgtctcaatatctcatggtggtttttaaacatctgtgtaataaggacaaccatgatcaagtctgtttcatatacagggaagtggaggtccggaaaagcaatggatgagtcagttgttgagtgccttgtgtgtgccagtcattaagatacagagtgaataagacagccctcgccaagggactgacagtctgtcaggtgacgcaccctccaacaaatgagccatgaggttacttggtgaaaccgtgatacagaggcacgaagacaagcacagatgaggctggagcgtttgcctgagggtgtatctttaagctgtgatattaaaccaaggttaaaggataaatacaagttggccaagtggaaatggatgtggtaagggaagaacatttggagcagtagaaatggctgtgcaaaggccctgaggctcaaaggagcatggcctattagagaagctgagagatggccagtgcgggtggagcagggtggaattagatcaggctgggccttgctcctacccttttccctgtggaagagctgcacctccccaaggctgggactagagtcaggcaagagaggcacccagggcacaaagcgtaaggaggccctacccactcacccctcttgcttgatggtcttgtcctggcctttccctgtcaaaggggtaggaaattgccagcctgtcaacctggcctagggacacttccctggagatgtggataatgtgagtttctgcccagataatgtgagtttctgctcaaggcaaatctagcttccacttaagagtctgtggtctggtaacagaagttggtgatcagctcctccctttatgggaagagatgagcaaaatgaggaagtgtcagggaggagatagcccaggacactggagaggggaaggaagggcagacagaacaagatccctatggcagtgagagctgacttcaccctgcacaggcagctgggtgtgcctgtgagatttttggcatgtgtgtgtgtctgtgtgcactcgtgtctctgtgtatgcatgtgtgtgcatatatatgcatgtgtgtgcatatatatgcatgtgtgtgcatatatatgcatgtgtgtgcatgcatgtgtgcacatgtgtatatctgtgtgtctgcatacagaggtatgcgtatgtttacttcttacaaaattgtctgaaaatcctcccttccagttctggctgagctggttacaaagaggcctttcttgattggcaaaatctctgataaatacctattcctgtgaaatgcaaagaaagctgagcctgtgtataaggagagtgacacaaactaggacagaaaaaatgggcagggaggggtgggtgagatccaggctgggtctccccgtggctgggtctcatgtgggcctgggggtcaaggatcatgcacccccggtgccccgagctgcatatctgttcctggagacccctgagcttggccgatactcccctttcactttaataaccttgtgtttccacagaccggcccccctctgggaaaaccccccagcagcctcctgtgcccccccagagaccgatggccgccctcccgcccccaccagccggccggaatcactcggtaggcctcctcccgttcttttacagtacttggtgtccactgcagttatttcctccgccagagagaaaaataaaactataaacatctttatctcattctaattttgtaagaaaagattataatcttttccctcggctggggaaaggcaaacccaagcattcacacgtgtttcttttttggggtaaaatactggtggtttttatttacttcccactatttgagagaagtgaaaactgtaaaataaacccaaagagaaccgaattaagtccgtggcacctactggtgttgcctgggtaccgagccttcctctctcctgcaaaaagacttgcgccaccttctggccgacacctgaaattccaaggacaggagccttcagaccggaggagacagaggtagcaaaccccgttttctccttcttcgagcatacagcccggtccttgtgaatctgataagttcccagagtgaccctgagaagctcagactaaggacttgatagttaggaatgtgttcccttcacaagtttatctacagatgtatattgcttttgagatttgaagaccttcttttgagatgcaggattcacttatttaatcagcaaatattgtctgagcagctactatgtgccaagcagagttctaggcgttggggataaagtgtgaacaagataaataaggtccctgctttcataaaactcaactagggctagttatcagacggtagacagatgtctgaaagagatcatttgagtagttatgtgtggttcgggggacggaagaccaggtaacatgacggtatgggggggggaggtgacaaggacctgggacagaatgagccagttgtgggaagagccgggagaagaacgttctaggcagaaggaaacaagtgtagggatgccaaagagggcataaccttgagattttccaggaactgcaagaagattctatggtagggaccccatgagtactgagaagggatcacaggaaagagttgagagggcagacatgggccagctcaggcagggcctcgcaggacattaacgagtttcaattttgtttctaatgtgataggaggcttagcaggaaagtgacatgctcactctgctgcctgcagaaaagagcttgcgtggcagagtctagaacagggagctcagataggaggctactgcggtagttcagtgaagaaatggacatggatgtttgtaggcagaacatgaagatgaggaaaagtgagcagatccagacaggttttgggagtgccggctcttgctgatgtattggaagtgcttcctaacgtttggatctttatgcagccactgcccccaccccagaccaaccacgaagaacccagcagaagcagaaaccacaaaacggcaaagcgtgagtacaagggctgctctctcttgccctgttcccaccaggcactcccctagccccgcccaacccccagccgactgctttcttcttttaattgatgtcagccttttccccttccagtccctgctccttcaatagacagaagcacgaaacctcccctagatcgttcattagctccgtttgatagagaacccttcacactaggtgggtatgattcacatttaatgcatagtaataatgataagctgttataaagtgcttcctgcatacgtttcacatgtaccatctcatttaactatggccacaatactaggaagtggagactagtagaatcatcctcattttacagataaggaaacggagacacaaagaggtaccttcccaagatcacacagctaccaagtgttgggagtagcgaccaaagcccatatcagcctcattagaaagctcctgcttgcagcttctgggggctgtgctgcttctctatgtgatgtggatgatctgtgtatacaaatcccattgtccttcagccaagaggctttagggtacagagagaggacctgaattgagacaaaagggttgggggagctgttgtctgctgccttgcctgctacttaatagctcacagaccacagggatgttagtttttcagagctcagtctcctaatctgtaaggtggatgttctgtacatagaaaatgctttataaatccctaaggtgctattcaaatgtcagggatgtttttgttttaggtatgcaattgaccaaacattgggtataccacagtgctttttcttcacaatttacgcagaatattcttggattgcagttaccttcacgtgcagctattttcaattcaattcttagctaccatttattgagcaactgctatggggcaagtgctctacctaccacaaatacacctacagtatctctaatcctcacagcaactcaacaaaggaggtgcatttttaacctcacttctcagatgataaaattaagggtcaaagaagttgaataatttgcctaaatttgcctaaattcgaacacttgtctttctgacttctaagtgggggctcttttccaccatatcaggctgcagttgaggaccctgggttttaacttgctgtgaactacatgagtctgaggaaggaactctgcaactgaacggaaaggagcccagaatcccagctgcccccacccctttcttggctatgctctgagcaaggcatttagctttctgtggcctcaatccctttttgtctgtcaacaaaatgactttcagttcttggatatgaggctgctgctcgctgctctttccccgaactacatcacagctctgctgtgtcatgcaaagctgtgctggctggtttggcttggaattgtctgctgtagagagctgtataattacatggaaatgaagatagatttgacttcagattccaaccctgctcactaccatgagccgagacatcagaaaagtggaacactgacatcaaatccttcgcaatcacctcctgacacaaaagttattcttttaaaatattctttttttctatatttaaaagcatttttaaatgacacacttttctgacaatttctgttttacccttgaattagtccgttttctgtgatgttttggaaggattactgtcttcttaaaatgtttacaccccacctgagacttttaacatgctcagagaatatgcaaaaattggcaaattttgctgggcatggtggctcatgcctgtaatcccagcactttgggaggctgaggcgggcagatcacaacgtcaggagatggagaccatcctggctaacacggtgaaaccccgtctctattaaaaatacaaaaaattaaccaggcatggtggtgggcacctgcagtcccagctactcaagaggctgaggcaggagaatggcgtgaacctgggaggcagagcttgcagtgagctgagatcatgccactgcactccagcctgggcgacagagcgagactctgtctcaaaaaaaaaaaaaaaaaaaaaaaaaaaggcaaattttgaaatacttattcaggccaaagaatataaatttaagtttcctgggtgcccctctaaagtagaggttccaccccaaaccaaacttttataagcatcttttataccgtcaaaactctccccattaccagcaagctcctttttatttttatttttttatttttagttttttttgagtcagggtctcactctgtcacctaggctggagtgcagtgacagcatcatagctcgttacggcctcaaactcctcgggtcaagcaatccttcttctccagcctcccaaggggctgaggttacaggtgcatgtccccatgcctggctaatttttaaatatactgtagagactgggatttccctgtgttcaccaggctgatcttgaactcctggcctcaagtgattctcctgtcttggcctcccagcaggcatgagccaccacactcagtgtcagtaagctcttcacagtgaggcaatattcttatcatgggcctggcatgtacttggtccttaaagaataaatcacgttgtgaaaatacaactccagggagataatatcaccattcgccatagggcactaactgtgcctgggtgtggaaggaagggaaagaaaggcgagttaactaacaattgtcagcccacatggaccatatcaaagtcaaaataaaaacgtagaagaaaatctctaaatttgttttatttaggaagaaagaattgcaatttggggcaattggtcttcagggtcttcagtatgtctgaagaacaaaaagaagattggaggttttataaaaaggagaagtgttacaatatcgctccttgagaaagttcatcggttctgggggctggcaagttttgattggtgagcaatggcagagggcaaaattaatcttcgagttgcagcagattatttcagcaactactagatgaaactggtttcaggttacaacagccaacctcacatagaatcacatttctggagcaatgttatgtgtcctgagtgcttttccctctggcttctcgactctgttttccttggaggtgataaaattcccaatttgtatgaccaactttcacaatcaagtgcctgatcctgcatgcaaattgtcacccaattcttatggcaaacctatagagttttagtctataatcttcattttgagatgataacattgggattcaaaaaccttaaataacttgttcttggtcatgtgggatttgcttctagacctggttgaattttgttagtaatattttcatcacattgaagacaaagggcatatttattctaggggactttagatagaatacaaattaaattactttgaataactttgtgatgcacaattatcaagtacacctggcatttcttcagggagcctgaatatcatccgttctagaagaaaagcaaaacaaacaatactaactaaaaacaagcagacaaaaaagatttgcagcataccaggagagtctcctgaaatgctctccccaagtgaaaagtttcttcagaaactaagtggagtgcttcatttaatatcaagtgtttcacagaattggataaaagttaccctctccgtggcaagtggatttatttcagatataaaaataaaacttaggctgcagaagaaatactttggccaattaaagaggcataaaatcccaaggaaacattaatccttttgatcatcagttatataaaagaaaatgtgattttatttaaaaaaagcacagaatccacaacactacttgtatgtacacaaagctgtgtgaccttcaaattaaatggtcaagccatttaatttctctgagcttataaaatttggtggtctctaacggacccttcctagtctgaagtttctgattctttaatgcttaaaccccatcaacccccaagagggttcagactcatagtttcatcaaactgtgtttttaaacctcatgcttatgaagttctgaactcatggcccatctgctctctgtcatttacaggaaagaaaccaccattttctgacaaggtaagctgtgaacttgttttttggttgtgtttgtttgtttcacatcttgtccttattctttgaaaagtgcttggacactcatacatttttcctcctgtcttgcagccctcgattccagcgggaaggtaagactgttgcatctacatgagggtacatgggacgttctgtagaactctgcctcggcaaagtttgtttcttacacatccttttcctgaactccacaggtcactcggggagcatttacccaagattcaaaagcctcctttaccaccgaccacggaaagacatgaaaggagcagccccctgccagggaagaagccacctgtgccaaagtaattgtctggtgttgcttgagcttgtcactcagagtggccggcagacaggctgccctgtgctgactctgcagtgggaaccgaggctcctcggtgctcccgggcagggtgggccttttcttgctgtggcttgagggatgttcaggcttcacaggttggctatgaaggatcagggtctctttgaaggaaatggactctactgagaaatgagtagagtgacatctaatcaagagtaaggggtgactgctgtttttagagattccagtcaaatatttcattgagttttccaacctcgttatagcaaagccttcacagtgcataggaactgtactcaccattttatttttcaatacaggtagcagacaggaaatggttgggggaggtttttcaggtcaccgcaagtgtcttccttactgctcaaccacatttgataattgcagaatactgagctctgccttagtatttttaactttgctgtgaagtagttttcagcctatttaccaaatggcgcgcatgtacctggggttaaggccaaccttgctacttgcaaagaatacaaccaaagcttccatctcatttgtgaatcaggggtcataactatcacccttgcttggctgttgtgaggattaaattaggaccagggctaaagtgtgccaaaaaacctcctcagtaatggagtttgataacattttagagtaatgtttttaaaaaatcaaaataaatgcagcaaactcataaggaacaaaattccaaaattttaaataaacacagaatgagatgatgatgtgtgaagcgtctgacacacaggaggtgttcaacaaattgtccagctcttccccttctccccagagaggacattatacggcccaggcagtgcagatgcctgtcgcagccctaaggcagctgtccccaagtctgtttgactagctcattcatctgggcaaagtgtaccaagccccctttggaatagtcccaaagcagcaacattttctaattgtcttctctttacaccaaggtgggccctgagagggctgttttaaaacaagagcaagggagaatattacctaaaatgttttcatttcttgggaaaaacaacagctcagtaaaatttaatagctactaaagagttagtttgctgactaaaccacatgtgtgtgtgtgtgtgtgtgtatatacatatagtgtgtgtgtacatatacatatagagtgtgtatatatatatatatacacacacacacacacacataattatttgctgcattagttatgcagaacaaaggtttgcctagctcagcttgcaatgatggcagaacatggagtaaccagatctcccttccaccccctctcccctgctctgtgggggtctgttgcttcccatcttccctaggctcagtgggttcgatttctcattattcaatgaagcaaaactgtattctaaggctggctctttgaaactcttcatgctcagttctttttatttgccctaattcatttcaggcatggatggggaccagacagaagagagaatgtaagtacaaaatgtcagtttgtaagtgcttgatacagggaaaagaagcataggctcttaggaggttgggactccatccaccttggccttggcccagaacctggagcaggtcctgcacccaggggtctcgtctcttaagggctggtgcctctgtctttgggccttggtcattgtctggagcccatcatgctgtgttgtttagctcatgtccctctaagagctcccagagtggctggcttaattgcagctccattaccaggggccggtaattacagggcacaaggagaaaaagaggataaagtaagggaaggccagaagtttggaccatgcctaaatttccaaggctactgttttccttttcaatacttccacaacctgaaaaagaggggaaatagcatttcttgaatgcttaccatatgcacattgccatgccagttaaatatgaccagttgtccctgtttgcgagggatgctgtcagttttagcactgaaaagtcccctgtcccaagaactatctccatcctaggaaaaccaggatagttgagtatttctcgctttacatatgagtataatgaacccataaggaaacatcttttctcttttacggagaggaaattgaggctcagaaggaataagatactctttgcaaattgcatgcttataaagagccaggatctgaacccagatctgctgagtttctctacaccataagccctctgaaggccatcagacccctgctgtcattcaagggctcagcccaaaagcgcctgctatttttgcagctctgtgctagatgctgtgcttgttccgatgaagtgctgagatcttatggaggcaggcacactcacaacccctcatgccagacagcatgcaatcacgggatgctctgtggggctgagggaagaaagtgtgccatgtggctcaaggagccagcagtgacttcctagaggaggtgagatttatgctggtcattcaatgatagggaggacacagaatagagtcattcttaaagaaagcccatggggattcccctcaggagtgtcctgagcaggtggataccagtgcccacggaggctgcagggacagtgagaacagtggcttggctgcagagataggaacaaggcagaggtaaggctggacagtgaggataacatcacattccaggttccctgtctctggaaggattgacacttgtgctcatgagaatctgggagttgtgttttctggaaccagagggaatatacttgcaaaagtattgaaaagtgattttgttgtgtggggtttatgagcccatgtgtgtttatttatgcagctctttgctgggactcccagttggccaactgggatgaatgattttgactgtggcctttttcgccttctctcagtgtgtgataggattgatgatggcaaacttttattaaagagcacttaacataagccagacacaagtagtagctaatttaatccttctaacaacactttgagaaagatgctgtttcatcattacagatctggcctaaccaaacaagttcaagctggcccttttggtctactagttggtggcaacatcattttttctctttgaacctcatttcttatctgagtggaagagaaaatagcccctcccttgtctaatttcccaaggttgctctgaagataaaaatggtgagggttgtagatgaaccttgtaagccaccgtataaatatggtcttattgatcttaagaagagtggccattgcaaaagagagccaaaaagaagactgagctttggtcagacatatttggggttgaatccatctctgcaactcctggcaagctaaggaagcttcctcagcatcatgcttttgtaaaatgaggatgttaaatttttggggggtcactaggggaactgaatgaaatcttgtgtatgaatcttttggacacattgtagatattgtcaatattattacatctttgggcccttttaggcacctcagaatctatttcatgctgagtatatgaggagagtctcatactggaatgcccttagatgactgtttgtattaagaaattgtaaaacacttagcaacttctattattctccacagtatatttattatgaaggtgtataactgccagagaaagaaacagatacctatttgatttatttgattgagaaatgcagtttttattttaagaattgtattttgatgatagcttaatatctttttttttcttccccttcccaggatgaagatgatggtatgttcggaaacacattcttacagcctataactcattctttcattttcctgctcaggcattcaagtggaattgtttagtacaggaaccccatagaatcaattataagtcttaaattagtattaagtagacttatgtcaattggcatactgcataactatcgtaaaatggattacttggttagattaccgaagaagactaaattcatgtgtaacagtgcagattatttaattgtatcacaaaatgtaaaattgcatgcatggtttgatggaaacatttctcacatttatgtcttctaacacacgtgggtaaagaatcagtaactgccaatgaatgagatagcataaaattttgactttcataaaacaaaacttgtaaatcatttctgaaatttataaggtttccagctgacaattttctgccaagttaacatttcaaaaatgaaaaacaaaatcaatgtgtattttagagtatcatctagatctgcgcccctttgtaaatggattctatggtggttaagtcatctagaaacaccctgggagcaaggttccatcctactacttcctaattacatctgatctgctttatttttgtgtcctctttatactagctgtttctaactggggggcggttatggaatgtttcttagtgacagctggggcctgccaatctcattcattgttttctacttctgcacagtgcatcagagacctttgccccagccagcactacttcctatgagctccaacactttcccttcaagatctactaagccaagtcccatgaaccctctcccatcctctcacatgcctggagcattctcagaaaggtttgtagctctgtcatgaaattctagcttaatataatgtttaggtccatccagtactgaagtaatgccaggcagattgagaaagaaggaaatgacgggtagatagtagggtctgaacattttgggtcttaagacataaaaccaaactgagcattaagaacgatatgttaatccaccagtgtcctctgagtctctgcttgaggtgagaggggtgaggaattgacttcctccttgatccctccagatagaatgggccttttggtagaaaacaaagaatattttcactttatgagttcaaacaaacaacaataattaagaaacccagttagtctaagtacttgaagttcatctgcatcttagttggggagactgagaaaatgcgcctcgtgcttggctgatgctaggaattcattgcagtctctgtccccctgttttctcagtagcagctgtgtttctcagggctggtatgaggccgcccaggggcagatgcatgaacaggagaaaggcccagtcattgtccccaaacaagcccacgggcagcctgtggtgtcccccaagtcctccagccctgtaggcttaccttctcccttaatattcaaggagagaagccaagatccttccctaatattgtagaaaactcaaccacccacaagactcatctacccccaccaactcctagcaggattctcacaatgtttcctctgccctgggaccctctggccctgagtttctgctgctcttctccctcttcccgctggcatctgctgcccttgtctgctgaccctcctgctgctttcctccatgctagccccaaccccatccttcatttgcacaaaatcccactcacacaaggttgctgtgcagagcagacttttcccaaaggtttagactgatgggtgcaggagttgctgctcagtgtggagggaacagactgcatttcagggccctctgggcccgcctccccaccccagccctgcaaatgctatcaccgtctgctgcagagcccacctaacatgcacttcccttctcacctggcttactctctccttgcagaccctaagccctggggattcactgctcaccaaagacaagcccattaatataatttcctagcaaaagggaagtcttctgagaagaggacttctgtattctcccaactcaaagagctcaagttgcagccaatttttaaagtaactgttaagtgccctttacacagttgaatgttgttgctgttctgctttataaagcttgttagactttggcatggtccacagcggaatgtagttccattccctgtgtgctgtgttctgtccctgtgcccagcccccatggttttgggggcagcagggaaagtgataccaaatcaagaagcatttgcagcctggcttccctaacccagctcccctgtctggccccatcaccccaatccaaataaattttgttctttttctgtctcctcagtaacagcagttttccacagagtgcctccctgccaccatacttctctcaaggtttgtactctgggcttttgtgacgtgcttcagccatcaagcctttatgactggatccctaacctgtcccaaaagctttcgacaaaggttttattgtttcctaaaagcatctgatttcctcattcaacatttaattccgtgtctgcagtgtgccaagggctgtcggaatgataggatagtacctaaaacacaacacatacacacacacgtatacatatacatgcccatacacacatgcacatatacatgcacacacacacatgcatacacatgtacacatatatacatgtgcacacaggtatacacatatatacacatacacaatacatgcacacacatgcacatgcatacacacatacatacatggacacacctacacacacttcaccaggaagccagccctcatccccaatcttcctgtgcagaactattcctccagctccggtttccctacggaatcctcagaatcctgtttgcctttctctgcagttttagatttccatgatcaatctgtccatggttgtgagttggggagcatgttcaaaatacaaactaagagaacttaacgtcacagattctgattcagtaagtccggagtgaagtcagggacctgtgtttttaataataccacctctggacgtccatgattagtattcgcttagagtgttctgcaacttgaaagtgcatatagatcacctgggaattgtgttaacatgcagattctaattcaggaggtctggggtgaggcctgagtttctgaatttctaacatattccatgcgatgctgtgactgctggttcatgaaccactttgaaaggcactggggcaggactaatttgtgctttttatccttaaagacttgcaagtgacaggcacttggtaggcactttaaaaatgcttgtcgaatgagcatcaaatgactagggaaagttacccaactctagtaagtagcattccaggaaactggcttagcattgccagattttccaatttttttctcaagaaaagtgaaattatttaatttttaaatgttgacttaaatttttaaaaaatgctgtgaagaatgacaacagaaaagccactttttttgcagtcatgttccacatgcagtgtgtgcacgggccagtgtgtgttcagtagaaaactatgttagtaaatgtgagttgatagcctgagaatcaacattttttccaagaacacatctagggtattcagttggatgcatcattccatagaggggcgagatcccactgctgacgccagtggcacccactaagttttcaatgttttctaagcatttgaggttatggtggtgtccacgttcaccacatggttttcacagtttctcgcccaacccctaattttccacaatccccaaaattctctgtgttttgcaaacacacatttgtgttacctccttgcctctgtagccatctgagtcccagacacatcacagcattattttccaaagcaagttccacagatctccagttttatgagtctgtgatggggcttattaatgcaaatagttaattatttttggaacattagcttgatccaaattgatctcttttcccctaagactgccaggacacctggtcctcggtcttctctactggttctactggttgttccaacatcagaaggataaagtttgtgctgtgcattgcccaaaaacctgtcatgactcccttgagagtctagatattaagggtggtaggtgactgcaataaaaaagtgtatgtgcttctctgttgtaacttagaactctatgatgctggcctgcaggtgcagaggcagaaagagaatcatttcttaactgtagaatggccatgcaatgcgggccttggttctgttactctcctgtattgttaggtttcattcattcaacaagcattataaaagtgcaagtgttggactgcaaaaaaaatggggatggggaagatctgtctaggcactgggaacttggagaaggaaggcactggcagctcagggccagcttgtttagaaacagggaaggagcatcttaaacaatcctgttgatgtggctcaggagacttgtttaaaaacagggaaggaccatcataaataatcttgatgatgcggctcaggaggctttagcccttacaggtgactctcctctcctcagtggtgtaacaaggtagacgtagtgacaatccgtggtgtagaaccaccggaagtacttgctaacatgcagatttctgagccccaggtgctcgcaagtcgcccagggattctgactcatgcacagtagcatttggtaaccacaggtttaagttttggctttgccactgatagcgcatgatttgcttagcctctgagcctgtatttccccatatgcaaaatgaagacaatacctaccttgtaatgttgctgtgaggattaaaaaaaatgtacacacgataccttactcaagatctggacagagttgtgctgaataaatatttgttgaaggtatgaatgaatgatggttaaataattaagagaacatttgactcacagaatttttctgtttttaaccacagcctggcacatagaaaataccctgggcaactgcaataaacacaactaaacctttcctgagattaggaaacattctcctaaagtttcaaggaactgtaaatgagaaaaaagagttttagagaagatgaggcacaagcactgggtaattaatagttgcccagtaaaaacttcctgatctgtagtgccttctatgtgagttgaacagtctacctgtttagttagaacagcgggtagccaactttgattctaaaagctagcaatattctcaaggtaattttgtcttctcttgggtcacttacatttctttttgtggaaacattaagaacataattatcttcatcattgcattgtccctacatcagctgttgggaatccattctgcctatgatgatattataagaatctatgaaaaatttgtctcttgagcattcattttgacgttcacattcattaaaacaattgcgaatttttttataaagggatctagtcactttatattatgtaacatgcacatttagaaaaatcactcaaagttgaggttctcttctcaaagttttactggcatgattacagaataatgcctgagcagcccccatggtttcaaacagatgaaaattatttttgaagcccttgtttcttaaaatgcgaactataggaccaatcgcaagggtatttttttgggggagtggggggaatgtgttttgtgttttgatagcagcaaacaatagcttacagtaaattaactgtcagaattctatacttttgaaggccctagcaacagaccacctatcagagccgaaggcagaaacttccccttgccacttccaaacaaacctcggcccccatcccccgcggaggaagaggtaagagagcatgtttttatttttgtttgtttgccttttccctggtaaaagaatcaccagaaactcccattgaatgttcttctgtacttttatcttccctttgttttattttatttatttgaaaaaaaagttaaaggagaagatccagatgaacaatatgttcttttcccttggcgttctttcagacgctttcaatggcaaacatgtgttttgcattaaacagcaagaaaaataatcctgttttttatgtttatgaccttgattcgtcacttaactgctcaataacccatttttttaatcaagcaggttattatgctaaactgaagaaattattgtatctgtatctttcctgaagaggttccatactgtaaggaactcttattcacaggcatttttgcaaccagtgtcatgataaaaagcagttcgcacaaaatatcttctatttagccccagctaaatgactctgaatgcaaattaagaaaacaaatgtttcagacctcctggaattgaggtgttgatttatggaaatgattactcagaggcttttcttttcacttacatctgtaactgtaaaatttattcagtttctaaaaatttacattttcagaattcattaaatgaagagtggtacgtttcttatattacccgaccagaggcagaagctgctcttagaaagataaaccaggtattgtgctatagtttattttaacatagttgtaaatattaatggcagagaagggaactgacctgtcctgagtaccaattacaagctaggaattctgctaggtgctgttgctttctgtaatacctaggagacccattagtgccagcttcacaactaccagcacccatagcagggattcctaggctcgggaatcattaggctggcagaagaatctcaaggcagtcatttggttggcagcatcttaggagattttattaatgaaagagtctgtcttgtcataggaatcacatggtgtcagaaggagactctctttcaaagttccaacatcgtaccagttctatcttcctcttaacacagacgtgccatccatgttgatgtgaaaggaccaatattaaagagacggcagcaactttttgctttttgccctagacgtttctagctagtcctttaatatcataaagtcttaaacatatttcccgtagccagtgccgaaactttaccttagatttatttatcagaaatgggaaagcaaaaatctttcatctttcacacttaaactccacaccagtagttctcagtagtagttgcacatttagatcacccggagaacttttgaaaaatcccgattcctgggtctcaccttgagattctaattattctgggggtgctgtgtcagctctgggagtcttcaaacttcccaggtaattctaatttgaagccaagactgtgaatcactggtccagaagtatgtttgtttagcagagatgttctgacaggctcaattaacttgcaataaaaggaacaaaggaaagtcattattgccaactcatggctatttaaagctatcctgatttggtatgaggagaagggagtagtttaaaggagtccttaccaattaattctattttaatattagatctttacagtattaatattatgtagcaataatttattgaatggaaatttaaagtacaggacaatcaaaacagtagtttagcaaatatcagaaaaaagaaaagaaaagagaacatctgcattcaattttgctcaagggtctgatgaaggaaagactatctagagatcacagggttttaagaagggtgaatttcatggcatgtggatgttttctgactttggatgtggaaaagaaagtttagggaattaactcacaggaatactaggaagatatatcttgagttaaccaataaagtattttatttctcctggccttttatccactcaaccacccattatttattactgaacaaaagattccgtttttatcaggaggctttaacgagattgacttggaaatttctttgatacaatctctgttgcctttcttaataacaaaataactcatgacacatgggatatgtagctgtttggagaactgaatgttcgttgaatgacaggttttgcactcaagaagctgcaaagtgcaactgacatgtttgtcagatccctagaggcttgtctactactcttacaagcaacaaaaatattgacttttactgctcccataataacaggaatttgtctttttaggatggcacatttctggtcagagacagctctaaaaaaacaacaaccaatccatatgtcctcatggtgttgtacaaagataaagtttacaacatccagatccgttatcagaaggaaagtcaagtttacttgttgggaactggactccgagggaaagaggtaaggatttcaaatttcgacattttcccaaagtctttatttatgccactctgcatgccttcatggagcgatctttgagagtccgtgctgtatggcaaatttaggattaaatcacatgagtgaagcccttcatttattggaagagaaataaagcaaaatctttacaatggttacttctgccataggattctttcttgtatatcttttctttcaaataatcacatgtataattttcaaaatcaagaaaaactatgttaacttaaaaaaatctatttagatggtgtcaaaggaaagttcccactattattcacctctgtggcataattttaacgtaggctgcattttaagttgacaccacctggaaaaggggaaaaattagaatatttgctggggtgattattcaaatacttggctcatttcttaacaaaatggaggtttggctctgtgaggatggccagatcgccaaagaaattctctgttaggccaaggtttagattctcatgccagtcactttttgagtgctaatcagaacggatggaaagaaaccctcagggctagtttttcgcaaaggaaactaacaactgaaggtaacgccccaaacatactctaagttcaaagttccaagaggaggaccagctgaatcaaacatgtccagaatgagaaacagcttacccataacttctgcttcacatacttctgttatgataatgttaatgaatagaaaaaaaatgcatgcttgtgatcaaatgtttgaatcgctggttggcagtggatagagctgcacagaccctataggagcagaggtatttgcccttcaagatttatcttggtccagtgtggaaacacacaagtgcagaccaaccactcattgcagctcccatggagggaggcacctagcagattagtcttaaaggaagtgcattatcctgttagggttcctaggtgagttgtgacccacatctagaaaaatgagttaggcttttccctctctagcaagcaatcaaggctggggcgatccaggctatggctgcaaatattggttgctgagcctttatgagtgtgaaggtggcagtgaggacacagcagagagatcatgaaggaactcctgtgccatgctgcagatcccacctctagacaccatgaaccgtgtctgacctcctgagtccttatgtttcctaacactattaatgactgggggtgaaatagagatgcagaaaccaaaaccaaaaccaaaaacagagcaacccgaggcaagaatattgtaatagtgactatttaaatgaccccttcatatgaagttaaaaatatatgcatttcaaattacatatatatatatatagatatgtagatatatatatatatatatacacacgcatgcacatattttatctatttttttttgagatggagtttccttcttgttacccaggctggagtgcggcaatggcgcaatctcggctcactgcaacctctgcctcccaggttcaagcaattctcctgcctcagcctcccaagcagctgggattacaggcgcacaccagcacgcccagctaatatttttctattttctagtagagacagggtttcaccatgttggtcaagctggtctcaaactcctgacctcaggtgatccaccggccttagcctcccaaagtgctgggattacaggggtgaattactgcacccggcccatattttatctttatctatggtttgttggatgtttatgaggaattttttcaaagttctatagcagaaatcattaaactaattgccacatttacattttttccccccacaatcctcatcacttgaagaggcagcatatattatgcagataaaaaaactgaaagtgaagttcctgcttttcattccaatgttgactcatctccctatcttgactctttcaggactttctgtctgtgtcagatattattgactacttcaggaaaatgccacttctgctcattgatgggaaaaaccgaggttccagataccagtgcacattaacgcatgctgcagggtacccatagcaagttatagccgagcaaatgaaccgtcctcctgcctctgttgccaacacgagatcaatcagccttggtcaatggacaaacacttaggactgaactgaacccctccccatgaacacaagggttttatcctttcctttaaaaacagtgtttgaaatgaagactgtcaactatcccataatttatttattcttcttcaatgtttgtaaagtgcatgagtcatgttcacacttgaagtctagtagtgcactgtaataattcattttttaaaagattatttaatgcccatttcaaaatacagtagtttacacagctacagaaacaatttggggcaagttttaaaacactgaaacagtaatagttattggtgtcacataaaactgatttgttttttacagccaaacctctgtcagtcagaggcattcattagttttatacatgtaatttgaaaatcactaaacctcgttttctcagcagcaataatttaagaggcttcaaaaatataatttcactcttatttagtattttttcctgggggcatttttacgtaatttttttatgaaaagacaaatgcatgttgagataacttctgggattaaaatagtcttttgctttacttttttggtttcctaaaacaactttattgacttttagtccatactgttatatttttgtcttaaagaaaatttaaactacaaataccaaaagaaaacattttaaatttagggatgagactttggtgtatcgtgggtctaggtttaatgaacacatctggggttaagttggcatttcttcacatctccacacccacaccaaccatcacagccccccaccaaccttctcccaaccccaaaagcattgtccagggatatagattttaccaaaggcttcctgggaagacgagggagcaacactttagattaaatgtgatcagactttcctattagatatggctcttctgtctcttgttatccccctgacagctctgccataaagtcccttctcctcatccttcccaaacaggctgtataagtgctttgaggtaattaaactctttcctccagtttacaaatatcacttaacaaaaaatataggcattcagccagattaaaaaactggtattcagccaaatagtgacaatcagttgttcttcaagtttttccctttgggaccttggttgttattgcacaacttttattagcaacaatttttggcgtctctgcttaatctacaagttttcgaaatggaaaagagtatcttgcagcttcattttcatgagctaataaaaggggtattggaaggaatctaagaagtcaccattttaaaactgatgatatgttaaaataaggagtatgcagaaggtagagacttttaactgatgataaaaatggtgtttcacaaaatctcatccttaacaaccagaagttctcagtttagggtccaaaacttgggagtttaaggctgaaaaccctgcattcatttacacgtctacacaacgggctattcagcaagtatttacttagtggctcttctgtgttaaacaagtgagctaggtacaaggtagtaaggatagcatacaccataggttctagtatcgagtaagctccacttgtcttgctttgccgtattctatctttacaattcaaaaatatctaaaatgaaggacctgatagatttcaaagcaactatttggtagcgaatcatgtttataaaacaaaccaaagctcattttaagtctattagtggaaagtgccatcaggattaagatgttctgttccatggctatgactgaaatcaatgttgggaagctaatgttttcatgactagcattctctctctgttcaagcaccgacaactccttttggctgggccttgcctcttttggccacagaccttctatatgaccccaggtgcatcagtcacagttgctcagaaccctgctcagtgataaacatcttactaaagctgggtcaatcagggtcactctctggaatgttaaacatgaagcctgagacaagatctctcttttatctggggtccccaaaggcaatgctgtacacttggagctgcctgctgccctgcaactactcccatttaccaattatctggaagaaccagtctacaatagaagacaacgaggccaacacacaaaaacacagtaaaagtatggacaaatt

SEQ ID NO: 12501 - DNA, 71815 bp, Human
gccagtgaaacaaactgtggacaggtaacctgggtgctattgaaactcagttggtctactccctgcccaggctttctctaccctccagaagtcccccttgagttcacaagtgatttctggaatgttctttgggtccatattaaaaatatatctcttggctatagcatttctatagaaagctattcccttccattacattttcaacttgtgtttctcagagtcgcctgaacttccctgggaggaacttgggggacttggctattccccagctccctgctggtgaagaccatgaggctggaggtaggaggaagtggaatgtgagagagaatgaggagggagaagagatagacctgggtgccttggtgtggaacggagggagagggaagacacccaggaggttttggttcccaggatgccagtgctttgttgcctgggaaaatacagtgttacatctttctgtaggaaggatggggaaagtccctgtcccctgtttgctagccatgaggcagcttgtcaggagagtctctggattcctgtcactttaattcaatacacaatcttgtgtttactataatgatttcctcagaaactacaaaactgagtactgaaaagagttcccaggaattaacggaaatgggacagagccctcctccccagcactttgtgcacactcaggacatcgtgagccacctgccacacccagaagagaaaaatctgaccggcatccggtttgaattagagcaggaaggaagagaattgtgctcgcctttgtctttgcctttgcctttgcttacccaactgctgggaccagaggcagctgggttgaactttgtctttggtcaggggtgggggtggaggggacagaatccatttccctgggctccatcctctttctggtcatttggacatgtttcctgtgatctaaatctgatgtaaggaaatgacaattgtgaaagacccagcgtgagagaatctgatgggagggtgggtcatcagggaccagctggcctggctgatgatgtattaatatcttaatcacacagaggaccccaatctccttccaaacctaatgagcggaagtggttctcaaagctactcagccagctagcagctgccataacccagtcagctgtcctaactcttagtcctgtaatccctcctcctcatagaagattgtaaactggcagcccacagggcaaatctagtggccaggtgtgtttcatttggtctacatggcattttaagaactttttgatgctatcaacattttttaaaagtggcaaatttcacctaaatatctggatttttggcatgttttgaaaggttggaagacctgggaatggtaggcccatgttcctgcaggggagtgctcgtcttccaatgcggcgcacaagctccagcgtcctgcgctaaacctaattggcctggctgaggatctgctcctggaatgctggttggtcgcctccaactgtctttgacttagagattatttactgtcagcttactcatagtggcgcagagaagtggtttctctgagctagaagcttctaagaaaagtccatcctcaaagctgtttgtgggatagacctggctcctccattgtaatattcctgattccaaacactactggaaagagctctgaactggcagttagcaggcctgggctcccatcccggctctcctcctaatgagcgaagccatttcaatgtagtcgaacttagcctctgatccttaactttccctatctgtaaatgagggcgactagatgggtgcggactgtcatccgtgttgagacttccggcccccgcagaatcaaccttaccggcgggagcacctcgaggggacgccgctcgcactagggggcgccagggccgctgcagagcccgagccagagccagggggcggggccgcgtctcgggagcgaggcctgagagcggcggggcggggcgtcggcgggcagtcccctgtgccaggtgtggtttggtcctcccagggcgccgtaggcggtgcatcccgttcgcgcctggggctgtggtcttcccgcgcctgaggcggcggcggcaggagctgaggggagttgtagggaactgaggggagctgctgtgtcccccgcctcctcctccccatttccgcgctcccgggaccatgtccgcgctggcgggtaaggaagggctgctccgccctgtcccgctgttatctccgaagtccggttccatggcgcctgagggaaaccggctgtctctcgggggtttcgggctggttgggtcctcgtgggtccgagctcctcagaaaagctgggaggcggggtgggcacagcgctccccaggcatttggagggtgggactccgggaatggggaggcagggcatcctggagacagagggctccgaggggcaggcgggttgggaggcttcccgcgagttgaggtcccggggaggaagagattctgggtctgccaggaatccagctttttggagggacctggcggccgcagacccccaaattaaccctttttaaggaagttgaaaagcatggggttctcttatagtggaagctctgtggaatttgaggagtacaggatcctctagggttcaggacaattaggagagttaccccgggttctgggttttctgagggaaatggaggatgtgacttccctgccaagacccaaggcttctcgcgggcatcttggtgtctgggagtcccccggggctgggagctctttgcagaaaataagggagtatggagccccttgaggtttaggacaggactaagggtaaggagagatcggaccattctttttggggcccaaagatctctgctacaggtggcgaaagtaggccacctggggttctgagtcctcctgtggaagctcccttggcctctctagactaaagactagagggattcggccaaacacctcctggaaggaagagttgtctaagggtgaagggtagcttcagagttgggttagttgcacctgcagtcacctccccgccacctcacacaccaccctgcagcttcctgccttccccatcttttcccccagcagtaggaaccttctgtctcctatgtttcccagccacctgtgtgggtggcccaccctctgggtccaccagggtcagcgtccagaagctttggagaggcggcaagagggtattgaggtggaggggggctggctatctgccccctgcttcctggctttccgtctgtggacagtcacttccttcatcttgaatgcaaggactgggctaccagtgggtcacttcctcagcaagggagcatgggattttctcttcactggtgataacagacttctggagagagctaggggtggaaatgcctaaaacaaatttttttaggctgggcgtggtggctcatgcctgtaatcccagcactttgggagggcagggcaggaggatcgcttgagtccaggagtttgagaccagcttgggcaatatagcgagacttcatctcttaaaaacaaaaccttgtctcttaaaaaagattttttttaagcttacagagtccttcaactcgaatgatttccagtaactttttttttttttttcttagatggagtcttgctctgtcgcccaggctggggtgcagtggcacaatcttggctcattgcaacctctgcctcccgggttcaagcgattctcctacctcagcctcccgagtagctgggacaacaggggcccgccaccacgcccggctaatttttttggtatatttagtagagatggggtttcaccatattggccaggctggtcttgaactcctgaccttgtgatccgcccgcttcggcctcccaaagtgctgggattacaggcgtgagccaccgcacccggccgatttccagtaactttttctaacagctgtgtaatataggttgcctgtcttgaaccctgtttcttagaaaattgtgaaaggtttcacagtacaatagtctagaggcataaagcctctagatgcattagtttatgcattctttctttcattcaaagaatatttgttggattcttctgtgtcatatacttagccaaatgctgagtacagtggtgacatagttcttggctttgtggtgcttaataatcctagagatggacaataaataattgtaacaattgcaataaatgctataatagttaaggtaaacaattgagataagtgctgtaagagtgcaccaggggtgagggttttctctacttttttttctgttttggtagagacagggtctcactatgttgcccacggtggtttcaagccatcctcctgtctcaacctcccaaagtgctgggattacaggcatgaaccaccatgcccatcctctactttttttttttttgaagggaatacttttcttaaaaatgcaagtttatgctgacccctggagataagtaaaagttagcctggcaaaaaaagctcacagagcattccaggcagaggaaacagcataaaaaggccctagggtaggaaggcatgtagtgcctttgagccttggagctgggaggtcaatatggttttttgatttttttgtagggggtggggaggaagagtcttgctctgttgcccatgctggagtacagtggcgcgatccagactcactgtaccctccacctcccaggttcaagtgaatcttctgcctcagcttcctgagtagctgggactacaggcaagtgctaccacgcccagctaattttttgtatttttattagagacggggtcttaccatgttgcccaggctggtctcaaactcctgagctcaggcagtccacccgccttggactcccaaaatgctaggattataggcgtgagccaccatgcccagccaagtatggcttttttatagatgaggagacaggcccagaaatgacaaggttccatagctaaatgagcagtggtggtcagagttcatattttccaacttcaagtttagtgcttcctcctctctgtagcacaaaaagcagaatgaagttgactatggagtctgagaaggaagtgggacttaaactttcacttgttattccattcaaaccatgttctgagacacctcagattcctcgtgtaaccggagaatcgataacaaatcaaatatttactgagtgcctgtgatgtctgtggcactgggcaggaccaagttttacctcttataaattttaacaggtgttagagccaggagagagttttgagataatgtatagtctccttgttttacctatgaagaaactgaggctcagggaaaaaaaacggagttgtccagggtcactcaactagtggtagagccagaaccaaggtaggacttctgcagtgttctttccagtattccaggctgcttaagacgtacagggtctggcacatggtaagcccttaataagtatttgtggaaatgagttatatatagtttgtgcctctgagaaacttactgtctagttaaggtaattaaggcaaaaaacaaaactgccatgctgatcagtagtgggattgcgcctgtgaaaagccaccgcactccagcctgggctacatagcaagatccccatctcttaaaaaaaagaaaaaaattgataagacaagctgttataaggcttgcgtatgataacattatagaatttcaaagatgagggagaattctcttcaaacatttattccacaaatatatattgagttcctgctatgtgctaaactcttttggcccctagggatacagcaaggaacaagatagaccaaatcccttccctcatgtagtgtatgttctggtggggagagatagacagcaagtaaatgtatgaacatcatattcagggataaatccattgaagagaagtgaagtagggtaaggggatagaagaagtgagttgtcagggaatgtgtttggcatgtttaaagaatagcagggtatccagggtggccatcagttttggttagggaatacttcttgaagtgggtaagacttgagaaatcttaaataggcttaaagaaggtggggaagatgatatcttagtagggaagaaactttgggagtaggagacaaaagtaggcaagtttcaggtcttcataaagggtagcaaatacgtgtggtagaggcaaggattgggaggtggaagattcataggaagtggaaggtacagctgagaatgtgggtgcaaccggactagagggtttaatgccaggctgaggattttggaagtttctagtctacagtaggcaccgtaggtttagagaaaggaagactcatgatgtgggcacagggccaccaatctggaggtgggtatagtgggccctgagatgaggtcttagtggtagcaatgaagaaggcaccaaccaataaaagatgcctcctgacataggcaggccagggtgacttggatggtcctggatatgtgatggagcagggtagggtccaaaatgaccacaagatttcaaaactaaataaaaatccgtcatgatcaaggggctgtattaggctttccacattcatggtggattttctgcatcttctggaggctgagctgattcccagaacagggctgccttcttgttagtgtaaccttgagcgggtctgatagggcccaccatcacacacatctcatttcaatgagaggacctgaaactgtagcagtctcttacaagtctaccttctttctcatcctttatctatttttatatagtagaaagaattagactattttacctattaatttacattgaatagtaactagaacatgaaaccaatgcctggtttcattaaagtgttccttgaacattctttctgggattcttttttatcatgtctttctgcctgtaatttgttttgtccaggaaagaaagtctaaaatgtagttaaagacaggctttgagccaggtgcagtggctcacgcctgtaatcccagcactttgggaggctgaggtgggtggatcacaaggtcaggagttcaaaccagtctggccaagatggtgaaaccccatctctactaaaatacaaaaattagccgggcatgggggcaggtgcctgtaatcccagctactcgggaggctgaggcagagaattgcttgaacctgggaggcagaggttgcagtgagccgaggttgcaccaccgcactccagcctgggtgacagagcgagactccgtctcagaaaaaaaaaaaaagacaggctttggagactagacctgtggtctaatcccagctcaaacatttattagctgagtatttcagtttcctcttccgtaaaatgagaacaataatagttctttaagactagtcctgatctcatgggatctttgtattcagttagctcatacttgcgtagtgcttaggacattgtctggcataaagtagtttttttcctctatcattgacaactggcagagaactgctgtatgagaatatatcaattggttaaccagttctctgataaagatatttttataggccctccatagataagaaaatgcctactcattcacagttgagtgaacttctggttggaagttgcagtctgggtggcctgaaagacataagaaccatctgtctcatttgtcactgcagtgtattttgttaatgtactgagtttgccttgcctgtagcacctggtttgtccctctctgacatgttatttctgtgtatatccatgtccttcacaccccatgagtacacaccaagggccccagtaattcctggcctactctgtgccttgtacatgggcacatagaaaaaagtttgctgagtttgttttgaaaaccttcccttcagattttagaagtttctgtattcagcttaaccttttccccagccaacttcctagatacacacgcaggaaggaagagaagttagtcacaaatcggtccaactaagtgcctggcaccatgggagatattttcacatctattacattatttctattaatccacttggtaatcctgtaaagcaggtggtattatcctctttttaaagattaggagacaagctcagagaggtcaaataatttgcccaaggacacagaggcaaacagtgacagattcaggtttcaaacacacatacatttacccctcacaaatttttccaaataaaccaaagaagggaagaagagaataacagcaagaaggaaactttctgagatacctgtgtctgtgccttaacctgaaaaaggagaggcccttggtttggtgtcagtctctcagagctggaagaaatcacttgatccctccttttacaaaagaacaatccaaggtttagagaagctcgaaagctcttttaaaaatcatctaatctttttttttcctgagacactccttttggtaaaatttggtaagctagtgaggaagaaaaccctttgggttacagggagagtatctagaggcatgttaatccttactgttagtctttttgatagtcacttcattaaaatgtgatctttttctcttggcttttccccagcagctgctgccctgcccttctgctttctgctttgtcccagaacaagtgggatttatacacctgacccgccagttcccaaggggcccaggggttaccatacttgttttatgctgcactgaattggctgagttttgttcctggttctcgttgtctggtggaacgtgagaagcttcaaagatttttttaaatgaaaggataggatgttgatttaagctaggcattagagtctcatgagctctcagtgcttgaggatttctcaccattttgaagcctaaaaaggactcatttgcagaaaccaagctcttagaccaaatttaaggtgaacattgtggggactgcattggctctgagctgggataccaggccaacccttccactgaatagctgtgtgttcttgagcaagtctcaacttgtctgaggctgcatagggtattaaaaatatgactggcatggtagtctctgagcatgggtttgaatccctcctggaccatctttcagtagctttgtggtggttaggcaagtctattttccttcttttttttttggcgcctgccccagtggattcacatttgtttgagggccacattgctaattaagttgggagagagaagcattcataaagtgaatgtaaagtgaatgtattttataccaagattgaaaaggtcttaaaggtgagaacccctataatgagacatttgttgcagtgctcaccttacgttgcacagttgcacttattaaaagcaacaaattccaataataactgaaaacacagttttctgtttattaaacacctaataagggtcctttattgtttgaaggtactgtgaacatttacttaaatcaagctccttttctggactcttcttttttttattttattttatttttttgagacagagtctggctctgtcgcccaagctggagcgcagtggcacgatctcggctcactgcaagctccacctcccgggttcatgccattctcctgcttcagcctcccgagtagctgggactacaggcgcccatcaccatgcccggctaattttttgtattttttagtagagatagggtttcaccgtgttagccaggatggccttgatctcttgacctcgtgatccacccgcctcggcctcccaaagtgctgggattacaggcgtgagccaccacgcccggctcttttctggactcttaacaatcagtagccactgttgataagtctgcaaatatgagaggtaaacactatagagggagagaatgaacagcctggtacaatgagatattttcttaagaaagaacttcccaggctgactggactttggattgatcctccactaggcttcacagaaatccctaagactttgcattacagtattacatttcttttacatttcctagaataaaggtggtaagagaatagatcaatgaatttttaagactgtaagagagctaaagaagtcaagagtgttctcttgaagagggtctgggcgtaggaggctgtgtgctttgggtgaatatctttgctcaggtacttcctaacagaaaagcagtgtgaatgcataacaggtaaactgaggccaggtttatccacatgagactactcataggtaatctgggagccagaacagttattccagtggaatcatctgtgctgacctttggaacttatctttggaaattgcttttatagctggcagttggatccaaattttcagttgggttcaccacacaaaggaatgtctgttttgcaccaggcccaaggttaggccctggagataagaacataataaagatacagttcttacaccttagttctctgaatggggtgtgggggaggagagtggagagagagggactgaaggagagagaaacatatgcagtgaactgtaattaaataacaaattatgtaaaataggtatagacaaaatgaaacaaacactgcctgattttagggaactttaaagaaaggatagaaatttgattaaggggccgggagcagtggctcacgcctgtaatcccagcactttgggaggccgaggtgggcagaccacctgaggttgggagtttgagaccagcctgaccaacatggagaaactccgtctctactaaaaatacaaaattagccgggcgtcgtggcgcatgcccacaatcccagctatactcgggaggctgaggcaggagaatcacttgaacctgggaggcggaggttgtggtgagccgagattgtgccattgcactccagcctgggcaacaaaagcaaaactctgtttcaaaaaaaaaaattttttttttgattaagggaaaagatagagaagcttatacatagagaataactggaggtgtgaatgtcaggatgcaagtacatgaataaaagtggcaggaatagaaaataggtcaaaatgtaactagagcattcttttgtaaggaatggtgagagagaagggtcctttgggaccacattgtaaggaccatttgctctttcagtaactgtttattgaaggattgtagcagaccaggggccagacatggtttgctagccctttggaggtagcaaaagccaactttaatgatgtgtgagaagtttttgttcctgccccagggcctttgcacatgtcccccctctccagtgttagccttccttccccccttttttgccccgttaatttgtattcatcctttagagctcagcttggaaattacttcctcaaggaatactttggccgcccgcccttttcctagttatgaacttgatatcttcgtaccacttgccccaattataaataaataataataataattattattttttgagacagagtctcgctctgtcgcccaagctggaatgcagtggaatgatcttggctcactgcaacctccgcctaccaggttcaagcaattctcttgcctcagcctcctgagtagctgggactacaggcgcccaccaccatgcctggctaatttttgtatttgtagtagagacaaggtttcaccatattggccaggctggtctcgaactcctgaccttgtgatccacctgcctcagcctcccaaagtgctgggattacaggcgtgagccactgcgcccggccctcaataaataattatattattgtttaatatttgctttgtgtttaatctctctcttgtttgctcctctttccccaacacagtgtcagatgcatagttggcatgcaataaatatttgctgaaagaatgactgaagcgggtccattgaatttagcaataagcagttactgttactgttgaccttggtgagacagtttcagagaaatggtgggggtggaagccagattgcagtgcattatgcagaaagtgggaagtgaggaaatgagggcagcgatgtgtagacaactttttttcttttttctttttttttgagttggagtttcactcttgcccaggctggagtgcaatggcgagatctcagctcactgcaacctctgcctcccgggttcaagccattctcctgcctcagcctcctgagtagctgggattacaggcatgcaccaccatgcctggctaattttgtatttttggtagagatgtggtttctccatgttggtcatggctggtctcaaattcccgacctcaggtgatccacccgcctcagcctcccaaagtactgggattacaggcatgagccaccgtgcccagcctctttttttttttttttttttttttttttgagacagagtctcgctctgttgcccaggcgtgagtgcagtggcgagattactgcaacctccacctcctgggttcaagcgattctcctgcctcagcttcctgagtagctgggactacaggcgtgcaccaccatgcccagccaatttttgtagttttagtagaggtggggttttaccatgttggccaggctggtctcaaactcctgacctcaagtgatccacccaccttggcctcccaagacaactttttcatacatgtggctgtgaaggggagaaacaaggatggtagctagaggagaaaaggatccagtggtttggttttttttaaaattagattttaaaactaaattagattttaaaacttaacgagtttgcatgtcatccttgcgcaggggccatgctaaccttctgtgtctcagtccaattttaatgtatgtgctgctgaagcgagagtaccagaggtttttttgatggcagtgacttgaacttatttaaaagataaggaggagccagtgagggagaggggtgctgtaaagataactaaaagtgcacttcttctaagaagtaagatggaatgggatccagaacaggggtgtcataccgagtagcccagcctttgttccgtggacactggggagtctaacccagagctgagatagcttgcagtgtggatgagccagctgagtacagcagatagggaaaagaagccaaaaatctgaagtagggctggggtgaaggacagggaagggctagagagacatttggaaagtgaaaccaggtggatatgagaggagagagtagagggtcttgatttcgggtctttcatgcttaacccaaagcaggtactaaagtatgtgttgattgaatgtctttgggtttctcaagactggagaaagcagggcaagctctggagggtatggcaataacaagttatcttgaatatcctcatggtggaaagtcctgatcctgtttgaattttggaaatagaaatcattcagagccaagagattgaattgttgagtaagtgggtggtcaggttacagacttaattttgggttaaaaagtaaaaacaagaaacaaggtgtggctctaaaataatgagatgtgctgggggtggggcatggcagctcataaactgaccctgaaagctcttacatgtaagagttccaaaaatatttccaaaacttggaagattcatttggatgtttgtgttcattaaaatctctcactaattcattgtcttgtccactgtccgtaacccaacctgggattggtttgagtgagtctctcagactttctgccttggagtttgtgagagagatggcatactctgtgaccactgtcaccctaaaaccaaaaaggcccctcttgacaaggagtctgaggattttagacccaggaagaatgagtgatgggcatatatatatcctattactgaggcatgagaagagtggaatgggtgggttgaggtggtgttttaaggcctcttgccagcttgtttaactcttctctggggaacgagggggacaactgtgtacattggctgctccagaatgatgttgagcaatcttgaagtgccaggagctgtgctttgtctattcatggcccctgtgcctgtgaaacagggttcggtgactgtcactgtgcctgtggcagtctgtagttacccagagagaacaaagctgcatacacagagcgcacaagggagtcttgtaacaaccttgtcctgctttctagggctgagtcaggtaccacagcttgatctcagctgtcctctttatttcaagaagttgacatctgagccataccaggagtattgtattttgtttgaggcctctctttttggaggaacatggaccgactctgtgcttttgtctatgctggtctctgagctcacacaacccttcaccctcctttctcagccagtgataggtaagtcttccctatcttgcaaggctcagctcaagtgtcagcttcctctacaaagactttcctggttcccctcattggagtgaacaagagttgacatggtagaatggaaagagcagaagctttagaatgagccagacctgagtatgaatgctagatccaccacttagctagtcaaccctgccccctgcctcaagttttaattttcctatccattaagtgaatataataatacctgtgtcacaggattattttgagaattaaatgagattaggtctatgaaagcacctagcagagttcttggcatataggaggcattcattaaatatttgttcttccccttttatacccattacttttctttttctgaactaaaataatacttggttctatctctgaaataacatccaagtgaaaaatcaacaacatgaaagagcagttcttttccagtggatttgcttcttaaggagcagagattatgtaatctaacagcctccaacatacaaagagctttgtatctagaacaggggtccccagcccctggaccgccaactggtacgggtctgtagcctgttaggaaccaggctgcacagcaggaggtgagcggcgggccagtgagcattgctgcctgagctctgcctcctgtcagatcagtggtggcattagattctcataggagtgtgaaccctattgtgaactgcacatgcaagggatctgggttgcatgctccttatgagaatctcactaatggctgatgatctgagttggaacagtttgataccaaaaccatccccccgccccccaacccccagcctagggtccgtggaaaaattggcccctggtgccaaaaaggttgaggactgctgatctagaggaccaatttattcaatgttggttgagtaaatgagctcttggattaggtgatggaaaaatctgaaaaaacagggcttttgaggaataggaaaaggcagtaacatgtttaacccagagagaagtttctggctgttggctgggaatagtcataggaagggctgacactgaaaagaaggagattgtgttcgtttcttcttctcagagctataagcaaaggctgaaagttctagaaaaaggcaagttttgtttcagtagaaaaaaggataatcagaaccatttttagaaaatggaatgagactacttttgaggccatgagttccttgtccctggagagatgagcagaggttggacaagtgcttaccagagatcttgtggaggcagaaactgtgcatctagcagagcattggcctaaccctttcaaatgagatgctgttaactcagtcttattctacatggtaggaatcctgtccctttgcctcctgctactttgggcctctcaacctcttggttttgtgtgcaggtgaagatgtctggaggtgtccaggctgtggggaccacattgctccaagccagatatggtacaggactgtcaacgaaacctggcacggctcttgcttccggtaggtgggcctatcctcccatctttaccagtgtactatgggccaagcactatttcatgttctgatggaaaacacagaaacaagcttctgagttgagaatttcaatcttagggtggggaaaggaatgtaccaaggaagagctcatgaccaaacctcaagtgtggcccccctgaacccaggttaaattggaagagccataaatgggccagctggaggcagggtggggggatgagaggagccctttccagggttgtcccatatccctcactttatgggtgaggaaactgaggcccaggaagagtgactttcctgtggctgcactacagattatgcaggtacttcaagagttgtttgtattcttattttattttattttattttattttattttattttattttatgagagggattcttgctgttgcccaggctggagtgcagtggtgcaatctcggctcactgcaatctctgcctgctgggttcaagtgatttttctgccttagcttcctgagtagctgagatgacaggcacctgccaccatgcgcagctaatttttgtattttagtggagacgggggtttcaacatgttggtcaggctggtcttgaactcctgacctcaaatgatgcacccacctcgacctcccaaagtgctggaattacaggcgtgaaccactgtgcccagccaagagttgtttttagtgtggttggcagagccagctcttcctcaccacaggttgcctccctaggttcctactttttgttactagctttattatagctacattattattattattgttattattattgagacagagtctcgctctgtcgcccaggctggtgtacagtgatgtgatcttggctcactgcaacctctgccccccgagttcaagcaattctcctgcttcagcccccctagtaggtgggactccaggcacctgccaccacgcccagctaatttttgtatttttagtagaggcggggtttcaccttgttggccaggctggtctcaaactcctgacctcaggtgatccgcctgcctcggcctcccaaaatgttgggattacaggcatgagccaccgcgccctgcctatagctacattatttttgtaggcagctcagtttcttaaaaattatacagacttcaaatcagatttgttcctgctgtctgaggctcagtttcttcatctggaaaatggatggtaataatcttgttgagattgaatgaaataatatatgcagtgtatccagtacatggtagacacccagtgaatggttattccttcctcccatcggattggaattctcaagggtgggaacttgtctttatattcttcacaacgtaaaatagttgaaatttgttggtggaaagaagagcagtccactccagaggctggatgggcatgcctggcccccaaggtctgaagtggtagggctgtgcctatatcctgagaatgagatagactaggcaggcaccttgtgctgtagattccagctcctgcacatagctcttgttgtaaaacatccctgtgcttataccaagtaattgagttgacctttaaacacttgcctcttccctgggaaccatataggggattggcctggagacgtctggcctctggaagagttggaaagcaaccatcattattatcctttcctttcagctataactcagagctctcaagtcttttctgtggatcttattgccttggttcttgccccttttactcccagggaagttgattctgtcttttctgttccatttagtatgacaggagcagagaatgtcagagctgtaagggaccttatagttaaagcctttggctggtcctttcattttatagctgggactaataagtaacgtcaaaacccaatgagttcacagattgggtctcgccttggcatgtaacccatatgttcatattcttgctgttttcctatgtgtatgaatattttctatccaaaataagcaggacagggtagagcaagttaatctttggaatttctggattctcttagagctaaaaaacttcagaactagaagaaaccacccactatatggtataacccattcatatcacagatgaggcctgaaaccaaaaagacttgctcaggccatggatgacaagagctggccctagcactgaactcttgggtcatttgtaggtctagtcagatgctagcttgttagctctgtgcgtgcgtgtgtgtgtgtgtgtgtgtgtgtgtgtgagatagagacagaaagataacatatgtacacaaatacataaagaggaagtagacacgttagcatggtagataagagtacaggcaggccaggcgtggtggctcacgcctgtaatcccagcactttgggaggccaaggcaggtggatcacctgaggtcaggaattcgagaccagcctgaccaacatggtgaaaccccatctctactaaatacagaaaaaaattagcttggcatggtggcacatgcctgtaatcccagctacttgggaagctgaagcaggagaatcgcttgaatccgggaagcagaagttgcagtgagccgagattgtgccattacagtctagcctgggcaacaagagggaaactccatcgcaaaaaaacaaccaccaccaagagtacaggctatggaatgagactatggttttaaatcctggctttgcaatttattaactagccttaagtgacttccctgagcttcaggcaccaatctgtaaaatgaggataagaatattactcatgccacatggttgttagggaggattaaatgtgataacctatataaagtggctagcatagcatctgacatatagaaaactcttaatagggccggacgtggtggcttatgcctgtaatcctagcactctgggaggccgaggcagaaggatcgcttgagcccatgagcccaggagtttgagaccagcctggccaacatggcaaaactccacctctacaaaaaatacaaaaatattagccaggcgtgatggcacacacctgtagtcccagctacttgggaagctgaggagcgatgattacctgagcccagggatatcaaggctgtagtgagctgtgatcatgccactgtactccatccagctgggggacagagtgaaacccctgtctcaaaacaaaacaaatgaaaaaaaaaacccttaataatcagtaactgtcactttatattatgttgtgagtgtgtgtctatatacacctatatgtatacatttctcttattacacattcattggtgatctgatgtggagccccagggattaagggcaactttgaactaccctgacacaatcaagccaaatatcattcccgtggaggaagtagagtatctaggttctgtctcctagttgcagctttaccttgaggacagagactctaatccagctgtgctgaaggagcacatctcctgacttctgagctttcccctggtaaattcaaactggatgtcacggcgccctcagatagagcctggtaatttgccctggggagagtgactgtcttttggatctaatttgacttttgccccagttggaggaaaatcttcagggctaggaaggattgtatttgtctgaccccagagataacctgggttttgaggaacatggggcatcaacctgaatggtcttgtaagatctctcccacgccagcttgccagtgtttctctgatgaatttagagtacctgagtagtgcaggcctgctgggaggaggactctccctctgtgctactcagagaaattcattcttcaaggcccccttccagccttgctcttacccagctgggctacagttacaataaaggaaatgacttttcttctccccttcccccagtacctttgttttcctagtcacagggtggggctggatattgaatggagaaattgctggggtccatcctaaactcctcccctcatctctcccttacattaccccattcttctgtctgcagccacatccataatcctgcctctgttagccttccgacagaccctcaggtgcccaggacaacaggaagctacttaaagctggaacctcagactgtgcaatggaggccagtgacaaaactgaaagtagctctgtcagtaattgtgctggtgcgattaggcagctggccagaatcttttggatctcctggacatatggctgactagtcctcccaagccttcccaacaggcctcttttttttcctttttttcttttcttttttttctttctttctttctttcttttttttttttttttaggctagtgaagtgaaattgtgggagtggaaaaggaacaaagaaatcggtaactggtagtgatcaattacttgtaaacactattgtacttggaccagcccagtaggccttttttaaaactctgagttacctctctttcctttccttgagcagtgccattaattctgtatctggggcaatcctttctgatgttctctggacctggctctctctccttaggagaggccaggagagtagccagagagcatgtcatttgtagctgaggttaaagtgtggagctatcaatggtgacctggcctcttggcatgttagcaagccagaggaccttgacaacttttttgatgattgtccgttcaccctgatcaaaggtgtttggcttaggaggagggaagaaaagctacccctattagtcttgatggccccagcgtgggtctctattgcttgacctggttcctagcagcattatcagaaggaaaatccaccgctcttaaggctcctgggaactttcaggacttcctttctcaggattgcaaacataagactatttgagctttcacttttgaaaagcggttactaatacctatactctgggaaagggctaatgcagatagaagactgtggtcactgcatcaggcaacagaccatttccgctaaatttagtgactccaggaaggccagtgaagaaataacacacgtagcaaccagagactgtgttgtaatatgttggctgacagcagggtactttctgtgatgctgaaagccacattcattttctctcccctcatccccatctaagcaagcctggtagaatcataattacagtaataggtaccacttattgagtactctgtgccagacaccctcctgagcatacgacatgcatagcacatttaatccttacaatgacttaataaaatgtagtactagtcttacctacttcgagaatagggaaatggaggttacttgtttaaagtcacagagctaataggtagcatagctgagatttgaactcaggcattcttactccttgcctgcaagagtctcttggcattcttgaatgcaagcatatttcttaacctcactgaggctcagtttcctcttatataatatggggtaaagagccctcaccctgcctgccacacactggtagtgtcagataacattgaagggtgttagtttaaaggcttcatggactctataatgtcaacaaaagtgctgttaactttcttctgggtctcaggctcctgatgtagagtcagtggagcaaccctgccatctgctgttatgctgttgatgttgctgccacacttactaacctaaacctttgattctggctgtggccttctccagaaggtgtttactcatttgtccagtttatcttttaggaaacagccagcccgtagatcattaaggctggctattggacagggggctggggcctgcctgacagaggaaggaagggcagacatctggttcttcctctgcccctacaagagactccagcctgaccacagagtggtactcctaggatgtagcagcagcatatgagcttgaatgtgccttaatcctgctctttactttgagaagagagaactaaggacccacagatgtttcacagcttctataggaggcagaggtagaaaaatggagagagatgaggccagagatagataactgatattaattaaacgttgtattaagaacctcacttagattatctgattcaatcttcataataaccctgcaacccccacctttttttgagacagggtcttgctctgttgtccaggctacagtgcactggtacaatcatagttcactgcagtgtcaacctcctgagctcaagcaatcctcccacctcagccttgcaagcagcttggactacaggcgtgccaccacaccttgccatttttttttattttaagtagaaacaaggtcttattaatactatgttgcccaggctggtcttgaactccagcgatcctcctgccccagcctcccaaagtgcttgggattacggaagtaagccactgtgcctggccagtgcaacccccattttatactaaaacaggaaggcccagaaaggtttggagtaacttgtccagggtcacacagatgatatttgaactcaggtctccctggctcccaagagagtctgctttccactaggactcccaggagaaaaaaaaaaaaaaaacagtagacttggagacagaaaatctgatttgagtcttagttgagctaggctaactgtgtaactgtgggcaagttccttagcccctgtgagcctcagtttcttatctgtaaaatgtcataaaagaaatccatctcatggagtagttgtgatgatcaaggactctgaaaacattagaatggtttaatgtgaaggattagcagcagcacatggcaacattgtgcatcttatattaactatccaaatatatcaagcgtcatttgctatatataaaagtcatcaaattaggcactgtgggggatacggagttggcatactagcctggcctcttaattaattcattaattagcttatttatttttgagataggtcttgctctattgcccaggctggagtgcagtggcatgatgatagcttactatagcctcaatctcccaggcttaaacaatcctcctgagtagctgggactacaggcacacactaccatgcccagctaatttttttttaattttttgtagagacagggtcttgctctgttgcccaggctggtctcaaactcctgggctcgagatcctcccacctgggcctcacaaagtgttgggattacaggtatgagccacggcacctggcctggtctcttaactggttccctaagacagctggaaatagagaatgtcatggagcattcctaaccatgggctccagcctggctttcattctgtttctcccctgaaacaacattcctttagtaatattccgaataacagcttcatcagtctgtctaccgaccactcttcaggcttcatcttatatgacctcccaaactgcactaagggttgtattagagaaaagtggataaagttcggagtcaggctgcttgagcttaaatgccagcttcacttaccagccacctgaccatgagtcagctgcttaaccattctttgccacagtttccttgtctatgaaaagggaaatggctcccacctcaaaaagttgttaacattaaattcaatcatgtattcaaagtcctgagcagaatgtctggccatgactgggacttaacagatgttagcatttattattagtatctgtcagtcttgaaatgttctcttcccttggctttcatgacattccacactctcctggttttctcttacctctctggtaatacctgtttgcttatccttctttgtccagctctgggatgttaccattccttcaggcgtgctgttttctccttaggcagtcttacacacactcatgacttccttccattgtcctccacacactgatgaccctaaaatcagtatctccagcctaaacctttccactgagttctagacccatatgttgtactatcaacctggcttgtccatttgaatgtcttccaggcacttcagactctcttctctagactttgctggactttcactcttccccctaaaactggctcctcttccactgaaacatgtatgtcattgagaggcaccaccatccacccagtgcctaagccagaaacctaggaatccttgatacctgttctctctcatcctgcatatccaagcctatcagttttatctctaaattatattttggtaggtttacttctttccttttctcccaccaccaccctgctccaagctaccatcatctcacctggatgtctgcaatagcctcatctcccacagccactctgcaccccctaatctgttctctatagagcagttggaaggagtgatttttgttgtttgttttgttttgttttagacagagtctcactctgttccccaggctggagtgcagtggcacaatttcggctcactgcaacttctgcctcccgggtttaagcaattctcctgcctcagcctcccaagtagctgggattaaggcaccggcccccatacccagctaatttttatatttttagtagagatggggttttgccatgttggccaagctagtctcgaactcctgacctcaagtgatccacctgcctcggcctcccaaagtgctgggattacaggtgtgagccactgcacctggctggaaggagtgatcttaaaaaaaaaaaaaacaaaaaaaaacttgactgtgtcactctgtgttgtctctcctaccttgtatacttccacaacttcccagtgttcttggataaagaccaaaatccttaacttggccaggcgcggtggctcacacctatcatctcagcactttgggaggccgaggcaggcagatcatgaagtcaagagattgagaccatcctggccaacatggtgaaaccccatctctactaaaaatacaaaaattagctggtcgtggtggcgtgtgcctgtagtcccagctacttgggaggctgaggcaggagaatcacttgaacctgggaggcagaggttgcagtgagcccagatcacgccactgcactccagcctggtgacagagtaagactccatctcaaaaaaaaaaaaaaaaaaaaaaattccttaatttggcctacagtagagccctccgtaatgtggcctctctccacatctccacaacctcctgctccctgcacttcagcctcacctctcttctggacaggccctccttctgacaagggctttgttcattctgctccctctgcctagaatgcccccttactctgttcacttaactcctgcttatcgtttagatctttacctggatggctcagagaaatatagaagtaattcctcaccctgaaaaataggttaggtccctgttttatgttttcatagacctttcctttgaggctttttttaaaaaagtagttttaatctcacatttattcatgtgatcatctccttaatgatatcttaagacctctaatagaacaatttggtcatggactgtggggtttttgcccctcattgtgtcagcactgagcatattgttggcataggagggatatttgttgaatgaattgctagaggtggccaagagatatgatgtaagtcaggcttttccctgcccttccccttccccttccccacatccttcctatagcagccaccgtggctgcagttactgtaaatggcaagacggaatcagttccggacattgggttgttttagaaaattgcctgcaagtgtcagggtgataagttaaagctttgtcttttgccctcagaggagctatcccatagtgagtagaagccagagaagctgaccccaggagtccttctttccagcagcaggtcttgagctgcacttctctgtagctacaatccaggcaggaacaagccctaggtacctccggagaggagggcaagagaggaagaatgagttcagctactctagccaccaaactgattatgaattgccctgaaatctgaaaaatttcaattccaatcgtaagtttgttttgtttcattttgttttcttaaattgtatatttgaaagatggcattaactaaagatatatattcaatatagagtggaaaaaatggaatacttgcatagtatcttttacttataggtgatttatgatggggagtggggtggataggttggcagttcccccaagaagttggaaatgaagtttgtcctctgtgagttgaactaattagatccacaagtaatgaaagcagtattgtgttgtagttaagagcacactctagaaccagattgcttagtttcaaatcctggttctgccttttattatctgtgtactttgggcaagttacttgccctttgtgtgcttcatttttctcatctagaaaatggagaggccaggcgtagtggctcatgcctataatcccagcactttgggaggccgaggcgggcagatcacctgaggtgagaagttcaagaccagcctggccaacatggtgaaaccctgtctctacaaaaatacaaaaattagccaggcatgatggcgggtgcctgtaatcccagctacccaggagcctgaggcgggagaaacacttgaacctggaaggcagaggttgtagtgagccaggattgcaccactgcactccagcctgggtgacaagagctagactcagtctaaaaaaaaaaaaaaaaaacaaactggagatacaggctgggtgcagggcttacacttataatatcagcactttgggaggcctaggcgggaggattgcttgaactcaggagtttcaagatcagtctgggtaacagagcaagacctcatccccacaaaaaatcaaaaatttagccaggcatggtggctcatgcctgtggtcccagctactcaggaggctgaggcgagaggattgcttgagcccaggaggttgaggctgcagtgaaccatgactgcaccactacatgccagcctggatgacagagcaagaccctatctcaaaaaaaaaaaaaaaaagaaacgagccaggcgcgtttgctcacgccagtaatcccagcactttgggaggccaaggcaggtggatcacttgaggtcaggagatcgagactagcctggccaacatggtgaaaccccatctcaactgaaaatacaaaaattagccaggcatggtggcatgctcctgtagtcccagctactcacttggaggctgaggcacgagaatcgcttgaacccaggaggcggaggttgcagtgggccaacatcatgtcactgcactccagcctgggagacagagcgagactctgtctcaataaataaataaacataaaataaaataaaataaaataaaataaaataaaaaaatatggaggccagcaggcacggtggctcacgcatgtaatcccagcactttgggaggccgaggggggcggatcacaaggtcaggagatcgagaccatcctggctaacacagtgaaaccgcgtctctactaaaaatacacaaaattagccaggcatggtggcaggcacctgtagtccctgctactcaggaggctgaggcaggagaatggcgtgaacccgggaggcggagcttgcagtgagctgagatcgcgccactgcagtccagcctgggcgacagagcaagactctgtctcaaaaaaaaaaaaaaaaatggaggttgggcgcggtggctcgcgcctgtaatcccagcactttgggaggtcgaggcgggcggatcacctgaggtcaggagttccagaccagcctggccaacatggtgaaaccttgtctctactaaaattacaaaaattagccaggcacgatggcaggcacctgtaatcccagctacttaggagactaaggcaggagaatagcttgaacctgggagatggaggttgcagtgtgctgagatcgcgccactgccctccagtagagtgagattccgtctcaaaaaaaaaaaaaaagaagaaatggagatacaaacttactacctacctccttacaacctaccctcacagtattactgtgaataaaagtgtgtgtagcactgggaacactattcacagagcactcatgaatgtttgttctttgttattagttactagagaggcaaatgtctgccagggctgaataatatgtgtgaattggtgattgtcgcacatatctaaagaagtagttatttttttcaattaaaacttagtttaaaaaccaatataaggccgagcgcagtggctcacacctgtaatcccagcactttgggaggccgaggtgggcagatcatttgaggtcaggagttcgagactagcctggccaacatggtgaaaccctgtctctgctaaaaaaaaaaaaaagtacaaaaattagccaggcatgatggcaggtccctgtaatcccagctacttgggaggccgaggcaggagaattgcttgaacccaggaggtggaggttgtagtgagccgagtttgtgccactgcacttcagcctgggtgacagagggagacactgtctcaaaaaaaaaaaaaaaaaaccaaaaccaatataataaataagtggccagcaatgaaacagaaagtgaaaagttagtgaagcaaaactagtactgtattcagataaagatgctgaatctagatttggtcaccagaatagggtcctttgtggcaacctgggctagtttggctgactcaccactgccaggatgaaatttctttcagtggctactcatttccctttattttaagtccatgctcacagagcaaccttctgatgcctaattcagcttcctgggatacttaataacaggaagggtctggaagtagtacctgtataggggatatgagtgttctgattttaatagtcaattcataagtgtacagagggtttgataaatggttaggtcagaaccatcacagaatgtctacacctctttggacattaggaaggtcaaaaacctgaaaggccaaaagctaggcctagattagggtcattcaccaagaaaacatcagccttgaagagttctctgggtggtccaccagtcaaccttcctttgatcacacctccttcctcgttgcttctttaagcattgacctgtaatgggtatggaattttttgctcacctaactccttccttttacagaggaagaagttgaagcccagagagatttaatggcttgcctaagatcacacgcagattttctgttaaccagggtgatttttcaggtgttccctgccagacgagggcttttttccttgaattgcctagagatttcttgagatatccgaagcatttttcccagtgcagcctggagaaggatgtccctgtcaacacagcatttgttactcaatgttagacattcaattttctaattagtatcatggagcaacagtggatgattatctataaggggttgcaattccatgcttatgtgcttacagcccatatagacaaatatcagctgttaaaatgacaaggcagtagagatgtggccccaggacaaaggcatactctgctgttagtgaacactagttggccagcaaatttcacatgggcatatacacggccaactgtagactttaggcatttatacccattcagagagccaaactggcaactaaagatcagcattctctttggcatttcagctttgcgttctgttaaaaatcactgcttgcttaaatacctctgatagctcttcactgcctgtaggcaactctttagcctagcagacttggtctttagtgctctgcccctactctcttccaccattctggcctcctgtctaattgctgcccatatgtgccatgcactagagcttacagacctgctcagcgttatatgagcataccatactctttatgcctcagtgcatttgcacatgttgttccttcaggccagaatgcctgttactgcctggcaatcagcctattagagtctgccaataccatcccatcttctgtggaggagccccccgccaaatccacccatacctctccccaccaatcagagacttcttctctctttgttattctcttcgttattctcttcatacctcagttatatccatttcagtatttgtttacacatctagcatcactcttagagtgtgaaattctccaagtgtggagccgtatctagtttgtctttgtatcccagagcttagcaaagtgcctagaatgtagtgggtgctcagagtgtttgctgggtgaatgatgtatttgttgaacgactctttggacacttgaataaagtccatccagtatgcaccattaccatctcttcgctctacaatattcttttaggcaagagcttatcttttgaggtgataagataagctcaaacttatgtagactaagacctcagtctgtaaatgtcatccctaagtcttaaaccatcaaaaccagggcctcaaggaatggcatgccttctgcaactgtagcaacctgctgtgcttattttgccgtgtttttcatttttcccccaaaagctagagtcccttctcccatgggcagtgctggaagtgtgctaacaaattctttctccatactgcttacgattacaaaaaaaaccctcagcatctcatgccagacttgagttaaggttgttttcttttgtgtgtcagctgtattctggtcatgacttcctgatgatgccctatagagattttgctgagatcagagggtgctccactgccatcagtagcactgactcttgcagaagcaccgtttctgaagttggctaatgtcatccctcacgtttgtttgtttgaaatttgttttagttccagagatagcactttcatggaatgacgctatcttctagaatcactttttttttttttttgagttggagtctcgctgtgtcgccaggctggagtgcagtggcacaatctcagctcactgcaatctccaccttccgggttcaagtgattcccctgcctcagcctcccgaggagctgttactacaggcgcacacccccactcctggctaattttatgtgttttagtagagacggggtttcaccgtgttggccaggatggtctcgatctcctgactttgtgatctgcctgcttcagcctcccaaagtgctgggattacaggtgtgagtcaccgcgcctggcctagaatcacctttttataccataacgtgagcaccactgccgcgtcaccaaggaaagagagaggcagctactgtggggttacaaatgggtaagagtggcaccaggaaggtgaaagtctctacttagccaaggcttaacaaaatgtcaatcaccaaacatttatttattaagctacgttcaggataagaagatgaacaagctatctgtacattcattttctcgtttgtaacaaggtaatgatagtgatctatcctgcctgcctctgagggttattgtgagaataaaatgaaatcaagtggaaaagcacttaggaaaaagaaaagcattggttttcaattgttagtgtggatcagaaacactggggcttgtttaaaatgcagattcttagccccagtctcagcgattctgattctgtatatctgaagtgggactcaggaatcttgattttcaacaagctgaccagagggtccaatgctgctattcctttagttacactttcagaaatattactgtaaatcaaatggcaagaataaaatagttatttgaggcagttttagtatgttggacctggagtccaaagacttgggtcaaactccagctttgtcagttcctagacctgtgaccttaaacagcaaccttctctgtgaaccttagttccctcaggaacggctctggtcacctcctgctgtactccattgatgactcaccacataaggctccctgggagtcccccaaacctttgctctcttaactccttttacagcctcctacatctcctgcaggtgctgtcttctcctcctttttccaggccctgctctgacacagcattcattctcctctgggaagggttccttcaatgtgtctccaagcacatcacacccaggaaggaccctgtggccatatctgtctatcaccagatcaaactacgtgaaggcaggcactaggtactgtcagtgcccagcataggcctggcccataccaggtgtccacagatgcctagtaaagaaacctatgattcaggacccccatgatgagcaactatagcactagaacagtgataataactaatgtttataatgcatcttcagtttacagagggcttttgtactcatcatctagtttagttcctgcaacaacctcttgaggaatatagcacaagcaggacaagggaagcccagagatgttaaataatttatccaagtttatgctgctgggaagggcagcactgaaattaaaagaaaagttttctgagctcaaatcccatgccctttcctcaatgtgagctctagcaaggtattcaggaatcctgcctctacagttcagagcctcaaattgctgggtatgttgagttcttgtatctgatttttctagatttcctgcccacattcttactgtctggatatcaggaaagagtttatcaaatgcctgtggaaatccaagataaggtctcatgatgagtaacccagtgaaaacatgaagtcaagtctaactagtcactactatttcactactgctgactcctgatgatcagctccttttctaagtgcttactgtccacttattccatcatctgcctagaatttatgtgaaggaatcaaagcaaaaggatcataaggcttcctttttccagtatgtttttcctcctttttgaaaactgggccagttagctatctccatttttatttcatgaatacatccccagcgcctggtatatagtagatatggaacattacactttggagatattgcacccattctccagtttctccaaagttactaacaatggttccatcactgtgccaacatattttcttttttcaatatattgggaaataattctcccagtctgaaaatctgaacacatttcatgtgacttggtatcctcatatgtcttgggcttccaattctccattcctagtttcaagttcatgaactgtaaaacaaaggattagactaaatctctaaagttctatccagatgccaaattcttttctctttccatgatacctaagatagatgccaaatattgtcttttacctggtgtttgtgaacatgacatcacattacaggagtagcagatactaaactctcactctgtaaaacactgactgagttccatgagccagatactgaagtgagcttgttcacatatgttctcatttaatgctcataaccctgtgaagctgggaattgctgggacattttatttatttatttattgagacggagtctggctctgtcacctaggctggtgtgcaatggcatgatcttggctcaccgcaacctccgcctcccgggttcaagcgattctcttgcctcagcctccgcagtagctgggattacgggcacacaccaccacatccagctaattttgtatttttagcagagatggagtttctccatgttggccaggttggtcacgaacacttgacctcaagtgatctgcctgcctcagcctcccaaagtgctgggattacaggcatgagccaccatgcctgcccgggacccttgttttagaaggatgactgctgctataatgtagaaagtgatttggaagaggggaggagtggggcacgaaagatggttagtagatgggggtggtaatgcttacctttcagtatttggaggcttcggagtcctcaaaaattctcttccttgattggagtcctcccagccaatagagggcttcacacaaacagtttcttgggttttgaattgtttgaccagagctttcttccgacaaaaggttggggtgattcattcacttaccacaccttgcctgaacattcacttggggctgccggttatgaaggctattgttctccagcctgtcacagacgctttgaagacctgtgcctcagctggttctaaggagtcagtttgttcagctccgtgccaggtttccaacttatgaaatgtgctggagattaacacctctcctgccattttatccctactataattgccagtcaaaggattcctgcagttgcctctggcagccataactgatgaatgttctgccagctgctctgaggacctagaagagcagttttctatccaggaccagtttccaagggtgggagggtgaaatatatcctccagtgtgacatttcatctcccagtgatgggtggcttgggccctttgaagttggctctgaggaaccacacacttgggtctgagcagccagcagcttatcacatctggtgatcaatccttcaaaggttcctcctgaagtctgaatttttggaggtcaaatggattccacctgggaggggcttctgcttcaactcaggacatggggagaaggctgttcctcttccagggggaggcagttttcatggcattgagatgtcctctcacttattccccacccacccaccaagtcctttgtaagaggagtagggggagaggagagcgcctgcagcctcctgctcacattcctagacaccgactcactgagcccgtcgccgctggaacagcagagctgtgtgaaatgtcaagaggagttatgctcataggctccctggcctcagtctctttgtggcttgcatattcttccattagtactgtgttcatcacatggaaatcagagggtacaattaaaagataatttgctagtcccagacttaatttggggcccccttcttgcctgattgaattacaggggaacataatagatttttggtgagaaatagttgtctgtgtggctgggagaaagattgctcccagctctccagctgggcagccctttcagtatcccgtatgttatttccccacttccagcccacctcacctcctctgtggcccttgtgtgtcccctcggctaggatcctgacctcctgctcaagagtttaaactcaacttgagacccaaggaaaatagagagccctctgcaacctcataggggtgaaaaatgttgatgctgggagctatttagagacctaaccaaggcccagacagagagagtgacttgctaaaggccacatagctagcccacagtagttgtaacaatagtcttaatgatattaatggctaacatttatcaacctttaatgtgtcccagactttgtgccaagggcttacatgcagtgcattgtcgcattcaaacccagacagtctggctctgggcccaggctgagctttggtatagcatggtagaacgttgtctataatgtctagtctgggttcaaatcctggcttcacttctcacatttacagctgagtgacctcaggcaagtgatttaacctccctgtacctcagttgctttatctgtaaagagaaaaatcacagcactgtggaatagtgggggttaaaattcattcatacaagtagtgctgcaagcaatgtttaatacagggtgagcacctgttcagtgcttccttcttctggctgcctctggggctagagtgtggtgtcttcgtggtatagatagatagatatggctgagctctgcacaaacaccaagagctgttcttcactattagaggtagtaaacagagtggttgagctctgtggttctagaacagaggccggcaagctatggcccattgcctattttaatacggcctgtgattgattgattttttttttctttttgagacagagtttcactcttgttgcccaggctggaatgcaatggcacgaactcagctcaccgcaacctctgcctcctgggttcaagcgattctcctgtctcagcctctcgagtagctgggattacaggcatgtgccaccacgcctggctaatttttgtatttttagtagagacagggtttctccatgttggtcaggctagtctcgaacttccaacctcaggtgatctgcccgcctcagccttccaaagtgctgggattacaggcgtgagccaccatgactggcctgattgactgatttttttagtagagatagggtcttggtttgttacccaggctggtctcaaacttctggcttcaagcagtcctccctccttggcctctcgaatgctgggattataggcatgagccactatgcctggcctatatgacctgtgatttttaatggttaggggaaaaaaagcaaaagaatgctttgtgacatgtggaaattacatgaaactcaaatatcagtgtcccagcctgggcaacaaagtgagaccctgtctctacaaaaaataaaaaaaaataagccagggccgggcgcagtggctcacacctataatctcagcactttgggaggccgaggcaagtggatcacctgaggtcaggagttcaagaccagcctgaccaatatggtgaaaccctgtctgtactaaaaacacaaaaattagccgagcatggtggcatgcgcctgtagtcccagctacttgggaggctgagacaagagaattgcttgaacctgggaggcggaggttgcagtgagccaagatcgcgacactacactgcagcctgggcaacagagcgagactccgacacacgcacgcacgcacacacacacacacacacacacacacacacgctgggtatggtggccagcacgtgtggtcccaggatgcactggaggcttaggtaggaggatcacttgagcttaggtggttgagactacaatgaaccatgtttataccactgcactttagccagggcaacagtgtgagactgaatctcaaaagaaaaaaaaaaaaaagaaaaaaatctttccataagtaaatatctgttggaacatagccatgtcccttagtttatgttttatatatggctgcttttgccctataatgacacaattgagtggccacgacagtctgtatggcctgcagagcctaagatatttgctctctggccctttacagaaaaagtgccttgacctgtgctctagagccatatgtaccaggtttgaaactcagcctcacagctgggtgtgatggcacgcatctgtagtcccagctactctggaggctgaggtgagaggatcacttgagtccagaaggtcgaggtcaagattgtagtgagccatgatggcatcaccgcactccagcctgagtgacagagagagaccctgactcaaaaaaaaaaaaacaaaaaaaaaaaacaccctcaccacttatcagctatttgtcttgagaatagtgacataacccctcagaacctatttcctaatctgttaaatgaggctgatgacgtttcctccttttactggcaatttaaacatgatggataataaatgctaagcacttaacacagggcctagaagatattaactgctcaataaatggtagcttcttaacagtattcaaacccatgtgctcttatcacatgcattgttgtccctgtgtccagttggtggaatgggaaaaggctcccttgtaaccccatctaccatctttatcagactttcctgccatggttcacagtaagagatagaagctgcacggtgacttctggctctttacaatggtgagcggtgtgtgcctggtaagggagagctgatgtcactgccccaaatccagtagtgagatctgagtgttctggtttcctccagcagccttgctttttcctttacaatcctgcaggcagggagacaagggctttctacatggtaggctctggtttggtcatcgtcacaactgggggctgttcaggtgggctcccattccagatacctaggcttatcaatcccttttggcaccccaggcctttttctccctcatgccccatttttcagtttgaaaagcatggttatcacaggacaagtagaagaagctccactgtccactgaggccaatggatggtgttctgcatgtgaacactcagtgaatagtgagtgaatgagagtaacctgggctccatcctatttgcagagagctttggaaaagatttttctccttaaagagccagaatgaagcctggtagtgggagagctccagctctagagtcacatgagcctacatttaaattccagccctgccactgactccctttttgaccttgagtgagttacctaatctctctgtacctcacttttcttgtctgtagagtgggaataattcctgtctcagagaaataaaagagtgcatatagtgtttgccacatggagacacatcaggtgtaggttaatactctgggccttgtttccttatttgcaacacagccctgccctggagtggaagtggcacctcccattggtcagctcttgaggctgtccccaggacaggcagagggagggaatgaatgggagccctagtgccaggacagaacagatggcagctcagagctaggatggctctctggacctgtctctcctaccagaggtccccccgtctggtgtggctcttcctggacctggcatcctctgctttttttttttttccacctccaagcagaattactgtcctgtaggcagctcctctgcttgaggacatctggggccagatatgttcacactctatcctgccttgcccttccctgagctcaggatggacgctcaattggtcccagttattgtctgcagcgcctgcctgcagcctcgatccagcccagctccaccccttgcctgcaaggtctgtttcctaacagctgctccaaccacacacctcggttctgcgggagcccctcctcttcctccctccctccctcattcaggggtgggactgaagaagaaggctaacttgacagcagcgcttctttcttagctagtcaccggcccctgctcaagaatgccagtgtgtgtgtagcctccacagagaggtcgttttctcggagtccagaggggccgcctgagcttctgagaactagggaggagccatcccagccatgagcccctgtgggaatctgctgggggccaagtggcctggagtcctcaggctcccgcagctgctccggagggagaggtgagctcagggcagcctgcctgcagccagaggtgccgggagccccgggcctgtcatggtggccatctacagccggcctgaggcagtcacagacggatttgcagctgagcctgtctatctggtgtgggaagaagatggggagttacttgtcagtcccggcttacttcacctccagagacctgtttcggtgagttggtctccgagttcccctctccatctctcctggcccctggtcctgagaggagggtggtctccctaaatctccttctcacttagtcctttaccatcggttctgccgggcagaagccagcggaggttatacccaaggagaatcggccttgtgaggtacccccattatgtcctggaagtggtgaggggagggatatacccagaaggaacttcttagggagctccagctccccttctatcccagacaaacctgaaggagcctccaaaagatgccactgacctgcccattgtagatgttactgcttccggggggaatagcccaaatagagtgctgtttccagctctcacatgtcttacctgcgggccatgctgcctgcccaggaatttgtcccaacaagcaggatgggcaggttttgccaaactgtggaaactggcaagtcctgggtgtgggtagcctggtacacagtaggcaccttataaacgtttgttctcttaatggcaggcacatttgcctctggccttgaagggcttctgagctcccaggtgaatgtagttgctggggaaagacctgggcgagtgcttctaagactggagcaatgggctttagagtgttcctgagctgctgggccagcccccacacctcctcagtccctaggcctaagtacctccacgagcctctctctgtggggcttctcagagggagatgtggaaactctacctctaacctggctttctttgctcattgccccactccacctcccatagaaactccccagggggtttctggccctctgggtcccttctgaatggagccattccaggctagggtggggtttgttttcattctttgggagcagcctgttgttccaaaaaggctgcctccccctcaccagtggtcctggtcgacttttcccttctggcttctctaagctaggtccagtgcccagatcttgctgccgggatactagtcaggtggccaggccctgggcagaaaagcagtgtaccatgtggttttgtggaatgaccggaccctggtagattgctgggaagtgtctggacagggggaagggggaagggaactggtcctcaatgctgactctaccaagcgccctgctagacactttatcctttaatctctcaacagcctaaagagattatatatccccattttacagatgaggcaaccagtttcaacagagttaacatatggagcctcactgggcagctttttctgtcttcctgactttctctcatccttcagggggctgcaggtttgttttcttctcctagtggagaggaaattctcaggtttgttttcctctcctagcagagagtaaaaaaagggatagtttgcctgacttgttgaaggtgtggctgagattgttttctaaagagccaatggaaattgatcttgagtttaggagaaagcttttacatgtggaattaagatgccaagtgttgaagtagccacatttcaggtcctcattaatttctcttaatcctgggaaggcagcttaggagaagggttgttcctttaggagccaggaactataccccttttacccttggagaggcagggaagccagggaggacacaacttctcaggaagaggagaagctagagcagatagtgaactctcaacctgaacctttaagggccagaccactaatgccacccaagtccacctgccgtttgtcttgttctgtcccaggctttctggagaacctgatcttcttgcccctacccccaagctccgtttgcccagctagagtctggggggtactgactgactttcgtagacattcttcccttccccaaataagaggccacattcctgaagtcacttctgaagagatagctgccacacagggctctttccccccagggagggaccacccagaccctctgctctcccaggtatccgttaccacatcactacctggtcagaaagctgtttctgccattagcccctccctcttttattataggatatcctcaagggctcctctttgggcctcagtttcatccttggcagaaagtagaagctagacttcttgggctcctgaacagggtccttgctggattctgtgaaacaaattaagttcttgaccctaggcctctgggggagtacaaagtctatgggagttctggggctgtggttgcaaggaaagtgacgcaaccagattccatggggacatgatcaggcgtgacatgtgagggaggaagagggagcaagggaatgaagaatacaacttctgtgtcccatacacccctgcctgacaggccatacatactcagcagagaatgcactgtctttcctaccacactagcgtgaggagtgagctgcaattaccactgtgcttccaagtaagaaaatacctcaaattggaatttacaaaagaggtaaattagggagtggcttttgtcggacatctttaaagcatttttctttttatagaatttcacttaatgtccaatactgatttaatgagcttgggtttacacattatctcttgaagaaaacaaatgaacctttgtgttccaaagcaatccatgtttaaagggaaaaaattatgcataactctgcccagcttcacagtaacctttggcaggtgccttaggtcctctgggactcttttccttatctgaaaaatgaaggacttggatcaggtgaatggttcccagctctgcaacttatgtggctcctcagaggcacacaagctcttttccattatttgccaaataatggaggccctgtctttaactgcagtacaactacacaaaatacttgaaactacagtcttcctggtttttggttggaactgaatcagtgcactctagcaacacttatttcttgctgttcgtaggcttcattatgtgtttggttaattttttaaaacaacaataacatattccataataattacagcttaattggcagactgtttcagtctataggatctgcaggaaggaggagtaataaagggatttttgactgagctcttatggaacagagtctctctaggcccctgtcatatctgcccttctgggccctggggaaaagttggcatccccagttgtggtgctctccaggtgccctcaggctgtggtggagggagcttcccattctctccttcagcccactcaattcagaggctaggggctgaaagaagcttctctacaactggctgttcactgggaggttaagggatgaccatccagccaggccttcctcaggacatgggagggcttatgctttaacatgtgtaaatccactgcaataatgactggttcttttaccccataaggttgagaatttacctgtaaacatttttgtctgaagaatttggatgtaagtgagggctgggcctctatcttatctcacttggcttctctcagcacagcaccttgcctgcttgttcttacacatcctagatgcacagtaactatttcctaattattagaaatctattagaatcaattgatttcagctgggcttggtggctccttcctgtaatcccagcactttgggaggccaaggctggaggatcacctgagtccaggagtttaagaccagcctgggcaacatagggagaccctgtctctacaaaaaataaaaaattagccaggcatggtggtgtgcacctgtagtcccagctactcaggaggctgaggcaggaggatctcttgagcctgggaggtcagactacagtgagcaatgattgtgccactgcactccagcctgggtgacagagtaagactctgtctcttaaaaaaaaaaaaaaaaaagttgatttctatttggatagataaataattcattttaggacctttctttttcacttacagaaatctgtttcattctgggctgagaagcaggtccatattgctaggcataggagaaaaaggggtctgtctgcatttgcccttggtggtctcaaattggggagggaaagaaatgaacacttactggctaccttctgtgagccaggcatcatgcaagacatctgtacataatttaattctcataaccccataagatattattagcaatgtacaagtgaggaaactgaggctcagagtcatgaagtaactggccttgggtgacacagatggtaaatggcagagaaggaatatggatccaggtcttgaaagagaaaatctcaactgattatcttttttaaaaaactcatatgttctctgctgactcaaaaggtctctgtgtggatctgggttgacccactgaactgaccatcagggttccatgcactttgtatctgcccaagccctcagaacccctcagtaatgttttggaagatgagttttggaggttgtccttaggcatagcctcagcgtatgtaggcctctaggtgatctcccctaacctgaggatttcagctcaattcactctggctcctcaggacagtgggatgactggttcagacctcagctttaccacctcccagctgggtactcttctacctacagccagggcagattttgactttcacttgaaacttccaaaaattgaaaggtagaaaaacagccttggctttgggaagaacgtatgatgtccatggcctctaagcatctgaggtgggacatgttcgagtagcaccttacagttccaaagtgtgttctgggttctttgtttaaaagaacagagactgctggggaattgaacactgtgaagtatatgaaggaggagaattgtgctatttaacattcagtacttgggctaaaggagaagcatcacgaagtgttaacactcaaagggtcttgagctgtcagggctccagcttccttattttcacaggtgagaatcctgaggctcagctgttgagatgtgctgtctcactccggtgacatagtacagtggatgtggctttgcagccaagcacacatagcttcacattccagctccatcaattatgtattgggcagctttgcagaatgatttgactttaactctgcttttcagtcttctgtaaaacagggataatcctgctaccgtagggttgtcaggattagagataatataaataaggtacctcatataggacctggattatggctggcattcaataaatagtagctgttaattgatagctaagctagaactctgaagtctaccatggcaacttcttaagtggtctgagaacccagttgtgttctgtggcaaaacacagcttagggatccatacccagccctcctgtcagctgttcaccttccagttcttcagagacatgtgtggcagtgactttggccacatagctggctgtgccctttaaaggcattccttgacacagatatgtggactggtgacgttgctctccagccaggtgttcttcccagcaggctggcctggctgtctcctgcatgcctgtacttgtttgtctccctgctccctctcctgggcctggccagagctacttgcagcaaacaaaagcaggatattggcaatggaaaggagggtgtgttctggtgctcccatgccctgcggcgcacataccattgcaagggcgtaacagagcccaggcctgcatttgggtgcaaataagtctgcacacagaagaaaagaaggacctggtgaccaggagccatggaacccttgtgctcccctacctgggctactggttcttgccactcctaccattttcagtttggaaatatttgttaaggctttgctcttccaggtcctttgcttggtgctgagtctaccaagagtaagtgggatgctgtttttgtcctcagggagctaacagtctagtgaagaagaaagatggttgcccaggaacttctaagtcagaaggcaggaggcaagaaggaagcccctgctcctactgccagccctctgttgggcaccccatagttcttcagaaccacatttaatcctcactgcaggccaggcatagtggctcacacctgtaatcgcagcacttcgggaggccaaggcgggcagatcacttgaggtcgggagttcgagaccagcctcaccaacatggggaaaccccgtctctactaaaaatagaaaaattagccgggtgtggtggcatgcgccagtaatcccagctactcaggaggctgaggtgggaaaatcacttgaactcgggaagcagaggttgcagtgagccgagattgtgccactgcactccagcctgggcgataagagcaaaattccatctcaaaaaaaaaaagaaaaaagaaaaaatcctcactgctaccttgaaagtaggtgatgacattgccatttcacaaatgagaagtgaaggggctagcccaagatcacttaggtggtaaatggtggtgctaagattagaacctcagatcatctagggaaaaacacagatatgcacagagttaaggggacccagggtattgtttgtcctcttgtttcacaggtggggaaacaacccagagagggaaaggggcttgtccaaggcaatttagcacccaagaacttgaacccatatctctctcctcctcatttagagctcatcccacatgtatcttatattgagaggagtgtgagccacataccaagaacagtcttcccctctgcctccaacctcactgtgcagttttgagacacttcacagccatactcttcatgccatacccagcccttaagaccctgaagttccccttccataagacaagtaggaaaagctatagggtaaaaatagccatcagtgtttgttgagcacccaggaggaattgggcactccagaaagataaagggattctcagggacttgcttctctagacttccctagctcagctgcttcaactcattcctgcccctcttctctacctcccgcagtgctcagaagtagtagaactcactgtggcctctcaccttgcattgttgagttttatttagactttctcttcctcaactcttcataagctcatgaaaggtgaagtagggtgccctgtgtatttatcttttatatctgcagtgcttagcaagttataataatgcacttgcctggcaaaaggctttctctcatacattagcttatttcctcttcacattggctctttgtagtaataggatgctattagttattttcaatgagagaaagctactaagagaagttgtccagctagtgacagtaagtggctgataaagtgagctgccattacattgtcatcatctttaatagaagttaacacatactgagtttctactatattgggtcttttttttttttttttttttttttttttttttttttttgagacggaatcttgctctgttgtccaggctggagtgcagtggtgcaattttgggtcaccacaacctccgcttcccaggttcaagcgattctcctgcctcagcctcctgagtagctgggactaccagtgcacgccaccacgcccggctaatttttgtatttttagtagagacagggtttcaccatgttggccaggctggtcttgaactcctgaccttgtgatctgcccgcctcagcctcccaaagtgctgggattacaggtgtgagccaccgcgccctgcctatattaggacttttatataagctatctctagctagctagctagctagctataatgttttttgagacagagtctgactctgtcacccaggctggagtgcagtggcgtgatctcgactcactgcaacctccacctcctgggttccagtgattctcctgcctcagcctcccgagtagctgggattataggtgcatgccaccacgcccagctaattttttgtatttttagtagaccaggtttcaccatgttggccaggctggtctcgaactcctgacttcaagtgatccacccgcctcggcctcccaaagtgctgggattataagcataagccactgtgcccagctgctctctatatttttaatacatattatttccattaattttcacagcagttcattttatagatgaggaaactaggccagagaagtaaaatatcttgcccaagatgatgtaactagtaagtggcaggatcaagattcaaaccaagcaatgttcaaacctcttggaagcaagaatgtggccactgtggaaggtgcaaggccttgacaacaagaatagggaaaagaaggagctagaaggaaagagatggcatgggctcagcaggccagggagctcttagctgtgtgtgttgggaagctcagaagggaggaagaggttgtctgtgcaggtaagtcctgagaacacaccagacttttgagaggtggagcttcatagccaggtcattaggggagaagggagctatagattttttttttttttttttttttttttttttttttagagacggggtcttactatgttgcccaggctggtcttgaactcctgggctcaagtgatcctcccacctcagcctcccaaagtgctgggattagaggcatcagccaccccgcccagcgagctatggatctaacatgtacatcttacacagtgctaatagaatgttgggtttcttccccaatattttattttgaaaaaaaattcaaatatatagaaaagttgaaaatgtagttcaaagaacacctacatacctttcacatagattcatgatttgttaatgttatgccactttgtatatatctctctccctctatctgtatacttttatttatttatttttgctgaactatttcagagtaacttaaaggcatcttgattttacccttgaacagttcaatatgtttctgctaagaattctcctatataagtcagatatcattacatctaagaaaattcacggcaattttacaatataatattatagtccaaatccatatttcctcagttgttccaaaaaatgttcatggctgtttccttttttaatctaaatttgaatccaagtttgaggcattgtatttggttgctgtgtctctagggtttttaaaatctgtgccttttcttctccccatgactttttagaagagtcaagaccggttattcttatagaataacccacattctagatttgcctgattagtttttttatacttaacgtatttttggcaagaacattacattggtaacgctgttggtgatgggtcagttttgaagagtggagatgattaaactgcttttgttcattgaagtatctgtcaagaccagagatccttaactggtgccataaataggtttcagagaatcctttatatatacaccctgtcccccacctaaattatatacacatcttctttatatattcatttttctaggggaggcttcttggcttttatcaaattctcagagggccccaagacccaaagaggttatgaaacactagtctgtccactgaggcaggcaacacagagctggtttctggggccttgttcagtctgaaccagcttcccttggggagatagcacaaggctgtaactttgccccatcttggctttggatcaaagaggactgtccattttgttgtcatacctaggaaccagggacagcttatgtggcctggttccagggatccaggagaatttcagttcttgtcttgcctttcaggtgttcagaatgccaggattccctcaccaactggtactatgagaaggatgggaagctctactgccccaaggactactgggggaagtttggggagttctgtcatgggtgctccctgctgatgacagggccttttatggtgagtgaatcccttcatatctgcccctcttggtcttcagagtccattgacagtgcttccagttccctgtggcctgttaatcttttagtctttccatcagccagggcatctccctttatttattcattcattcaactagcaggtatcaattgagcacctactaagtgaaaggtaagatccttccctcaaagacttaatagttgaacgttgggagtgggaggagaggcaggcagagaggagacacaatatagttggataaggacctccaaggagagtgttacaggctgagaggaggatatacttaggttgtctttagggaatcagaaaaggagactctggaataggctggcagagagaggggctacctcctatacctgctctggacaaacgactttaagcatagtgacagacttgccaaccctgtattggaagaactgatcttttttagtggggatgattacttctggggatttcttctcataactgagaccaaaacagttttgtgcagtctcagaaatgacaggaggtaccaatctgacacttcctttggaagctctagggcagagagtgaaagagtggattttgacgggggccttgcttggaggtcattcacccacccctgtcctcactccagcaacagtgataactcacttccttcctccctttgtacacccttctccccacctgctcacaggtggctggggagttcaagtaccacccagagtgctttgcctgtatgagctgcaaggtgatcattgaggatggggatgcatatgcactggtgcagcatgccaccctctactggtaagatagtggtcctttgtctatcctctcccatataagagtggctggcggggagggacagtggcagggtgagttgggcagaaggagtgttagggtagtcagagcattggattcttaccacagcagtgctcttaaccagctctttaacttgtaagcagaatgatttacacatgtctctaccctttttccttaccaaccttgaaaatgtcttcactctgccctgcaatcctcccagtgggaggcactcttcaaggacgatcccagaacattaaagtcaaagaccccttagagctcaccctgtccaaccaccttggttgataaaagaagtcagcctggggcccatggaatagaatagtacaagggcaaggttctcattgtgagtcaaaggtagagtgaagagaacccagaccatctcaccccaacccaggccagtgtttttccaaatataccacttgctgcagatctagctcagcacccccagtcccagcccaccctgagaacccaggctcctcattctgagcagccagctagaatcatgacaaagagggtggtagtgagactatgggtactgttgcttaaagccacatggtgcagtggttgctggggggcttctgtgtgggactctagcatcttattcccccctgtgccctctccccagtgggaagtgccacaatgaggtggtgctggcacccatgtttgagagactctccacagagtctgttcaggagcagctgccctactctgtcacgctcatctccatgccggccaccactgaaggcaggcggggcttctccgtgtccgtggagagtgcctgctccaactacgccaccactgtgcaagtgaaagagtaagtattttgagaacccttcagcaggggttcttgagcagagtctgtaaatgggcctcagagggcttagacctccaaagtctcatgcagaactccctttattctcatctcatatctttctcctggaccccactatgctgtaaccgtacctgggccttggcacttactgttctctctgcccaggctacttcctacccgatacttaaggcaagaatcactcacctttcaggtgtcaggtttcaggtcatgtttgctctttgaaatcatctggcttgattatgtgtattagttgtttatcttctatcccctccactagaatgtaaattccagaagaaacttgctgtcttattcagtgctgcatgcccagggcttggaagagtacctggcatatagtaggagttgattgattattattttgtcagtcgagagaatgaatggagaaaatgtggtccatggcccaaaagaagttaagaccctatcctagattcaggccagagaccagatggagaaagagtctgtgtctatctaataccagtaatgtcgtacctctggccgcttaccatgtaaatattgattgtgtatctaccatgtgttggacactaggctagtgcttgcacagcaggtgaaagatactagagtttgggaagtcaggaggagctaaggtctgttctacaaccttattagatgaagaggagagggaattgtgttcagggcagagggagaagcatttctccaaaagtaggagtcttaatcatgtctgatgtaggttgagtgtggccagaaaaggggctgttaagtatagagggcctggattatgaaaatccagcagatccattgagagtttaagcagcaaggtgttgtgaccaagttaacattttagaaggatcactggtatggaggttggattggagaggggaaagcctaaaggtatagagactagttaggaagctattgtaggctgggcatggtggttcatgcctgtaatctcagcactttgggaggctgaggtgggaggattgcttgaggccaggagttgaagaccaacctggccaacatagcaagaccccgtctctgtttttcttaattaaaagaaaagtccagacgtagacatagtggctcacgcctgtaatgccagcactttgggaggccaaggtgggcagattgcttgaggtcaagagtttgggattaggccaggcgcagtggctcacgcctgtaatcccagcactttgggaggccgaggtgggcggatcacaaggtcaggagatcaagaccatcctggctaacacaatgaaaccccgtctctactaaaagtacaaaaattagccgggcatggtggcggacgcctgtagtcccagctactcgggaggctgaggcaggagaatggcgtgaacctaggaggcggagcttgctgtgagcagagatcacgccactgcactccagcctgagcgacagagcgagactccatctcaaaaaaaaaaaagagtttgggattagcctggccaacatggcaaaaccccatctctacaaaaagtacaaaaaaattagctgggtatggtggtgcgcgcctgtaatcccagttactcaggaggctgaggcatgagaattgcttgagcctgggaggtggaggttgcagtgagcccagatcatgccactgcactccagcctggatgacagagtaagatgccatctcaaataaaaattaaaaacaaagtttaaaaaaaaaatagaagctattaccgtgatccaggtaagagatgtgaataactacaatgatggaaagaaggcagagttcttagagatgggagtaggagagatgagggaactccagattgggaagatgatgttcaagtttctggcttaggccacagggtgagtggcaattcccttcactgagatggggcatcctggaaaaggtgttgcctttctgtgtgggtatcctgggccccttaggggccactggtggcctgggacctggtaaaccttccctgcacaagcagaattggtcaagcaggtttttaggacatctttaccctgcctcaactcttgtctggcccagggtcaaccggatgcacatcagtcccaacaatcgaaacgccatccaccctggggaccgcatcctggagatcaatgggacccccgtccgcacacttcgagtggaggaggtagagtgtgtgtctaatctgtcttgtgagggtgggacatggaacagatcctctgagaaatcaggctgtagcctttaccttttcctacccccagcccatctctttgtcttagcattgagcctgtgaccactggtgacctatttcagcgtaacaggttcccagggtagcagggatggttgatggacgggagagctgacaggatgccaggcagagggcactgtgaggccactggcagctaaaggccaccattagacaagttgagcactggccacactgtgcctgagtcatctgggttggccatgggtggcctgggatggggcagcctgtgggagctttatactgctcttggccacaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggtgccacctcccaccctggctctgttctgtcctatgtctgtctctcggatgaagctgagctggctttcagaagcctgcagagttaggaaaggaaccagctggccagggacagactatgaggattgtgctgacccagctgcccctgtggggatcacagtttacagccagagcctgtgcggacccagctgtctgccaggtttccttagaaacctgagagtcagtctctgtccactgaactcctaagctggacaggaggcagtgatgctaaaccctgaagggcaacatggcctatggagaaagcatggagctcagagcctggagtacgggcacagataggattgaataaattgtgtagaaagactttgaaaacaataaagcaaaagatgaatgaacgttttttttagacttgagggaccaacaacccccaaaccccagattctgccaggtccatggggaaggagaagttgccttgagtggaagccccaagtagggagacttacagaaaagaagtcaagagcactggctcccaggcagaaatactgataccctactggggcttcaggctgagctcctcccttcacaaatcacttcatctctctgagcctgtttctgcatctgtgacataagatggtaagataaaggtggctgtctcaccaattatgtaaggattaaatgtggaaaaggacataaagttgtatagtgctgccatagggacagtgttcagtaaacgtgacacattcttagtatcactaagaatcaggttcttggccaggcaccgtggctcatgcctgtaatcccaacactctgggaggcctaggtcggaggatggcttgaacacaggagtttgagaccagcctgagcaacatagtgagacactgtctctacaaaaaaaaaataataataataattgtttttaattagatgggcagggcactgtggctcacacctgtaatcccagcactttgggaggccaaggccggaggattgcttgaggccaggagttcaggagcagcctgggccacattcctgtctctacaaagaataaaaaagttaactgggcatggtggcacatgcctgtaatcccagctactcaagaggctgaggaggaggattgcctgagcccaggagttcaagactgcagtgagccttgatcacaccactgtactacagcttgggcaacagagtgagaccttgtctccaaaaaaaaaagtttgtttttttttatccactctcctcaccaaacaaactgagtaagttagagccctctcagctggcatgtgttggaaacagtgccctctcattaaagtgctgccctcactcccattgcctcttggccttggtcagtatgatgaaattagtgggaggcagggcaacagagggcagggaagagctagaaatccatggcctggaaaagggaagatttgggagtggccaggtatctgtagagccaccatgcagaggaggggggcagctagccttgtgtgctctggtgggcatggtcagcaggaggcagagcaaaaggacaagggtaagtaaacctgtaggtcgggacaagccaagagccatccagcgtcagtcctctctgggtagcccaagtaaagcaggagcataccccagagagaaagttcgcagggctgttcacctgcagtgctgtggacttcaaccttcttgttccttcttcagtaagtgaaaataacagtcattgaccatgactattatcgaccgcttttgaaaatgtaaacatagtgactttattgctgtaaaaatcatacgtgtttatcatcttaaaattcaggaaacatggacaggtacaaagatgtgcaaaatatcatccaaaatcccatttgctggccaggcacggtggctcacgcctgtaatcccagcacattgggaggccgaggcgggcaaatcacttgaggtcaggagtttgagaccagcctggccaacatggtgaaaccctatctctactaaaaatacaataattaggctgggcgcagtggctcacgcctataatcccagcactttgggaggccgaggtgggcgaatcacaaggtcaggagtttgagactagcctggccaatatggtgaaaccccatctctactaaaaatacaaaaattagggccgggtgtggtggctcacgcctgtaatcccagcacttagggaggccgagacagatggatcgcgagatcaggagttcgagaccaacctagccaacatggtgaaaccccatctctactaaaaaaatacaaaaattattcggttgtggtggcacacgcctgtaatcccagctacttgggaggctgaggcaggagaatctcttgaacctgggaggcagaggttgcagtgagtggagatcccgccgttgcactccagcctgggcgacagagtgagactccatcaaaaaaaaaaaaaaaaaaaaaaaaaattagccgggcgtggtggcgtgcacctatactcccagctacttgggaggctgaggcaggagaatcgcttgaacctggaaggcggaggtcgcagtgagccgagatcgtgccattgcacttcagcctgggcgacagagcgagactctgtctcaaaaataataataataacaataactagccgggcctggtggcacatgcctgtagtcccagttactcaggaggcggaggcatgagactcaggtgaactagggagacagaggttgcagtgagccaagatcacaccactgcactccagcctggttgacagagcgagactctgtctcaaaaaaaaaaaatcccatttgctcattttttggatactagtataactatcactctaaaccagttagtacttaaatcaagcagatatgggagatggtgaattaccatctacagtgttgtcatatatgtcacatactgagcattatcagctagtagaatctagttaattgttctatgtgtgatgtatgcagagttcccattttgaatgtgtttttactatgcttaaataaatgactgatgtcagcaaccccaaaatgatacatctgatgtaagagcccctgttccccaataataacatctaaactatagacattggaatgaacaggtgcccctaagtttcctccctccagggtttcttggccggtctctgaggactacacatccctactcccgtctttcctcatcttcaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgagcgcaggcaacaattgctttgctcttctgcccccagtccctctgtcactgtctttcggggatttctcatcacttggccccaccccacaccatgcaggatgccaggcctccttcctggctttgggtgttggtgtgagaggtatccttcacccccacccaggccacctaaggtcaatgttgctgttacagtgagcttgtggacctggagatccaggttgggttgagctgtgcctgtggccctcctgcctccagtcagtgggtgtttgttaggtgcctgcagacctcagtaccgggcatgctacaaggagcacacaggggaatggctcctgcctccctggtgaacagtctcagggactaacctctctctttctctcctcctcctcctcttctgctgagaactgggagggggggtcaggtaagacgtgtgtctcagcttgggggcagcagggctggagagctcacccccgatccacccagctccctggtgcatgtctttggcactgaccttcctgcccccagacttctgttcactcaggagactcacttctatgccaaatgaccagagcccctgcttggcttggcagcatcccctcctgccttcttccccacttcccttttctgggttcttgcctgtcctctgtgcatgcccagctctccaggaaagagggtttgcttccgtgtgagtcccatgttgctccacgctgcatcttccacacatgaactctgtcattctgacccggctcagtgtgccctccaagggatgggatggccagctgcatagattttctcaaacagttctccagaacttcctctggtctcagcaccattaacagtcaccctccctgtaggtgacacacaaagccacgggcaaagtgatggtcatgaaagagttaattcgatgtgatgaggagacccagaaaacttttctgactgaggtaagaagatggagggggcccgggaggttggtgtcaccattggaagagagaagaccttacaaataatggcttcaagagaaaatacagtttggaattactgtcttaaagactaagcagaaaagagccctagaggaatatcccactccctctaaattacagcgtaattatttgttcaatgaacacttactaaaagcaacacaaacagggtacaagggatgcagtaacaaaagatacagggttcagaagagctctcaggttatgaggatgatggacatgaaaacactccaatttagtacaactcaatgttataatcctcacctgaacgccctgctaagggagcctggaggggagctccctgagcactcacactccttgggcatttacagttttcactacccctcccaagttacttcatggagtaacttaagttggggacacctgtggtctgggtattgccctccaagccacttggccactcccaccccagttctcccaatgcagttccaagggtaaggcctatgaagccatctccatctatatggtggtggtcttccctcatcctgatcttagtgccctgtcatatcacaagataggaggtaggagatacaggtggtaacacttgtcaagctgattccttggagggaagaggtaaggaagacagtgagaagttaaccaccagctttccttggcttcccccacccccaggtgaaagtgatgcgcagcctggaccaccccaatgtgctcaagttcattggtgtgctgtacaaggataagaagctgaacctcctgacagagtacattgaggggggcacactgaaggactttctgcgcagtatggtgagcacaccaccccatagtctccaggagccttggtgggttgtcagacacctatgctatcactaccctaggagcttaaagggcagaggggccctgctttgcctccaaaggaccatgctgggtgggactgagcatacacagggaggcttcactgggagaccacattgacccatggggcctggaccacgagtgggacagggctcaacagcctctgaaaatcattccccattctgcaggatccgttcccctggcagcagaaggtcaggtttgccaaaggaatcgcctccggaatggtgagtcccaccaacaaacctgccagcagggcgagagtagggagaggtgtgagaattgtgggcttcactggaaggtagagaccccttcctatgcaacttgtgtgggctgggtcagcagctattcattgagtttgtctgtgtcactgaaactgaccccagccaactgttctcagttcacagccctgttttcaaagaattacacatctctaaaggcaaacagggcacggacaaggcaaactggagaggcaaactgtagcctgagatggcctgggcttgccatcacaggtattcaggtgctgagggcccttagaccaactagagcacctcactgcctaggaaatcaatgaaggggaaatgagttctagcggagccctgaaggatcagaattggataaagttcttattggcagagaggcaccaggattgaagtgacaggagcaaagacctgggaggaaagaggagaaaatcatctatttcacctggaaacaaatgattccaagcatagaaataataacagctgacaagtactgagtgccctctatatgctaggcactgggctgagggattaacatgcatgtgcatgtttattcctcatgacaaccttggtttccagataagctggactggaaagggacagagctgggatcctgggctaatcagtctggtcgccaagcctgagactttagccactgcccttcacatgggggtccatgaaaatagtagtagtctggaacagtttgggggtacatcaaggtcgctgtgttttaagctatggagtctggactataggagacaaatgtaaaagagttttttggttgactggctttttggtttttttgtttgtttgtttgtttgtttttttgtttttttttcctgtttctggggcttgaatcaggaaggaggtttttttgttgttgttgttttgagaaaggatattgctctgttgcccagactggagtgcagtggcacgatcatggctcactacagcttcgacctcctgggctcaagcaatcctcctgccttagcctcccaagtagctggactacaggtgtgtaccaccacacctaattttttgaatttttttttctttttttttttttttttttttggtagagacaggttctcactttgttgcccaggctgatctcaaactcctgggctcaagcattcctcctgcctcgccctcccaaagtgttgggattacagttgtgagccaccatgcccggcaggaaaagatttttaagcaagaaagcttaagagctgtggtttttccaaaatgagtctgggctggcacagtggctcatgcctgtaatcccagcacttttttgggaggccgaggtgagtggatcacttgaggtcaggagtttgagaccagcctggccaactggtgaaaccctgtttctactaaagaaaaaaatgcaaaaattagctgggcgtggtggtgcacgcctgtagtcccagctactcaggaggccgaggcaggagaatagcttgaacctgggaggcagaagttgcagtgagccaagatcacaccactgcattccagcctgggtgacagagtgagacttcatctcaaaaaaaaaaaaaaagagagactgatatggttagtacattggggtggaatgcggagggtccagggaatggagccctgcatagggggctaatgaaacatttcagatttctgaattaaggtagtggctgtggggacaggagcctgggaggccgggtggagtcagaatggagagactggttggcaatgagggaacaggaggaggaggaggaggagttacgagtggcttgaggtgtcacttaccagacatttgggggatgggggatagccatgattgttgagcaactggtttgggaagagctagcattgatccctgctgttctgtgctagcagaacctatcagcatcttctgggcaggaaactggctccatgagactggcttagggagaggctgctagtcacctaatctgcagagaaggggcagctggagctgtgggacagaagaggcatccatgtagctggtgggggtgtctcagcttgtgaagaggagatggctttgagcagggctgacactgaaaaggctggaagaaaaaaacagacacacaagagtctcaggatcaggtagcataggaaagttgtggacagtctttgaggagcactccctcaggcaggcaggcaggcaggtcatgagctatagcgattcaggaagagctccctgggtgtgtgagcagctccaggagcctaagggatgaaagtagtattgcagggggctggagagcaaggagtggctccttctacatttgcaagggaaggagaaaggaagttgctcctgagagtggtaagagtcagtggtggaggcctggagaggagacataacaaacaaatttgttgacaaacattttggtaggaagggggagagcttaaagtttagacagtggggaaggtggagtcttagaggaggtgaatgtctgaaagacagagctagctggagcaagaagtcacttctctgttgcaggcaggaaggatccaaagtggctcaagccagagattgggagagtggggaggagggagcagcctggatctaagtaaaatgggtagaggtggagggggtgctgcaacggccagggttttctgaagttggggacattaggagagagctgtgagggctttggccagccactgtgctagtgattggtgaaccaaaggatgggcaggagatggcagcagggaagcagaggaagtccaggcttcctgttggtattgggacaagggagaggccataggaggccctggccctgttgtccaggttgggttctgaagctgggtgggcatggcctggtaggagagcatctatggcgcccaattccagattcagggtctagttgatttgctggccctgtagcctcagctcatgcttctgttccaggcctatttgcactctatgtgcatcatccaccgggatctgaactcgcacaactgcctcatcaagttggtatgtcccactgctctgggcctggcctccagggtcctatccttcctggcttccttgtcacaaaggaggctgacttgtcccctctggctagagggcagaggtgttgcctaggagctcctatctttcccttcctgcttcttccaatgcccttctctgtcctctgggagctccgagacacacacagacataatttcaccttctctcattagcaacctttgaaataatttgattagaagggacttcagaagtttgttgactatatgtagaaaaccctgtcattttacctgcttttgccccatagtagtcttgtaaaacagttcattgctgaccccattttacagtggtggcacctgaagcctcagcctgaggccaccgagctagtaaatttacagggaccagtttgagaccagcattcctcccactgcccctcagctgtggtggttacaatgttgtttgtcttactgacttgctatctggcttcctgggtgtctaccggctggccctggctctgccctctagacccacaccacgcaatcttcattcctttcccacatgactgccctgtagctattcaaagagcttgtctcccccaagtctccccatctactgcctccaccttgcctttttctgtcttatcctggttctagccactgcctgaaatcattttaggaataagacaggacagggaaaaacaaaagcaaccccctgtcccacctctgagttccactctccaagtccctgagcctcacctccagggctccagtggctctgccatgaacccactgtgggctgggagtctgctgtgcacagataccagaccctcagaaacacaaatgccaagtgtgtctgtttttttgttttgttttgttttgttttttagatggagtctcattctgtttcccaggctggagtgcagtggtgcaatcttggcttactgcagcctctacctcccgggttctagtgattcttctgcttcagcctcccaagtagctaggactacaggcgtgtgccaccacgcccagctaatttttttttttttttttttgtatttttagtagagacggggttttgccatgttggccaggctggtcttgaactcctgacctcaggtgattcacccgccttggcctcccaaagttctgggattacaggtggaagccaccgtgcctggcctgagtgtgtctatttgatagagctttctgctctgattctcccttgctatacaccttttctccccttctcagtggcttctcttgcctatgcttcctccccagggccaggtttgagaacatccccatgaagtcctgacctgtcttttatcctaccaggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggtgagtcctgaagccctggaggggacacccgcagagggaggacagatgctgcccttgcatcagagccctgggaattccaggggaggcctgtgaagcgtaggaccggatacccagagctgaggatatttttcccttgccaggtggggcctcacgatttagctcctgagctcagggggctgggaactgatcagtgtcccatcatgggggataaggtgagttctgactgtggcatttgtgcctcagggatcgctaagagctcaggctattgtcccagctttagccttctctctccatggtgagaactgaagtgtggtgccctctggtggataatgctcaaaccaaccagagatgctggttgggattcttgaaatcagggttgtgaggcctcagaaatggtctgaatacaatccattttggagtctgaggcccagagaagttcagtgaattgcctaggagcatacagctgcctaatggcagaggctagatgaaccctagtctggttcttttccactttaacgtgcagtttcatcctaggcagtgttatgttataagggctctccaaggcagttcacctacggctgaggaaggactattttcaggtggtgtctgcgcaggacagcctgtggggtgtccctacagaacctgttctagccctagttcttagctgtggcttagattgaccctagacccagtgcagagcaggtaagggatgtaaacttaacagtgtgctctcctgtgttccccaaggaaagagctatgatgagacggtggatatcttctcctttgggatcgttctctgtgaggtgagctctggcaccaaggccatgcccgaggcagcaggcctagcagctctgccttccctcggaactggggcatctcctcctagggatgactagcttgactaaaatcaacatgggtgtagggttttatggtttataacgcatctgcacatctttgccacgttcgtgtttcattggtcttaagagaaggactggcagggtttttttgttttagatggagcctcacttcgttgcccaggctggagtgcagtggcacaatctgggctcactgcaacctctgccttctgggttcaagtgattctcctgcctcagcctcccaagtagctgggactaccggcacacaccaccatgcccggctaatttttgtatttttagtagagacagggtttcaccatgttggccaggctggtcttgaactccggacctcaggtgatccgcctgcctcagcctctaaaagtgctggaattaataggcgtgagctacctcgcccggccaggtttttttttttttttttttagttgaggaaactgaggcttggaagagggcagtggcttgcacatggtcgataaggggcagatgagactcagaattccagaaggaagggcaagagactgttcatgtggctgtctagctagctcttgggccaaatgtagcccttctcagttcccttcaagtagaagtagccactctaggaagtgtcagccctgtgccaggtaccacgtggacagagtgaggaatcttggaaagattcctacctttaggagtttagtcaggtgacagcatatctcagcgactcaaacacacacacattcaaagccttctgtaattcctacaaagttgtgaggggtagaggagaggagagacaagggatggttaggataatgaaggaatgttttgtttttgtttttgtttttgagatggagtttcactctgtcacccaggctggagtgcagaggtgcaatcttggctcactgcagcctccgcctcccaggttcaagcaatcctcctgcctcagcctcccaagtagctgggactacaggtgtgcgccaccacgcctggctaatttttgtattttcagtagagacagggtttcgccatattggccaggctggtctcaaatgcctgacctcaggtgatccacccgcttcagcctcccaaagtgctgagattacaggcatgagctaccgtgcctggccatgaaggaagatttgttttaaaaaattgttttctttaatattaattgaacacctctgttcagagcactgggctggtgccagagggtttcagacatgaatcagatccagcacctcatagagccttaactctggcacacacacacagccacaaggagacacagacaaggcagggtaggatgagtggaagctaggagcagatgctgatttggaacacttggcttctgcagtgaagccccttcttagtcctcttcagtaacccagctctcagtggatacaggtctggattagtaagatttggagagatgattggggattggggagagctctctaacctattttaccacctcctcttctgccattcttcctgtccacatcccagcatccctttcccttgccaagtatctgtggcctctgtagtcctttgtaaacagctgtcttcttaccctacagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcaggttggtatcctgcctttttctcccagctcacagggtcctgggacgtttgcctctgtctaaggccacccctgagccctctgcaagcacaggggtgagagaagccttgaggtcaagaatgtggctgtcaacccctgagccatctgacaacacatatgtacaggttggagaagagagaggtaaagacatagcagcaagtaatctggataggacacagaaacacagccattaaaagaaagtttaaaagaaggaaattcacccaaaccatttgaatacagtaagtgtattcatctttcgatattcccctgtccatatctacacatatacttttttttatagtaaatagttctgtattttgccctgcatttcccttgtgtttactatccagtcttcctgtttatcatttttgtcgacaacatgaaattctattgagagactgtctgaacatattgtaatgtagatgttcaggtttttccagtttctctttacaataggtatttaactacagtgagcagttttatgcatttagctaatttctcctttgaggaagtattttcaaaattacctttattcttctcaggtaataatttcattattaccaaagttaccctaggtcttttcaagtgtgtggttaaaaaacgagaatctggctgggcgcgatggctcacacctgtaatcccagcactttgggaggctgaggctggtggatcacctgaggtctggagttcgagaccagcctggccaacatggtgaaaccccatctctactaaaaatacaaaacttagccaggcatggtggcaggtgcctgtaaccccagctacttgggaggctgaggcaggagaattgcttgaacccaggggcggaggttgcagtgagccgatatcacgccattgcactccagcctcggcaacaagagtgaaactctgtctcaaaaatggggttcttttcctgccatcaaaaatcatgtttcttttaaaaacaagttcaaacattaccaaagtttatagcacaggaaatacgtcttctgtaatctcccttaaccaatatatccctcaacattctcctcacccccaactccaccctcccaggataaccagttgggacataatctttatttaaaaatggtttccggatagagaaagcgcttcggcggcggcagccccggcggcggccgcaggggacaaagggcgggcggatcggcggggagggggcggggcgcgaccaggccaggcccgggggctccgcatgctgcagctgcccctcgggcgcccccgccgccggcctcgccgcggagccggcgagctaacctgagccagccggcgggcgtcacggaggcggcggcacaaggaggggccccacgcgcgcacgtggccccggaggccgccgtggcggacagcggcaccgcggggggcgcggcgttggcggccccggccccggcccccaggccaggcagtggcggccaaggaccacgcatctactttcagagccccccccggggccgcaggagagggcccgggctgcgcggatgatgagggcccagtgaggcgccaagggaaggtcaccatcaagtatgaccccaaggagctacggaagcacctcaacctagaggagtggatcctggagcagctcacgcgcctctacgactgccaggaagaggagatctcagaactagagattgacgtggatgagctcctggacatggagagtgacgatgcctgggcttccagggtcaaggagctgctggttgactgttacaaacccacagaggccttcatctctggcctgctggacaagatccgggccatgcagaagctgagcacaccccagaagaagtgagggtccccgacccaggcgaacggtggctcccataggacaatcgctaccccccgacctcgtagcaacagcaataccgggggaccctgcggccaggcctggttccatgagcagggctcctcgtgcccctggcccaggggtctcttcccctgccccctcagttttccacttttggatttttttattgttattaaactgatgggactttgtgtttttatattgactctgcggcacgggccctttaataaagcgaggtagggtacgcctttggtgcagctcaaaaaaaaaaaaaaaaatgatttccagcggtccacattagagttgaaattttctggtgggagaatctataccttgttcctttataggccaaggaccgcagtccttcagtaacaccagtgtaaaagcttgaggagaaattgtgaagctacacagtatttgttttctaatacctcttgtcattctaaatatctttaatttattaaaaaatatatatatacagtattgaatgcctactgtgtgctaggtacagttctaaacacttgggttacagcagcgaacaaaataaaggtgcttaccctcatagaacatagattctagcatggtatctactgtatcatacagtagatacaataagtaaactatattgaatattagaatgtggcagatgctatggaaaaagagtcaagacaagtaaagacgattgttcagggtaccagttgcaattttaaatatggtcgtcagagcaggcctcactgaggtgacatgacatttaagcataaacatggaggaggaggagtaagcctgagctgtcttaggcttccggggcagccaagccatttccgtggcactaggagcctggtgtttccgattccacctttgataactgcattttctctaagatatgggagggaagtttttctcctattgtttttaagtattaactccagctagtccagccttgttatagtgttacctaatctttatagcaaatatatgaggtaccggtaacattatgcccatttctcacagaggcactactaggtgaaggagtttgcctgacgttatacaaccaggaagtagctgagcctagatcccttccacccaccccatggccctgctcatgttccacctgcctctaatttacctcttttccttctagaccagcattctcgaaattggaggactcctttgaggccctctccctgtacctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgtaaatccaatacttgcctgaaagctgtgaagaagaaaaaaacccctggcctttgggccaggaggaatctgttactcgaatccacccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcacaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtattaatgcaatgtgtggtggttgtattggagcagggggaattgataaaggagagtggttgctgttaatattatcttatctattgggtggtatgtgaaatattgtacatagacctgatgagttgtgggaccagatgtcatctctggtcagagtttacttgctatatagactgtacttatgtgtgaagtttgcaagcttgctttagggctgagccctggactcccagcagcagcacagttcagcattgtgtggctggttgtttcctggctgtccccagcaagtgtaggagtggtgggcctgaactgggccattgatcagactaaataaattaagcagttaacataactggcaatatggagagtgaaaacatgattggctcagggacataaatgtagagggtctgctagccaccttctggcctagcccacacaaactccccatagcagagagttttcatgcacccaagtctaaaaccctcaagcagacacccatctgctctagagaatatgtacatcccacctgaggcagccccttccttgcagcaggtgtgactgactatgaccttttcctggcctggctctcacatgccagctgagtcattccttaggagccctaccctttcatcctctctatatgaatacttccatagcctgggtatcctggcttgctttcctcagtgctgggtgccacctttgcaatgggaagaaatgaatgcaagtcaccccaccccttgtgtttccttacaagtgcttgagaggagaagaccagtttcttcttgcttctgcatgtgggggatgtcgtagaagagtgaccattgggaaggacaatgctatctggttagtggggccttgggcacaatataaatctgtaaacccaaaggtgttttctcccaggcactctcaaagcttgaagaatccaacttaaggacagaatatggttcccgaaaaaaactgatgatctggagtacgcattgctggcagaaccacagagcaatggctgggcatgggcagaggtcatctgggtgttcctgaggctgataacctgtggctgaaatcccttgctaaaagtccaggagacactcctgttggtatcttttcttctggagtcatagtagtcaccttgcagggaacttcctcagcccagggctgctgcaggcagcccagtgacccttcctcctctgcagttattccccctttggctgctgcagcaccacccccgtcacccaccacccaacccctgccgcactccagcctttaacaagggctgtctagatattcattttaactacctccaccttggaaacaattgctgaaggggagaggatttgcaatgaccaaccaccttgttgggacgcctgcacacctgtctttcctgcttcaacctgaaagattcctgatgatgataatctggacacacaagccgggcacggtggctctagcctgtaatctcagcactttgggaggcctcagcaggtggatcacctgagatcaagagtttgagaacagcctgaccaacatggtgaaaccccgtctctactaaaaatacaaaaattagccaggtgtggtggcacatacctgtaatcccagctactctggaggctgaggcaggagaatcgcttgaacccacaaggcagaggttgcagtgaggcgagatcatgccattgcactccagcctgtgcaacaagagccaaactccatctcaaaaaaaaaaatctggacacaggctgcagttgtcactttccagtaacagggcgaggatgaatgaagaaaaggcccagagcttgccacataggtgttgacaaggtaacccaaagcttctcaacttacacggagggttcctgttacccctcaaaaacttggcaatgtggagtctttttttttttttaattaagtcaaatgcagagcaatttcccacactatatgcaggtgtcagaatgaggtatataaaacatgtatatagagaaatgcctttatagaaaagtagaaaccagtaatattctcttctccagcatcactaacaccaagagaccacctgaggtctaggtccccaaagcagatggctccatagaaagccccactaacccgtctccacattgggcagtggaagggttctggaaaggaagctctatggctaggagctgccaaggcctcttgagtgtgacatcacaggttagaggccctgctgagctgctagcacagtgcagtggagaaatgttgcgctccgtcaggaagctgggctcttgccatgccagtagcttgcttacgaccttgggcaagtcactttttcctctctggggtcctgtgtccaaaaggcttaatgagccctttctaatggttctttgattgcttta

SEQ ID NO: 12502 - DNA, 64171 bp, Human
  misc_feature (1)...(64171): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgatcgattgattcgtagttcccccccgcgcgcctttgccctttgtgctgtaatcgagctcccgccatcccaggtgcttctccgttcctctaaacgccagcgtctggacgtgagcgcaggtcgccggtttgtgccttcggtccccgcttcgccccctgccgtcccctccttatcacggtcccgctcgcggcctcgccgccccgctgtctccgccgcccgccatggcgactgcgacccccgtgccgccgcggatgggcagccgcgctggcggccccaccacgccgctgagccccacgcgcctgtcgcggctccaggagaaggaggagctgcgcgagctcaatgaccggctggcggtgtacatcgacaaggtgcgcagcctggagacggagaacagcgcgctgcagctgcaggtgacggagcgcgaggaggtgcgcggccgtgagctcaccggcctcaaggcgctctacgagaccgagctggccgacgcgcgacgcgcgctcgacgacacggcccgcgagcgcgccaagctgcagatcgagctgggcaagtgcaaggcggaacacgaccagctgctcctcaagtgagtgctagctggcggccgcgttagcgccaaggaggggcgggggcgcaaccgcggcgaccagctcaccgggttctgccgtggggagggagcagaggccaggatgcacgcgtccttctgaaggaacagggtctcggtctccggaaaggagaaagaatctagagttcatagcggagcaggggtcgcggagggggctcgagctgtagcgctggggggccgtgatgcccatttctagattttggatacccgctgggacgtggtaagtgcgcgcctgggactgccgagaaggagctcccgctttcgcactcgaatccggggagccggcgcggagaggcggcccctcaggccccaggtgcggggagctggagcgcgagcgcgcgctcgcgtgcgcgccccagtttccggccggcgcgagacaaagcgtctagcggatttgcagtgccgggatgggcggccggggaggactggcagcccgcctctagaatgaatgagcttcgcgcgggcagagagaggaaggggagggaccttcccgcagcatccgcgtctcctgggggtgggtcccgctttggcgcgctcagtcttggccctgtgacgttttgcgaagattctacgcctgctttaggcgggagagagaggcggagcttgatccgtgcgcctccagccagccccgggcaagttaggtttgctagctggttagctttctctggggaaatgtgtcctgtcccagcgggactggtgcggtccctcgggtggttctgcgcagggaaggaaagctgggtttgtgcatgtcacggctaccgttcttagaattgcggttctcctacccctcaggcagcggccctctgtccccagcttttgcctcctcgtagtatagtcaggctttcgggtagagactgtgcttagtaccccttagtcgaccactgtgcagatagtagaccagggcaggtgacagggtgctgtgtaaatgctgagtgtttgagcgaaggagagtttgtaattcacctaagcgagtgcgagttttcattccagtgcacaaggatacatttgcagacctttgctggccttattttgactttctgataagcaaaatggcctgtcatcagtaggcaacaagtgttgatgtcatgctttagagatttgcaaaatttgggtctgaaattcatggtcgccattagcactgccagctgaaatttctggaggtaccttattctcactttgacaccctttgcccctggatgtctttctgtctgtatctgcgtgaatgtccctgtccgaagtctctgagattttgtgtatttttacttatccctcctatcatatgttttcggttcataaaaaagcatgtgcacgtggtaagaataaaatagtatagactggtttgtagcgaaaaacgataactgcactacctctttccggaggcaatcacatttatccctttttgtttttatttctttggatatttagttatacaactcgaaaataatactaagcttgtatttccctttcttggatttactaagccttggtttcatcttttaaaatgagcagtcagttaactcacactattatttctatgttcctccaaattttttgccactgaattccttcaaatcttagatatcgttgcttgtaagacttgccattattatgtgtaccactaagaaaataaaaacatcaggaccaactgtgtaggatccatcctgttggacccatcatgatgggtttcatagatattaaaatgtcaaacagggccgggcgtggtggctcacgcctgtaatcccagcgctttgggaggcgaggtgagcggatcacttgaggtcaggagttcgagaccagcctgaccaatatggtgaaaccccgtctctactaaaaatacaaaaattggccggacgcgggggctcacgcctgtaatcccagcactttgggaggccgaggcgggcggatcacgaggtcaggagatcgaggccatcctggctaacaaggtgaaaccccgtctctactaaaaatacaaaaaattatccagacgtggtggcatgcatctgtagtctcagctacttgggaggctgaggcaggagaatcgcttgaacccaggaggcggatattgcagtgagctgagattgcgccattgcaccccagcctggcgacagagtgagaccccatctcaaaaaagaaaaaaaatccgggcgtggtggcgggcgtctgtaatcccagctactggggaggctgaggcaggagaatcgcttgatatccaggaggcagaggctgcagtgagccagatggtccactgcactccagcctgggtgacagagtgagactccgtctaaaaaaaaaaattaacacagatcaaatatctgttgcgtaccagtcaccgttctatgttagaggatatgaagatttttttaaaaaaatgaattactgttctttgttgctgagagtgtagtgggggagctatatcccagcaagtaaagaaagattgtcttttgtctgatgtgaagcattttgatgctggcgcttttgtaatctttccaggagttagccacaggaggtttttcacacagtaacaaggctgccacctggctgacagtagttgtaaatgtatcgattctaaaatgcatgctggtttcagcggggttaaaaaatgagaataatgtgtattagaatcaatgaaataatgcatgtgatacaatttaggtaatagcagatgctaagggaataaaaataaagcggagtgaagggttagtgtgattaaggaaggcctgtctgaggagttgacagtacctattctctgagggttagtagtgttctgggattatatttttcttaagtctgtgctactgtatgtatattcctattgccaggattagatgactcttcttttccccccaacataccatcatttgctcaaaacatgccacattttagtttgctccttatttgaattaggactttttttatatggatttattcctcaatagcttttcatttttcttgttaagaaaaatttgccctcagtgtgtttgcagactttttgaagatatttaatcataatatctatcacatgaatctgctttcttccctagagttctctttgcttaaggtaggctgtgtactgatgtcctgtaacttattaaagacagcttcctggccaggcacggtggctcacacctgtaaagcactttgagaggcctaggcaggtggatcacctgaagtcaggagttcaagactagcctgtccaacatggcgagaccccgtctctactaaaaatacacaaattagccgcgtgtggtagtggacgcctgcaatcccagttactgtggaggctgaggcaggaggcattgcttgaaccggggaggcggaggttgcagtgagctgagatcacaccaccgcactccatcctgggtgtattttccttttccttggtttcttcatattttgttgaagaacatccttaagtaatttattcagaaaggatggcaggaggtaaactttctgagtcctgtatgtctgaaaatagctttgggctaggtatagaatactaggttaacatttttccagaacttggaaagtattattttgccctattgtcttctggcatctagggttgttaatgtctttcttttttttttgagacggagcttggctcactgcaacctccgcctcccaggttcaagcgatgctcttgacccagcctcccaagtagctgggattacaggtgtgcaccaccacacccggctaattttgtatttttagtagagacggggtttcaccgtgttggccaggctggtctccaactcctgacctcaggtgatccacccacctcggcctcccaaggtgctgggattataggcgtgagccaccatgcctggcctatatttaattttttatttggaactagagtgtttgtaattaagtataatcatcatttaggtagatttagattaagaaaacagctttgagagaattatagattccaggttacttagtttctttttggttcctcagcaaacaagataccttagaggcagagcatggaaatgcttggtctaaagagaatttggcaacagtttccatgcaggtggtgtctgaatccatagaaaacagacctcatatgtaaggtacagttactttgattcagtccaagactgattatattttgctgaaagcttttttgagagaacagtttccaaaaatgatgatgaatgccatcactcaacactttaaacaaaaagtacagagaaattgacttgtttcagattttcactgttaactatacgggaaaactagatataacagaaagttaagtgtttacatcagtcttcaataactgattttgtggattcagacatttattttccttcagtgatacaggtcccgtatcttttctgtaaaaccctgggggcccgatgtgctttggaagttaaagcaattccaatttaagacggtaatatgatgcacatactggatatgacacccccagtggggtttatagatagagttagggtagatagagttagcactctatcatgaaacatttctgagggaaagatattgtcatggcaagtggagaaagacagattgaaaatagacctggtttcaggtcaggttttgccactaaatgtgttaataaaaattttaggttttcaaactctggaagtatagataaaagatggtgaatttttgtttttatttatttattttttgacacagagtctcgctcttttgcccaggctggagtgcagtgacacaatctcagctcactgcaacctctgcctcctgggttcaagcaattcttctgcctcagcctcccaagtagctgggattacaggcacccgccaccacgcccaggtaatttttatatttttagtagagaccaggtttcaccatgttggccaggatggtcttgatctcttgacctcgtgatctgcccgcctctgcctcccaaagtgctgggattaccaggcgtggccactgtccccagcttatttccttttcatggtaaataattttagtttgttgggttttgtttgttttgttttgtttttgagacagctctgttgcccaggctggagtgcagtggcgtgatcttggctcactgcaaccttggcttctttgggttcaagcgattctcctgcctcagcctcccaagtcgcagggattacaggtgcccaccaccatgcctggctaattttgtatttttagtagagacagggtttcactatgatgggcaggctggtctcgaactcccaacctcaggtgatgcgcctgcctcagcctcccaaagtgttgggattacaggcgtgagccaccgggcccagcctggttttttattaattacaggttattcacggccattctctctaaagtcaattaattagttgtagaaagcttnnnnnnnnnnnnnnnnnnnntagtagagaccaggtttcaccatgttggccaggatggtcttgatctcttgacctcgtgatctgcccgcctctgcctcccaaagtgctgggattacaggcgtgacactgtgcctggtcaaaaacatgctaatcttctttaggagtgttttctttgtacataggatgattaattgaaaaacaaaaacctttggctgggcgtggtggctcacgcctgtaatcctagcactttgggaggctgaggtgggagggtcatgaggtcaggagttcgagaccagcctgaccaacactgtgaaaccccatctccataaaaatacaaaaatcagccgggcgtggtggtgcacgcctgtaatcccagctactttgggaggctgaggcaggagaatctctcgaacccagcaggtggaggttgtagtgagccaagatcgtaccactgcactccagcttgggcgacagagcgagactctgtctcaaaaacaaaaacaaacaaacaaaaaaaccacaaaaaacaaaccttcatcatcctgtgtattactatatctttttttaatgtactgattttgccctatttgaagcagattgacagtatacatcttggccttaatataagagttatcaaacttttatatttttataactcttaaaatataagagttataaaactagttttctttataagagttataaaactagttaaactgcttttcatagttcttttataacagagttatgttaaatgttactttaattttcaagggaagacttggaaggaccaaacccctaaaaatgatttaaaagtctaggaagcaggtcccaagtaattaaactgtcatgacatttccttcccatgctttcaaaagatgtttgataaagcaagatcttttggagttgtttatttaacttaggggatgagactaggtaatattttgcatacccagattcaaggaagtaaacaggcagaatgaaagataaagcactattaaaatatggtgggtcttttcttttttgtgtctttacacagttgctggttatatttattctttcgtttgtatagatggtgtcacctctgatatgtctgagttagaaatcttcagactttttttttatgccattagtgtaagtctctttcatgtacaaatgttgagaatgagcctcaggtatcagttgagtaatgggaccctgtataggtcccattatttttaggatcagggaagtttttaaaatcagttttaaaccctttttacagtgtacctctttgataaggagattgtgctttggctgtcatttgatttttttttttttttttttttttttttgagacagagttttgctctcgttgcccaggctggagtacagtggtgcgatctcagctcactgcaacctccgcctcccgggttcaagcaattctcctgcctcagcctcccaagtagctgggattacaggcatgcgccactacacccggctgattttgtattttttttttaatagacttggggtttttccatgttggtcaggctggtctggaattcccaaccttggatgatccgcccgccttggcctcccaaagtgcggggattacaggcgtgagccaccgcacctggccggctgtcatttgaatttttattattttattttattttatttttttgaggcagggtctcgctgtgtcgcccaggctggagtgcagtggtgcgatctcggctcactgcaacctccgcccctccaggtttaagcaattctctgcctcagcctccggagtagctgggattacaggcacgtgccaccacgcccggctaattttttgtatttttagtagagatggggtttcaccatcttgcccaggctggtcttgagctcctgacctcgtgatccacccgcctcggcctcccaaagtgctgggattacaggcgtgagccaccgtgcctggcttgaatttttttttttttttgagacggagttttgctctgtcgcccaggctggagtgcagtggcgccatctcggctcactgcaagctccacctcccgggttcacgccattctcctgcctcactcagcctcctgagtaactggaactacaggcgccctccaccacgccgggctaatttttttttatatttttagtagaggctgggtttcaccgtgttagccgggatgggctcgatctcctgacctcgtgatccgcccgcctcagcctcccaaagtgctgggattacaggcgtaagccactgccctccgcccgaatttttaaaaattaattttattattattatttttgagacggagtcttgctgtgtcaccaggctggagtgcagtggcacaaccttggctcactgcaatctctgcctcccgggttcaagtgattctgccgcctcagcctcccaaatatctgggattacaggcacccgccaccatgcccggctaattttttttttttttaatttctagtagaaacggggtttcaccatgtcggccaggatcatctcgatctcctgacctcgtgatccgcccgccttggcctcccaaagtgctgggattacaggtgtgagccacggtgccctgcctaaaaattaattttttttttttttaataactgagtcttgctctgtcgccaggctggagtgcagtggcacgatctcagctcactacagcctctgcctcccgtgttcaagcaattctcctgcctcagcctcctgattagctgggactacaggcacacgccaccacgtcggctaattttttttttctttttctttttctttttttttttttgtattttagtagagacgaggtttcaccaggttgcccaggcttgtcttgaactcctgagctcaggcaatatctgcctgcctcagcctcccaaagtgctaggattacaggtgtgagccacggtgccaggccaaaaattaaattttttaaacagcaaatgtatattcattatagaaaaggagaaaacacaaacaccaagaagaaaattcttggttgggccttaggttgggcccaacccttaggttgggaccagcggctcatgcctgcaatcccagcacttttggaggccgaggtgggcggatcacctgaggtcagcagttcgagaccagcctggccaacatggcaaaaccctgtatctactaaaaatacaaaaattagccgggcatggtggtgggcacctgtaattctagctacttaggaggctgaggcaggagaactgcttgaacctgggaggcagaggttgcagtgagccgagatcgtgccactgcactccagcctgagtgacaaagcaagactccctttggggggtgggggaaaagatgcaggaaaaaaaaaagctgacatttattttgtgccaattctgtttgccaggcattacagtagatgctttacagacattatcttttttttttttttttttttgatgcagagtctggctctgtcgcccaggctggagtcctggagtgcagtggcacgatctcggttcactgcaggctccatctcttgagttcacgccattctcctgcctcagcctcccaagtagctgggactacaggtgcccgccactacgcccggctaattttttgtattttttagtagagacggggtttcactgttagccaggatggtctcgatctcctgacctcgtgatcctcctgccttggcctcccagagtgctgggattacaggcgtgagccaccgttcccggccagacattatcttttaagctcatgataactgctgatgagtaaggaaacttcaggctcagagagtttaagtattttgcctggtattacttagcaagtaatgaaagctagaaaggatggtagcctgacttctagcattgtgatagggtgttcacatacataaccttatttcatccatacaacagtgttctacaggtattactctggtttaccgacatgtagcaggctcacagagcatcattatctgtggttggtacttgaagtctcagataggatagttgattttcagatccctttgggtgctacttttggaaatgctactagttgcatgtttttcacgttgatagtttgtagccttcaagggaggtaattttggatttgtcagaagggtagtggtcagtagttgaaacagctgtttgaaatactgagggcttcatttgctaaagaaaggtgaagatgaattactgaaagagatcgcttttatcttttttctcttcttaaaaagctactttccaactttattccatgccttaataatttaaaagaaattaaaacctctaaataaatctttaatactcatgacagggtgttctttcattctttattcaagacacatttttgtggaacaggtactatatgccaggtcttgaaccagatgctgggaatagagaaatgggatactcagtccccattatcaagttacttacagtctagtggggaagacagaaaaccaacactacaggattgtgatactgtaagtgcagtatactaataaaatatattaagtgctgtgatgccagtatccaggtgttgctgtggagaaacaaggaccgctacctaaggcaggctaggagccgtgtgaaattttgaaagacatcccaggggaatctgagctaagtgcagggaggtaagtagggatttgcttctaaatggaaaatggagagtgagttgtcctgaatgtcaaataatttatataactggagccatatatatgtgtatgtgtgtgtatatatacatcttatatgtatatgttatatataacatatactttatgtatatgttacttatatatgaagtatatgttatatataacgtgtgtgtgtgggggtatatatatatatatatatatattttttttttttttttttgagatagagtttcactcctgttgttgcccaggctggagtgcaatggtgtggtctcggctcactgcaagctccacctcctgggttcaaatgattcttctgcctcagcgtcccaagtagctgggattacagccgcctgccaccacactcggctaatttttgaatttttagtagagacagggtttcagtatgtttgccaggctggtcatgaactcctgacctcaggtgatccacccacctcggcctcccaaagtgctgggattacaggtgtgagccactgcacctggcctactggagccatatatatatttaatacatggggtggggaaggggattgtatttttagtaatgagtggacccaagattttaaggcagaattgtgacatgatcattctggctatgctgtggagggaaaaaaagaggagaggtacaaacactagtaagaacacttggggagtaacaaggcagcccttgaactgaggcaggtggaagaaaggagagaaggtggatttaagagatactgaacataaaggactagggagaagaaagagtctagggtgactgcttccatgcttgggtgcctgagtagacaatattgctcttaaccgaaattggtggggaatgaacaggtttggaggaccctaagtcagtgaattagtggtgtttgccggactttaggtagcaatgttagttggcaatttgaagtactcaagagacatggaaagcatgcgcatatgaggactgggtagagaaaggagaacccacaatggggatgataagtaatagagaggtgaggctgggcgtggtggctcatgtctgtaatcccagcactttgggaggctgagtgtgtggatcacttgaggccaggagtttgagaccagcctgggcaacatggcgaaaccccgtttctactaaaaatgcaaaaattagccaggcgtggttgcacatgcctttaatctcaactactgtggaggctgaggcaggagaatcacttgaacctgggaggcggaggttgtagtgggcggaggttgcagtgagctgagattgcgcctctgcactccagcctgtgtgacagagggacacttcgtcctaaaaggtgagaaaagagaggtgagtcatggaacaagggttttttgtttgatgaagcctaaaaagtatctgttgtcattggtgtttttggtgccttaggtgattgttgactgagaggagagcctttggttaatagaggaaaccactggccataattaaggggagaatgagaggaaaaagattatgagtttagaatacttgtttaagaatgttggcagtgaagggaaggagacaagtttttttttgttttttttgttttttttttttgagacaaggtcttgttctcttgccggtgctggattgcagtggtgcatggttcactataacctggacctcccaggctcaagtgatcctcccacctcagcctctggagtagctgggactacaggcacacaccaccacgactggctaattttttgtggggagagggttttgccatgtttcccaggctggtcttgaactttgagctcaagcaatccgcctgcctcggcctctcaaagtgttgggattacaggtgtgagccactgtgtctggcgggagggaggcattcttaagggtcaatttaaactagattcttactcagtgtttatgtaacaaaacattggacaggggaccagaacccttatctctctaaggttgtgtcctaaaatgtgatcatttcaccccttttggtataaaacattttagtagcttctagggtaaagactaagaccctactaatagtagggtgaccatataatttggcatccaaattgggatacttttgtgtatgaaagagggagctgttaataattatgcagtgacagctcgcataaatggaacttgtccttggcaatctgggacatatttgcccaggttatcctacctaaaagttctttccctacatgggctggtcccagtctgaccctccagcttcatctcataccacagttgaacttgtttactcctctttagccatgaaatcctttattcagtcccgtttactgtgatcctcttaaaatagggactttgcatttggagtttcctttgaattttttttttgaggacgagacttgctgtgtcttcttggctggagtgcagtggtgtgaccttggctcactgcaacctctgccttccagtttcaagtgattctcctgcctcagcctcctgagtagctgggactacaggcgcctaccaacgagcccgactaattttttgtatttttagtagagatggggtttcaccgtgttggccaggttggtctcgatctcctgacctcatgatccacctgcctcggcctcccaaagtgctgggattacaggcgtgagccactgtgcccggcctaattttacatttttaatagagatgaggtttcttcatgttaggctggtcttgaactcccgacctcagatgatccgcccacctcagccttccaaagtgctgagattacagacatgagccactgagcccggccttattttattttatttttgagacagtcttgctctgttgcccagactggagagtagtgagtggtatgatctctgctcagtataacctccacctcccacgttcaagtgattcttgtgcttcagcctctccagtagcggggattacaggcgtgcaccaccaagccctgtgaatttttgtatttttagtagagaaggggttttgccatgttggccaggctggtctcgaactcctgacctcaggtgatctgcctgcctcggcctcccaaagtgctgggattacagatgtaagccaccacatctggtctgctgtgttatttttaatttgtgcagaatgcaggagttgtcagaagcaacatatgttatagcagaaatacttacatagtccccagcagaactcagtaatatactgtgattagttttttttgcctatcacaccttttgatcacctataaaaatagtactttttcccacttacttttttgtataattatatagagtctatgccagttgttagaacatcaaatcatttaggatcatttttaaattaattttacctcattaaataaagaattacctttgggtaccttgtgtttttctacagtctagttgtattgtataagcattgatagtttgggtatagaattctaggttgtaaatgctattttcttagacttttgaaggcatgttttggccgaggtgggtggatcacctgaggtcaggagttcgcaaccagcctggccaacatttgtactctactaaaagtacaaaaaattagccggtgtggtggtgggtgcctgtaatcccagctactcaggaggccgaggcaagggaattgcttgaacccgggaggtggaggttgcaatgagcccaggtcgcgccattgcactccagcctgagcgacaagagcgaaactctgtctcaataaataaataaataaacaaataaacaaataaataaataaaatgaagacgtgttctttagttttctagctttcattggctgcagaagtaatgatgagtgaaaaatttaaaagcttgtaggatcttcttttgatccagttctaaaatttcacagggatgttccttgttgtagatctcttttcatccattgtgttcatcatctgattgaattcttttggtcttgaaatttatgtccttcagttgttggaaattttcttgagattttctcctcttttattaccatatgagactcctagtattcaaatgttggatctcttacattgatcctttggttttcttcccttttttaaaaaatattttttctctactaagagatgttctcaattttgttttccaatttttgctattgtattttaaatttctaatagcttctttttattctgtctcttttttttaaagatagggtcttacccttgcccaggctggagtgcagtggcatgatcttggctcactacagcctcaacctcctaggctcaagtgatcctctcaccttagcctctggagtagttgggactactactggagtagttgggtgtgtgccactacacctagctaatttcttgatttttttcatagagacagggtcttactatgttgctggtctcaaactcctgagctcaagtggtccttctgcctcagcctcccaaagtgttgggattacaggtgtgaaccatcatgcctagccttttttattcccttgatgtctctttttttgtttttgagacagggtcttgctctgttgcccaggctggagtgcagtggtgcgatcttggctcactgcaacctctgcctccgtgttcaagtgattctcatgccccagcctcccaagcagctgggattacaggtgcccaccatgacaccgggctgattttcgtatttttagtagagacggggtttcaccatgttggtcaggctggtctcgaactcctgacctcaagtgatccacctatcgctgccttccaaagtgctgggtttacaggtgtgagccactgtacccagcctattctcttcttgatagctctatagcattgtttttgtctaaatttgatggatttggttcctttttttttttttttttggagacagagtcttactctgtcacccagactggagtacagcggcatgatcccagctcactgcaacctccgccccctgtgtttaagtgattctcctgcctcagcctcccgagtaactgggattacagacacgtgccattacgcctggctaacttttgtatttttagtagagatgggattttgccatgttgaccaggctcgtcttaaactcctgacctcaggtgattcgcctgcctcccaaagtgctgggattataggcgtgagccactgtgcctggtgtgtttggtactttctcttatctttgcagaagtcttcattgtccttcatagtccctctttgctaagttaatttctttttctgtttaggtctttgtgtcatcactcagtgcagggaacagaaagcactagggattttttttttttttttttttttttttgagatagagtttcactcttgttgcccaggctggagtgcagtggcgcgatcgcggctcaccgcaacctccgcctcccaggttcaagcgtttctcctgcctcagcctccctagtagctgggattacaggcatgtgccaccacgcctggctaattttgtatttttagtagagacggggtttctccatgctggtcaggctggtctcaaactcccgacctcaggtgatccacccgcctcggcctcccaaagtgctgagattacaggcatgagccaccgcgcccggcagcactagggattttaagcagaaagggaaacaatatgagatgtaggtgcttagaaatgatttttagagaggctagaggagcaataatgatgcttagaacattgttgtagaactgaccttctttgggagcttttatgtgtgaggccaccaatggaaccagtaaactgttttaaaaacagtatatagctactattcaggactaggaagctgccactgctattgctttaggaatagctgcctcataacacccagcaaactggagaatggacattggaacactgtttcagaaatattttacacccaggtcagtgcctagcacattgtagatgagtgacaaaggtagtagttattggtttttctttttctttttaaatgaatcagtcatttaaattaagacttaatctgtacgagtctgctccatactcctgtgcctgtttatgttacagtgatttttttttttgtttcaaagaagtggttttgtggtccagtttcaatctcatttagtatttttcctaattttacccgagtttcaactagagtttgcctgagtctgattaggttgttgctaattctttgacagattagtttattcagtgagtagcagaattttattggcaccggaaactatcctttgtaactttgagtttatgcaaaagcatcttcttagtctttttgcatatgccagaggagacccttgttaatagaaattgtgatcacaaggccgggcatggtggctcacgcctgtaatcccagcactttgggaggccgaggcaggtggatctcctgaggtcaggggttcgagaccagcctggccaacatggtgaaaccccatctctactaaaaataccaaaaattagccgaatgtagtgtcgggcgcctgtaatcctagctactcaggaggctgagacaggagaatcacttaaacccggaaggcggaggttgcagttagctgagattgcgccattgcactctggcctgggcaacaagagtgaaactccatctccaaaaagaaagaaagaaagaaagaaagaaattgtgatcataagaccttctagagtttttgtgtaatttttttttttgagatggaatctcgctttgttgcccaggctggagtgcaatggagtgatcttgactcactgctacctccatctcctgggttcaagcgattctcctgcctcagcctcttgagtagctgggattacaggcatgagccaccacgcccagccaacttttgtatttttgtatttcaccatgttgaccagtctggtctctaactcctgacctcaggtgatctgcctgcctcggccccctatagtactgggattacaggagtgaaccaccgtgcctggccgagtttttgtgtattaagttatatttgttttaatttcggggaagttcattaattttcctttggaaaaatactgtggatcacatcctttttccctttggaagggaagttaacatgaggacagtgttgaagctgatgagtggctgttggagcaaatgcatgcttgataagcagtttgagcctgttacgaaataaaattatctagttttaggacaaggtttttatgtgggtatattttactttaaattgaaaataaggtttattttttctctaaaggtctggagcatggctagatataagagacatggcatgttgatgctgagctctgggtgtgaagagatccccagacacggatttgtgtgatagtcacttgagtactgcactagtgttgagtggtgttcaggggctaccagacagctgttcagaagaaccttacagtatatgaaagcaggaacagagcttagccagctaggcctaattggcctggctctgtatgtacagtgggtctgttttaagggatttaaaaatccttgttttgtggctttgattagaaataagaattttgtatagaatgatttctgttagctgattacaggtgaaaaactaaatggcttttctctttcatctcctgtaatatatttgtttttctaaataagaatgggcctgaggtgaaatgttagggataggtactgacacaaactgaccaagagaatgttaacaggtgggcaataatttgccgttaccaaattaattaaaactattttgtaatgagcttcagattatgttgtatttgtccctgcaagtttacttattgatttgtttcacactaattctttgttccctgtttaagtggacaatcttattttttcaagtgtttatggttggaatatgctaactaattccttttcctttttttttttttttaaataaggatcttgctctgttgcccagagcgacagtggctggagtgccgtggcatgaccacagctcactgcagccttaacctccctggcccaagcaatcctcccatctcagtctctctagtagctgggactacaggcacaggccactactcccagctaatttttgtattctttgtagaaatggggtttcaccatgttgcccagggtggtctcgaactcctgggctcaagcattctgcccattttggcctcccaaagtgctaggattacaggcatgaaccaccgggcctggcctcctaattcattttcaagtagttattgttattgcaggcctggaatgactttctgcatgttatgtatgtggtatgacttttggaagaatgtaccctaaagttatcacctagtaatgatatatttctctaagagttccattgagggttcattttccagcgattctgtgattggatgtggtttttttgtttgttcatttgtttgttttagatggagccttgctctgtcgcccaggctggagtgcaatggtgcgatcttggctcacagcaacctctgcccccccgggttcaagcgattctcctgcctcagcctcccgagtagctgggattacaggcatgcacaaccacacctggctaatttttttgtatttgttagttagacggggcttcaccatgttggatcaggctggtctcaaactcttgacctcatgatccgccttccttggcctcccaaagtgctgggattacaggcgtgagccactgcgcctggcccaggatgcttttttttttttttttttttttgagacggagtttcactcttgttgcccaggtgggagtgcaatggtgcgatcttggctcactgcaacctccgcctcccaggttcaagcaattctcctgcctcagcctcccaagtagctgagattacaggcatgcaccactacgcccggccaattttgtatttttagtagagacagggtttctctgtgttgaggctggtctcgagctcttgacctcaggtgatccgccagccttagcctcccaaagtgctgggattataggtgtgagctaccgtgcccggccctggatgcattttttaatctcctttttttgccttgccctgtcttcttatggtgctgactgatctctactttctgactggtaggactagtctggagtagggtacacctagacaaatgaaggacacccagggagtgagagagagtcatcctcacagaaggactagtgcagaggccaagcaaagttcagacactaagttccagaaccaagtagttcaatgcagaagccagggttggaaatgaccttaaaacaagtcaaggtcaaactggcggcatgttgaacaaccagcatgattaaagcagcagagtatatggtattgctggtggtagaaggtgcttaggagcattttagaaagtgttaaccaactggatttagattagttctataggcctcaggagaggataggcatgtgtcccagatacatggtactaggttttattgggaaagtacaaccatagtaaagctgtgtatgttagtcttaagtcactgctgtagaatgttagcaggaatataaatatatcctttctagctaattttctttttctttttcttttttctttcttttttttttttttttttttgagatagagcttcgctctttgacccagttggagtgcagtggcacgatctcagctcactgcaacctccacacccccagattcaagcgattctcctgcctcagcctcccgagtagctgggattataggcatggaccaccatgtccggctaatttttgtatttttagcagagatggggtttcgccatgttggccaggctggtcttgaactcctggcctcatatgatccacccgctgcagcctcccaaagtgctgggattacaagagtgagccactgcacccagcctggctaattttctttttaatggccagatacttgattacacctggttacttgttagaccaataaaattcaagcttacttgaaatgaaagctaatttggtttattaagggaggaaattcttaattagcatagaatgccagttacatttataaaactttatttttttctggttgcagttagagtttggttcttctgtaaaacatctaaagcaaatgggtatgttttgtgacttattttcaggagcgtgtatatttctagtattagattcacatgttgaatttaacataggaagatctccttatctggaatagaaatagtttaatcaggcaggtggataacacaacaaatccagtcaggaaatggactcaaagtaaatgtatactaatatcttaagtgttagatagcttctagtaatttaggattcctatctaaattgctctgtgtttggaggcattgtcagatgtcattctgtgcttaggtgatagctgcagcaagtccatgtatgtatgttttaggatatcagttctacaggtttctgcactttgactatgtgctgataattacacttggactttctacattatattgatgaatgaaaaataatatggttagaaaattatgacaagaatatgttcagaatattaactcactgcatggctccccatgtatccttgacaactcatgtgacatagaagactcattgatttggctgagtgcagtggctcatgctggtaatcgcagcacttcgggaggctgaggcggacaggtcacttgagcccaggagtttgaaaccagccggggcaacataggaaaaccctgtcttcccatctgccccagcaaaatacagaaattagccgggcgtagtggcacatgtgtatactcccagcttcttgggggactgagatgggaggattgtttgaacccaggaggtgtaagttacagtcagccatgatcgtggaggattgcttgaacccaggaggtagaggttgcagtgagccgtgattgtgccactgcactccagtctgggcaacagagcgagaccgtctcaaaacaaacaaacaaacaaacaaacaaacaaacaagctgggcgcggtggctcaccgagcctgtaatcccagcactttgggaggccaaggcggttggatcacgaggtcagtagttgaccatcctggccaacacggtgaaaccccgtctctactaaaaatacaaaaaaattagctgggcatggtggcgggtgcctgtagtcccagttactcgggaggctgaggcaggtgaatggcgtgaacccaggaggcggagcttgcagtgagccgagatcgcgctactgcactccagcctgggccacagagcgagactctgtctcaaaacaaacaaacaaacaaaaaaactccaactcattgatttattgctattgtctgatggagacatgggtgtaaccttaagaattttttttcatgattcattcagcctgggaaattggtaggaagaaagagaggatacccatgcatgtgagttttagagattatagaagcatcagttattatttttttcttcttggaagagacatgatattttacataggatgaaaaaagagaagttgtgtgtgtctgtgtgtgtgattttttttccttcctggaaaacacatgatacattttacataggatgaaaaaagagaagtgtgtgtgtgtgtgtgtgtgtgcgtgtgcttgtaacatttagcaaaatagtcattatctgagttttctgtgcagaagatgtaggaataataagtcatgggccttgccctcaaagggtttacagtctcttgaggtagctaagcatatccacaaatacagggatttgtatgatcaatgcactgtaagtgctgtatatgcaagaggaagagatagtagtcagttcttctctctttattagccacttcatgatgcattgactttttttttttttttttgagacggagtctcgtgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacggggtttcaccgtgttagccaggatggtctcgatctcctgacctcgtgatccgcctgcctcccaaactgctgggattacaggcgtgagccaccgcgcccggccgcgatgcattgactttttcactgttaatattgtggcctaaggaggaagaggaaaaatatatgaacacagaacaatttgtttgtggagttaaagggctcacaaggtaaggacagctgtaagaactgtctgccctgagctcccagtgcaggtagccccacaagtcccttttcatcattttacttcagcatctgcaagataagtctttatgctacctagacagctacacacctaagtgtggtgacatggcctagtgcctgaccctgagcagtaaaggtactgagggtccagaagaaggaagggaatactaaaaacgcacttagttgggaccctgtcttatttatttatctttctcttcctggtagtacatagtagatactcagtaatgtctgctggattaggtaaatatgtctcaaaactagggacctggactgagcctttccgcaccgtctcgaaactctcctgtgtacctgtgcataagagtgcatataaatgccactgtacatttgtgtgggttagaaaaagcaaaagtgtgttcataacctcttatgagaagagactataaattactttgcaccaagggcggtagctgactcttgagttctcttcagtgcctggtacaatgcctgctgcccacctgcttgtgaaggctgtggtggcttgtacaggcactgcagggcagatctagattgactatttgggtctcagaataacctgggtcctctgtaacagaggctgagtacttatcttttcatgagttgttatattaaagtaaaattgtaagcactgctttcctgtggcttgcttctttcattttttaacagaaattttattgagtatccccaccctataccagacattgccaggcactgaggatctgaaggtaatctcattttacccacattccagtgtaggagacagacatggaatcttaaattttaaaaagatgtatataccatgcaccatatgagaatgatgcaccaagtgctgtggagcccagaaaggtacatgatttttttctgctaggagaggtaaagcagggaagcattacagaggaaggatgacatttgttccatccttggtcttagtttccaatggcagttggttaggaattagatggagttaggaatgggaatagatggcatggagtgggggagagtgaagtccgaggctcagaaggtctttaggacttagacctgaagggctttctagggggactgccatgccaaggagcttgcatatttcttggtggtcagaagttttcaaactgttttgcagaaaactaggactgttgggatggggcttgatgggacactggaccctacactgtatcttctttttttttttttttttttttttttgagacggagtttcactcttgttgcccaggctggagtgcaatggcacaatcttggctcaccgcaacctctgcctcccgggttcaagcgattctcccgcctcagcctcctgagtagctgggattacaagcatgtgccatcacgcctggctaattttgtatttttagtagagactgggtttctccannnnnnnnnnnnnnnnnnnnctcccgcctcagcctcctggggaagtggggattacaagcatgtgccatcacgcctggctaattttgtatttttagtagcaccgccgcttctccatgttggtcaggctggtcttgacctcccaacctcaggtgatccgcttgcctcggcctcccaaagtgctgggattacaagtgtgagccattgcagccagactatatatatatatatatatatatatatatataatttttcttttttttttttggtggtagggtctcactctctcaccaaggctggagtgcagtggcacgatcagggctcactgcagcctcgacctcctgggatcaagtgattctcccgcctcagcccctctagtagctgggactacaggcatgtgccaccacgcctggctaattttttttatttttagtagagatggggtctcaccgtgttgcccaggctagtctcccttccaaagtgctgggattatagacgtgagccaccgcacttggccaagaagtaatttataacagaacaatttatattttcatagaacagtgttttatgtgactaagaacttgacataaaatgaacagtagaagcattagtcatgattgaaattaaagctcctataaaatttccactggtatcattgggtggccctcagggtaccacaagtaagtactctcttcatcccctgtcctccttatcttctttggtttttatttttatggaagaaatcaccatattctagtcatctggatgtactgccttgggttaatttttggcttcttgtgttttctacactccacaagatgttgaacacagtatctttcacttggtagtatgacatcttgagttttgagctatttgcatgtattacttattaaatctgtgaagtcaaataaacaagaacaatactgcataaaatatgccgattttacaggttgttccatacaataacttgtaaagttgacatgctgttttatgcagtatcattcttgctggaccattttggtccctggaaggcacaggtcattctcctgccatgaggcaggatcacattgagaagtaccacattatgacctgagctttaaaaattactgtttgtaattgttaagtaattaattttgagtcagtagcttttgtaagtattgtgtaatactgcatttaaaatatggttttattttcagtcatatgtcttatgacatgtatcctagcccttctggtagttttatagtggggcaaaatagagactccttcacaagtgtcagttcattcctgtggagacccagcacttgtgtgaactaggcattttggttgtaaattattacagtatgggattttttttaacagttaattttttcctcttctggactagtcttcagttaaagcctgccatcgtgtggtgttttaaagcatgagatttaagcatgtggcatgactgctgagcttttatgatgagtaaaaagtgaatactattaaatcttttcatatgtgatcaacatttggccagtttatttcttcactttattttaatattacaatattattttgaaatttttattaattaaagattcctcctttagccagtcctcaaacatcagtaagtaaaagtactcttttacttttttagtttatttttaagatcctgtttctccaagaaaaatacaatagcagttttaagaacaggtattaataattttgatgttattattattttttgagacggagtctcactctgtcacccaggctggagtgcagtggtatgatctcggctcactgcaacctctacctcccgggttcaggcaattctcctgcctcaccctcccaggtagctgggattacaggcacaccccaccatgccctgctaatttttgtattttttatagagacagggcttcattttggccaggcttgcctcaaactcctgacctcaggtgatccacttgcctcggcctcccaaaatgctgggattacaggcatggcccaccatgcccggcaataattttggtattattaaggcttctctgtgtaactactgttaataattatttggatgagagaaatactgacctttaaaatataattattgggcaaaatatatccaaatgaactataattttataatgtagaactccatttaaaaaaaagtggttatttagaggccgggtcagcagctcatgcctgtaatcccagcatcttgggaagctgaggctggcagatcacttgagccaggtgttcgagaccagcctggccaaaataggcaaaccctatctctactacaaatacaaaaaattatctcggcctagtaccgcatgcctgtaatcccagctacttgggaggctgaggcatgagaaccacttgaaaccaggaggcagaggttgcaatgagccgagatcgccccactgcgctccagcctaggtgatggtgagatgccatctcaaaaaaaaaaaaaagtgatatttagagaaaaagaaacttcagtttgaacctcagcttgttttttgtttttgttgtttttgagacggagtttcactcttgttgcccaggctggagtgcaatggcacaatctcggctcactgcaacctctgcctcctgggttcaagtgattctccttcctcagccccctgagtagctgggattacaggcatgcgcctccatgcctggataatttttttgtatttttagtagagacggggtttctccatgttggtcaggcaggtcttgaactcccaacatcaggtgatccgcccacctcagcctcccagagtgctgggattacaggcatgagccaccacgcccggcctgtttgtttgtttttttgatacaaggtctctctctgtcacccaggctggagtgcagtggtgcggtctcggctcactgcaacctccacctcctgagttcaagtgattctcctgcctgagcctctcgagtaggtgggactacaggcattgcgccaccatgcccagcttaagtttttgtattttttggtaaagacgaggttttaccatgttggcaaggctggtctcgaactcctgacctcaagtgatccgccagccttggccttccaaagtgctgggattacaggcatgagccaccgtgcccggccctgaacctcagttttttggtagttggttttataaactgaaataatttttatgcaaaatattagggaggccgttatttattgttacctctatgtaacaaaatgggaggtacttgcaagcttggggtcaattagttcttactaatatcaggggagtttcagtatcatgcattgggttataacattactttttaaaataaccttttcttctcatttagtgtaatttgattttctttttttttttgagactgggtcttggtctactgcccagctgcagtacagttgtgcagtcatggctcactgcagcctcaacctcctgggctcaagcgatgtccccgcctaagcctcccaagtagctgggactacaaatgtgtgccactgtgccaggctctttttttttttttttttttgtagatttggggtcttgctatgttgcctaggttggtcttgaattcctggtctcaagtgatcctcccacatcagcctctcaaagtgatgtgattacagacgtaagccactgcgctcagcatgatatcctgacttacagttcctgtatgttttggcttataatatgcattatatttaaaaaatgaattttcatttcttcaaaaatatcctgtgttagtgtgcctctttatagaacaagggggacatgcagtctcactcaaggacaagcaggattctggtacattggtctttaatatggacgtctttgacccatagttattagtaatcatgtgacattgaaagagaatgttagccaacaaaaactctagatccagtgcttgtgaattgcttctctaattttgataggtgatgggagcctttatttaaactacttcttttgtttgtcccttcagcagagagggagaagacctcaagtcatcagtatggtttgatgtcttatgctttttaaatctgttccagctatgctaagaaggaatctgatcttaatggcgcccagatcaagcttcgagaatatgaagcagcactgaattcgaaagatgcagctcttgctactgcacttggtgacaaaaaaagtttagagggagatttggaggatctgaaggatcagattgcccaggtaaggtcaagcctactcttgagccgtatgtgacaggttaattgcctcatctgccttaagccatagtttgattgattgattgattttcaaatgtattttatttttgaaattttatatatttgttttctgatggtttacttgaagaaaagtcttgaggtagctaacatgcaaaacattatcacctcccaggcattatatctggattggccagatcttgtggttcccttcttcttccctattgtgcacacactcattctgtctctgctctcaaagcctattttgttagttaggaaataagtaagaaaagagatgccaaaatgctgctctccacacaggaaaaaatgaaagtggttagctaaaataactagtttgatttttgaaatgtgagtgagtcatacgtctctgttctattccctgttgccaattaacaatttgactggtcgtttggtatgatactctgtgggtgggaccagcaaatgaatacccagttctgtgataaatgttaagatgaagtaattatacattgataaatatataggaattttaacacttgatttgatttgattcatagatatcttatgttcattattaaatgattgccatgtaatttttatcacaattctttttccttgtaatagttggaagcctccttagctgcagccaaaaaacagttagcagatgaaactttacttaaagtagatttggagaatcgttgtcagagccttactgaggacttggagtttcgcaaaagcatgtatgaagaggtaactatatataattttgctttgtaaaggaatggaggggttctagaatgactttgtcatagctaaacatgtaattatattttatttatgatttctttgccacaaaaatatatcagataaagaaataataaggtttggggatggggagaaattttgcaggtagattattcaagctactgctgctaaaagaccgcatttgagaactcaagctgttaccgtaaacagatatgatttcacttcatcttacttatttttgtttttttgtttttgtttttttgagacggagtcttgctctgccgccaggctggagtacagtggcacgatctcggctcctttcaacctctgcctcctgggttcaagcagttctcctgcctcagcctcccgagtagctggaactacaggcgtgcgccaccacgcccagctaatttttgtattcttagtagagacgggatttcaccatattggccagggtggtctcgatctcctgacctcgtgatccgcccaccttggcctcccaaagtgctgggattacaggtgtgagccaccacatccggcctcacttcatcttaacttataaaggcttggtcacagcagctaattactgtcaacatgtttaagcattagttatctattcctgcctaacaaattacttccaaagttcatcaacctaaaaccacagacttgtattaatttcttagttcctgaaggtcagaattcagagctgctaaactgggtggttctgtttcttggtcccatgaggttgcagtacagcttttaacctgggctggaggaatggcatctgagctctttcacagggctgtgggcaggacgtgtcagttcctcacctcatggtcttcttcatagggctgcttatgatatggcccccctaagggtcagtgatgagaaagagagagagagagagaaagaaacacaacgagaacatgaatacatgctaccagctaccaaggcagaagccagattgtcttctataacctaatcacagaggttacataccatcactttggccttctcctatggctcacatctggaaatgcggctactcacagcatttataggcgtgtaaatttttttttttttgagacacgagacccgctctgtcgcccaggctggaatgcagtggcatgatcttggctcactgcaacctctgcctcctgggttcaagctattctcctgccttagcccccctagtagctgggactacaggcgcatgcacccacgccctgctaattttttgtatttttaatagagacgaggttccaccgtgttagccaggatggtctcaatctcctgaccttgtgattggcccgcctcagcctcccaaagtgctgggattacaggcgtgagccaccgtgcccggctcactcatgtggaaatcttaaaatatcacttataagccttaactgctgtggtcaaggggcaggggcaaaaccgttgtcaaacaaaggaagtaataaaattgaggaaaggggaatgtatatttcatgaaaattgtagagggttgaaatcaactcatgggggagaacatgctgttaatgtgctaggcttaatgtttttagaagtagtgtaattttgaaaacagtgcaaataggaattcattgtagcagttagcaaaccagttttttagttggaggaaaaataatagaaatctgattattttttaaaattacaggctttaaacaaaatagatattagtgcaaggtgcaccagacaagcagtcagaccttggacaactcttagtgtcagtttcttatttaaaatgaaatactaatactgctatttttttcttcaatgagtggtaaggatcaaagtggaatactgtgtgtgaaaactctttggatactgtagcaagtgctgtcatataattgttactaagtgttgctttgttaaagcagatattttgatatgaggttgacttacatttttgttttgttttgtaaaaattgtgatttatcattacttatttctgatgttgtgtgtagacaaccaggagtagggttttttttctttgtaaggtcactggttctatataaaaaatagcatcagtaaaaagtaatttaatatttttagagtgcatagcatctttgaatttttggcttttgcctttttgagaatggatgttaagatagtcctcttcagttttgttttttttgtttttgttttttttaactctttttggagacagagtcctgctctctcgcccaggctggagtgcagtagtacgatcttggctcactgcaacctccacctcctgggttcaagcgattcttctgcttcagcctctggagtaactgggtctacaggcatgtgccaccatgcccggctaagttttgtatttttagtagagacagggtttcaccacattggccaggctggtctcgaactcctgaactcaagtgctccatctgcctcggcctcccaaagtgctgggattatagttgtgagccaccgcacctggccttttttactttaaaaaaaatttttttgtgtgagacagagtctcactctgttgcccaggctggtgtgcagtggtacggtcttggctcactgcaacctgtgcctcctggattcaaatgattcttgtgcctcagcctcacgagtagctgggattacaggttcacaccctcacaactggctaactttttttttttttccttactttttactaagtaataccatgttggccaggctggtctaaaactcctggcctcaggtgagccactcgcctcagcctcccaaagtgctgggattacaggtgtgagccactacgctggccttaactttttttttttacattcatgatatatattcagtaataatatctaacttccttattatgaacagttgggggaaaaaaggaaggagaaagacgaaagaggaaggaggaggtagacaaagaacaaaccattagcagtcactcttcagtatttttgtgatttaggtattatttgcttcatgaaatagatgtgatctctgggaaggtgatagcagaatcctcctgatttttctgatttttcagattttgtcaagtgcatgctcctgtgtagtagttaagagaaagatgaagaaatgcaaaggaaaatacatgcgctaatatacacaaacagcaactttggtgggttatacttccctcttgtggcttcttcagatattaccattctaattattatttttttttttttgagacggagtccagctcagctgcccaggctggaatgcagtggtgcgatcttggctcactgcaaccaccgtctcccaggttcaagtgattctcccatctcagcctcctgagtagctgggattacaggcaccctccatcatggctgactaatttttgtattttagtagagacagggttttaccatattggccaggctggtcttgaactcctcacctcaggtgatctgattgccttggcctcccaaagtgctaggattacaggcgtgagccaccgcgcccagccttccattctaattttatttagacacttccttaaaacagagtaaaggaaaggatcatgacaactacttctattcttcaatggtaaatttttcataaatatttgagttagtcaactaatattgttaataagatcctgtgtcacttgataatgatagcttaataccggcttttaaagaagtcttgtaaattagcttgtgctgcctattattatgtctaagaaaatggttttatggctgggcaaggtggttcacacctgtaatcccagcaacttgagtggctgaggcagatggatcacctgaggtcaggagtttgagaccagtctggccaacatggggaaatctcatctctactaaaaatacaaaaattagctgggcatggtggtatgtgcctgtaatcccagttactagggaggctgatgcaggagaattgcttgaacccgggaggcggaggttgtagtgagctgagatcataccattgcacaacagcctgggcgacagagtgatactctatctcagaaaagaaaagaaaagaaaagaaaatagtttcatttcacataaatctttacatgaatttatcacaactgttaagtttaactttccatgtgctgttttttcagagatgttcttaagattatcaatgaaacaattcagaaaaataatttttgcttagtgtttagtatagtatactgtgtataaatccttgattgcagatagttttagtaggccatccaggcctttccttggcttcagaaaaataaatagctatgctcctgaaaaggaatagaaagttcctaaggcttgagatgctaccacttctgtcattagttccatttcaaaaacctcaactgaaaactaagaggcaaaaaagtgtttattcacatgaccgcctgaggacaaacaggaggaagttcgtgtgtaaaacttcagatggctgtgatgtcactcagatgtgtaccaatgcagccatggtaagtagcttggctttatgctttttgttttttccccaggagattaacgagaccagaaggaagcatgaaacgcgcttggtagaggtggattctgggcgtcaaattgagtatgagtacaagctggcgcaagcccttcatgagatgagagagcaacatgatgcccaagtgaggctgtataaggaggagctggagcagacttaccatgccaaagtgagctctcttcagaagattcttttgaacacttaaaatcattacttcacaattcccatgatgaacatggctttatgtttattttgttctagtttttaaaaatgattcccctagtctccatgaaatatatagaaaattgattttttcaaaaaagtgcagttttctataaactaaatgttattaaaaattactagaagaatgtagggttgttgcaattttattagaggttaggttttgtctttttgtcccattgatcattcgtactatgccatagtagttgaacccaaaccatgtgaaataactttcttccaataacaagtactgatcatgctgtcctacataaacatccatttagtaatgaatgaatgtcagactgcattagatctcactttcatgtcatcattgtgcatagattgtgactaccacacttccggcttttttgcataagggccaaatggaaagtctctgctatttcttcttctgtcactattattcacttaaaaaaatattgtagaaacttcccacttatattagctgaccttacaagaattcataaaaatcaccaactagtacaggctttccctggtaaatgattttgccttgtgttttaaatgttacatgatttgattaaaaagacttttttgtggttgacttagaatattagagtcacagagttattgaaaattttcattgcatggctttaaactgttcatgttgctttttatctattgtatgaagtagcagttagtgaaagtgaaagatcttattataagcagtaacttcagttgtataacatttatctaatatcacacattgagctatacagtgaaggagctaaagtaaggatccgtcacagactgtggcctcacagggagccagggaggagacacaggagcatgtccctgagacacacatacacaatagtgttatgggatttgtattttactcaaggagttttttttgcttctgaaaggaagtgtttctatctggtttgaacgaatctataaactagtattttctgcttgttggtttacattctgtattggatttggtgggttagggatatgtgatgtttcttttcttacagacaccaccacagtcaagttgctattgcccagtcttcttattatcagtgttatcttagacattaaaggtttaatagatgaaatattgaagtaataagctttgggtaaaggcctaggtatattagcattcttaaagctcattatttaggaagtgactctaaaagtcacacagaattaccatcattcacaccatatcagcaaacttcatgatgcttttcctgtgtttcatctaccagttaccagcaggacttaggtttgaaatgccttgaggtgaatcatgcttccttttttgtttcagttctagataagactgactatgctttgcttcttcttttagcttgagaatgccagactgtcatcagagatgaatacttctactgtcaacagtgccagggaagaactgatggaaagccgcatgagaattgagagcctttcatcccagctttctaatctacagaaagaggtaaataatcatctttctgtaagaagttagacttgaaggctaccttcaccacgggcacctacctgctttgcttgggctgatgtcactcctccctctgtttgttacagaggatggtgtcatcctgtgctttcgtcttcacagtacttttctagattcgttcattttgcattgcataaacatcctgtgagcagatactattgttcctaattagtagattacacagagctaagggacttgcccttgaggaaggagcctgctagtttattcactgtacttaccctaggacccggatcttccgacctgtctaacagcttcatctctacagagttattctcaacaccttccttttttatatcatttgaaaaccaaaatgaagaaaaacatgcaaaaattctttgtgggtggtgaatgctttgtgtttctagacaaattctttagtgcttaaagtatataacaattaggatccaggaaagtagctttaatttgcatattccgataagaatttagtgactcattcattcgttggtacgcctaagtgacaaatggcattattgccggctgtgttgactggctgcctatcagggtgtgatggtgtgcttcaggtgctgcttaagcaggcatggacactacttcagatcagttttagcctagggtgatgtcagtgtggacacaaagtacatatactccatatactgcattcagaatgattcagcaattaactcgtcaccttaattattttggaaataacttccgcttctattttcctcaagggaggaaatcttgttttgaattttccacatgagaataaactttattttacttttttttttttttttttttttttctttttgagatggagtctcactctgtcgcccaggctggagtgcagtggtacgatctcggctcactgtgagctccgcctcccgggttcacgccattctcctgcctcagcctcccaagtagctgggactacaagtgcgtgccaccacgcccggctaatttttgtatttttagtagagacggggtttcaccgtgttagccaggatggtctcgatctcctgacctcatgatccacccgcctcggcttcccagagtgctgggattacaggcgtgagccaccgtgcccagcctattttactcttgattgggcttttcttccttcctttttctttttaccatttttagtaaaatatttttctaattataaaactgatgacctctgttgcaggaacttagaaataaagcagaaaatgagtcccataaaatggggtgatataaaataatttagttaacacaggggcttttacactgtctatcatgtgctttgttacttacggcacaaatttttaaattattttaaacctattttgtgctgatagtgttttgaagattttcatttaatagcagagctggaagcacctctgagttcattccatgtaaccacagatctaggtgagtttaatgatttgcccgttgcccagaggctgcagactgataaatgggtttctctactccttcccagtttttccttttataactcattttcttcaaagaagatttacttttagaaatttaacagataatctttttttccattgcaccatctgtcttagtccttttgggctgctataacaaactactattgacttggtagcttataaacaacagatatgtcagaaattatttctcacagttttggaggctgggaagtccaagatcaaggcactggcagattggatatctgcctggtgagggctgttccccgatttatagatggtgccttcttgctgtgtcctcacatggttaaagggtgaatgagcacccttggccctatattataagggcatgaatcccattcactagggctttcctctcatgatctaattaccactcaaaggccctacctcttaatatcatcaccttgagggttaggatttaaacatgaaatttgtgggaacacaaacacacagactgtatcactgtctttgtttttcttgttgtttttttttcttctgagacagaatttcgttcttgttgcccaggctgtagtgcaatggcgcaatctcggctcactgcaacctccgcctcccaggtttaagcaattcccctgccttagcttccctagtagctgggattaccggcatgcaccaccacaccctgctaattttgtatttttggtagagacagggtttctccatgttggtcaggccggtcttgaactcctgaccttaggtgatccgcccgcctcagcctcccaaagtgttgggattataggcgtgagccactgcacctggcctatatcaactgtcttaacaggtacttttccaaaaatgggcctctctgttcttgtactgagttggcatttactactcttttccatttactaatagtaagttgtctactagttactgtctatccctcaattttattttttcctactgtattattatttttttggctgctgcctaatccatttgatttacttagtacagatcttctcttgaggttgatcttcactgtgctttggatgaggagactgttattaataagtagtagtgggctctgaaacttagtagctatgtgttctaacctaggttcaaggctgtttccctgttaattgaattcccatttttgcaagttggtttttttttttttttgagacagaattttgcttttgttgcccaagctggagtgcaatggcactatctcagctcactgcaacttctgcttcccaggttcaagtgattctcctgcctcagcctcctgagtagctgggattacaggcacgcgctaccacgcccagctaattctttgtatttttagtagaaatggggtgcaccatgttagccaggttggtttcaaactcctgacttcaggtactctgcctaccttggcctcccaaaatggaagggattacaggcgtgagctgctgccttaaatgctgggattacaggtgtaagccactgtgcctggctgcaagttttttttgttaaccttatcttagtggtttttaagtaatgttaggcagtgcactgggggtttccaggagctaactccttagcagataggagacgagcaatccctttagccaaaatagtttttaatttctctggggtgaatctttcctctgttcattattggtaacagactttatggtaaacagtatattttgaggaatatttttattagttgataaattttagccttagaaaaatcatcaaaaataaaaatgttatctttttgaatattttcctattgtttgtcttaatagtgtttgttgctgagtcatatcagtttcatcatgctgcctattaggccataagaatttccttttggttaaataactcaggttagtgaagtacttcttaaattttacttaaaattgacatggctttaaaatactggttttacaagatatatttaaataatatatagatggtagcagtgttatgttttggaattagaaattttacattgcttatagcatctctagatttttgacttgggaccaaatgaattggttggttagagtctgcttgccttagagaagagtacagtatggtacttaaaaacacctctaacttttgtttttctaacacccagattctggagactttggttgcagctagaccttaataaaccagtacaattacattacatactataaaatatttaaaaaccccaagatcatcagaagtcataaaatttagggttagtggcaagatctgagagatcatctagatagttagagctcttcattttccttatgtggaaactggtttagtgagattagttacagcttgcttatagcctcataggtagtttcaatggcagaattagaaaggagaatctaggtctaacttctcatactgtgttccttatatttcactacacaggtgtaagtgcagctactgaaaatagaatttaaatatttctatttaaaatacagaatgattcagagtaactttaaaatttttatacctagattttgatttttccctcttaaagagctctacaacatcaaaggcagtcaaacagagacatcattgggtttataaatctcggctcaggttatctgtgaatcttgggtagtttatatctctcatcaactctcctttagattctacctttttgcccattcaaatatatcttctacctctgatatatgaaataaagggaggcattttgaacttacatgactttttttttttcttttggagaaaaagaaaatacaaggaacatggtagcggggaaatggatttctccatttatagcatgatttttgcaaacgcagttaaatgcaagttctctgaggttcagggactacctttgtaatatccatcttaagaggagtgcctgtctaaatagcatgtcaagtcatatactactctggaatttaattaattgattggtcaattttttttctttaaaaatatatttttgtgtgtgcgtgtgaaccaggcaccccctctgcccccaaataggtttacagtgactcttgattattttttaaataaccttgttattttggcataattttagatttacagaaaagttggcaaagtactatagacagttcttgttttcctctcacccattttcccctgttgttagcatcttatgttaccatagtatatttgtcaaaactaagaaactgacattggtatattactgtgaactcgtctccagactatttggatttcaccagttcttctgttatcttctttctgttccaggtgccacatgcctcccctggtctgtgacagtttcttgggctttccttgttttttatgagcttgagtcttgagtaagattgtccaggtatcctgtagactgtcccccaatttggatttgtccggtgcttttcacgtgattagactggggttttgggttttaagtgcccgttttgtcacatcgtatcagggattgcacgtatgtgataaccacatgacatcactggtggtgtttggtttaagatagtgtttgtcaggtttctccactgtcaacagcgctactatttttccgttcccatacactgttcatggaaaacagctcactaagtccagcctaccctcaagggtgaaggacagggcaggacttaagcgccacattctggagggaaatctacatttattaaatggcattcttctgtaacgatttatccattccccgtttgtttggtttgtttgtttgtttgtttgtgtccgtatggaccatgggcatttactttatactttgggttgtaagctaatactgcagtatttacttttttggcttaaattgtttcatatttggccactgggagttctgtcagcttggccactatgtcccattgttttttgagcactttgttgctttctggtactataacatgctctaggctcatcttgcattttccctgccccagtcctagaattatccagtctccaaggagccctggttcttgttattggagaatggtatatagaaattaagatctgggcactgagtgtgctcactggtactgggtatcactgcttcttggccctctcaccgataaaagtgggtaacattttatgtatgctaacccatgtgtatgcacatatttataactttttctgtctaatcatttgtgttaagataaacatgaattcatacagatgtctctgacttgaatctagtaggacagcattcaattttggcttcctttctgacatacctgtatcttttctctctcagagtgagaaacctggtttttatcatccatttacttatctgttcagccccagtatatgttaaagcagtttcaaaattttgaacctgtactgctgtgaaaagtaaatttaccagcaagagtacagtttttatgtatttggtagctcctttttatctctagccttctagatttagtttttgcacattagatgccctttctctcctgctctgttgcaggtacttgtgattctgagggcctaagctatccatcagtctttttgagttgtcactttctgaggctactgagatgaattctgtcatggagaaacacagaagaataattacccagcgagccacaaggtttctaagatgaactttctggtgtaggatgtgtgatttttaatttttttatgccaaatatacagcttctatattcacagtaatactttacaaatcaccctatattgtgtgtcctttgtgtgctaactgaacatgagatagcccagcaatcctaaagggacactaggtagtgccttccacatagtaaccagagtccctttgccttggtttctgaatattcctcagcagtctgctaaaacgtacttttacccactcttaggtttattttgtcagtcagtgtttatatctttttttttttttttttgagacagagtctcgctctgttgcccaggttggagtgcaatggcgtgatcttggctcactgcaacctctgcctccggggttcaagcgattgtcctgcctcagcctcccaagtagctgggattacaggcgcccaccactacaacctgctaattttttttgtatttttagtagagacggggtttcgccatgttagtcaggctggtctcaaactcctgacctcaggtgatccacctgccccggcctcccaaagtgttgggattacaggcgtaagccaccacacccacccagtgttcttatctttttaagttctttatttaatttatacttttggaagtaaaggctttgtaagggagccagacttgacttttaccaaaaccacatcttaacatttttttggctaagtacagaaaaattatatgtatatttacagaacttacatttgtggaatatgtcttttattcttttatcagccaaaactatcctgaggtctgtgttttgtatttgaggaattttgggttttaatttcttaaaatctcttgaattctagtgagttagagattccatagggttgtactgttttccagtctaggaaatgatttaaaatagctgcctggtgctaatgttggaatgttcctagaaagtaaatatgtttccttgcatcttaagtctagagcatgtttggaaaggattcaagaattagaggacttgcttgctaaagaaaaagacaactctcgtcgcatgctgacagacaaagagagagagatggcggaaataagggatcaaatgcagcaacagctgaatgactatgaacagcttcttgatgtaaagttagccctggacatggaaatcagtgcttacaggaaactcttagaaggcgaagaagagaggtaaggaacttaagggtcaccctaccttatggtccactttttgcctctcaccctttttattgaaataaaaataaatagcattttaaaaagaactttattttcttggtcatttctttgaacacctaggtatagaagtagtaatagatcatatttctacctcatcgcagaaaatgttgctcaagtactcttagtttatttattattattactttaaatgctgaactgcatcaggatggattagttcctttgagattttaagtgttttggtgatttaatatattgtaaaatgccaaactggctgaaagagactttacatattatttatttatttatttatttatttatttatttatttatttatattgagacagagtctcagcctgttgcccaggctagagtgcagtggtgtgattctcggctcactgcaaccttcacctcctggtttcaagcgatttgcctacctcagcctcctgagtaactgggattacaggcgtgtgtcaccacacccggctaattttgtttttagtagagaagaggtttcaccatgttggccaggctggtctcaaactcctgactgcaagtgacccacccgcctcagcctcccaaagtgctaggattacaggtgtgagccaccacgcccggctggctttatatatattttaaatctggtcaatgtataaatatttttgacacctgttctcagaaaagagttccaaaagggccaggtgcattgcctcatgcctgtaatcccggcactttgggaggccaaggcaggcggatcacatgaggtcaggagttcaagaccagcctggtcaacatggtgaaactccgtctctaatgaaaatacaaaaattagctgggcatggtggcaggcacctgtaatcccagctacttgggaggctgagacagaattgcttgaacctgggaggtggagtttgcagtgagccaagattgtgccattgcactccagcctgggtgacaagagtgaaactctgtctcacaaaaaaaagaaaaagaaaaaaaaagttccaaaaggaaagtggctgatttaggataaaaagccagataattttaatattatatccgttgtgatcataagaaagtacaggtacgaaaagagaaaaaagtacaccaactataacagtggctgtggtgggtggtggtagatcagatgactttctacccatttaccagacttcttgcattatggttatattacttccatccctagagaaaacattcagattgttattttttaaaaaagaaaattgacgatgggcaccttatgaagaagtttacattagttaaggtaaactttggctttggctaacagattgtaagtaatattttgctttagaaatgcatgggtgggatattcttcttcttattattattattttgagacaggttttcactctgtcacccaggctagagtgcagtggtgtgatctcagctcactgcagcctctgcctcccgggttcaagccattctcctgcctcagcctcctgagtagctagtattacaggcgcccaccaccacgcctggctaatttttgtatttttagtagagacggggtttcaccatgttggtcaggctgatcttgaactcctgacctcaagcaatccacctgccttggcctcccaaagtgctgttgggttacagacatgagcctctgtgcccagcccttgtttttttgttttttttttttttaaggcgagaagggcatatgtgttttaaaaatgaattgttttatttttcccatataggttgaagctgtctccaagcccttcttcccgtgtgacagtatcccgagcatcctcaagtcgtagtgtacgtacaactagaggaaagcggaagagggttgatgtggaagaatcagaggcgagtagtagtgttagcatctctcattccgcctcagccactggaaatgtttgcatcgaagaaattgatgttgatgggaaatttatccgcttgaagaacacttctgaacaggtaataaaatagacccttttttttctagcaaggctttgtggattgctagattctcttgcaattgtcatagctccttagtttttgtttggattcattacgtcttcatggaataagggtttatgtcctttttacttaaattcataaaataaaataaaaattaaaataggaggaggaagagttaggtacccttagtagtttaaagatttgcttcattaacccttctttagagggccagggcttttttgaaaagcatgttccttttatcacagtggttctgaggatgagttattattattctctgccctagccaaatttgtgaagaagttggagcaattggatgaaaatggtggatattctttcggtcattaacttaataaaaagcttactgaaagaaggagataagagcctggactcagatattaagggaatatttttccctgcaaataaatgaatgaacaaatgctaatactttacatgaaaaatagcatgaagccttattttgaaatatgtttaaaagtaaacatgaagtattcatagcagagatttctgaaatttagggctggggctttcgggagctctgtagtgtgggccttccctagctctgcatcaaggagctggaggccatgatgggttgtgagatgatactagaggaaggcatggtctgggagcgtgcaggcggcagtgggatggatgtcacatcttgaaacatatgttcagggcctgctaaaagtagttttgaaaattagtcttttctcaccacagttattaaaactatcttgcatgtggatgaatatgtaatttggatgagtgaaggagcactaatgagcaccaacagttttaatgctaaagagaataggctctaaggtctctttgtagccttttttttttttttgagtcttgctctgttgcccaggtcggagtgcagtggcatgatcttggctcctccacctcttgggttcaagagattctcctgcctcagcctcctgagtagctgggattacaggtgcacgcaagcacgcctgctgatttttgtatttttacacagggcttcaccatgttggccaggctggtctccaactcctgacctcaggtgatccacccgccttggcctcctaaagtgctgggattacaggcatgggccaccatgcccagccccactgaccctttttttgagccccttatgctttcatgtatgagagctgaatgtgggcagaagtgggacagatgcagaaggaaaatgacagattttcttctgtttctaagcttatgtgtctattttaaaagcttgaagtaatccaatacttgatgtttaaaaattgtgattatgacagctagatagtgctgtaaatttgaaagacccaccttatctagcagtgaatttgaccatttaatttggttcataccctgttcttccagttctgtcctctttaaagtcaagtaccttactaattaactcattgttgaagttactgtttgacaaaatgacagaatcgtgttttctttttatagtaggaaaacctgaaatgtgggaagatgaccataaagcggtcttagtttaactgcctgtatggattaatttatttgattattccacaactttctttatctttgaagtaacacccctcaccctcctttctgtgtgtaggatcaaccaatgggaggctgggagatgatcagaaaaattggagacacatcagtcagttataaatatacctcaagatatgtgctgaaggcaggccagactgttacagtaagtgaatctagtcatcatttaatttaacttcattgtgttaactaacaaagtaactcaaaaagttttttggctaaaagagaagcattttagaaatggccgttaaagtactttttatattattagggcattacaagtgctataaaagatttttaaaattctgtcttattgagagtagtgaagaatggacctttgaattatttttatcttgtctattccagtagatataaaagctatctctaggctgatacttatagcccagtgtcattcaggagacactgcttggcataaagaactgttaagaatttagcattaacatatgcctaaaacagcaatctctagccttgggtgagcttcagaatcatttgggtagtattttggtgttcaggccctacttcaccctttgctatctttagggttggggtaggagcctaggttttgaataaaagtccttagattataggcacccttgtaaattttcactaattggcattctgtgtcttgatttctaaatggctctctattggtatgttctgaaatactacatctttaatagttactgaattattattagcttactttttagagaagtatgtttcattgagtaatcaaagattcttttgcttttacttagtaggtagatttagctaacaataaaatatgttaactttgatacagatttcaaagaagtcactcttttcatcctaaaagaatgtagaggtgactgtctctttccttttatatattctttaaaaaatattaaacgcatgttttaaatgtgtttataattttatgttgatacaaaccttactgttgaagatcaaaggctcagacttctctttaaaaaggtgtattcagagagcatgatgccactttgtgaaaatatcaaatgctaatttggtaataatgggtaaaaatgggatcaactatcctaactacaatatcctttcttctcgttagtaattactatagtgagaaaaaattgctcactatagcaattgctattatatgtcttatggaagctgtataatgtggtaaaaagaatctgacattttagttcagaggattcagaattgagtgtgctctctatctcagaagtaatatggaagccttatgccaatcatgtgctttttctactgggtatactacctcagggactaaatacatggattctagagatctagtggataactcaattatcatataaaataatgtgatacttttttcccttcagttactggcattaaatgtgataagcagctctttggaacatggtagtaataagtgatctttctgtaaaattgcagaggcaaaagcaaagatcagtttaaaactctagaatagaaatatgagaaccacatgtgtaattttaaattttcttatagccgcattaaagtaaaaaagaaagacatgaattttagaactatattttatgaaacccaatatatccaaaatattgctttaacatgtaatcagtctaaaaagtcagatatttttacattcttttttttttatgtttagctaagtcttcaaaatctagtgtgtattttacccttacagcacattcatttcagactagccatattttaagtgctaacaagccacattttgctgcggtattgaatgacatggctataggacatattagttttaggttaagttagccagcaaggatactgacattttatgatgatgattactaacataaatcaactatgtgattacatataggctagtgagaaatattgcttacaattagggaaacactaacattccacatagtctgaatgttggaccagattcagttctttttttcagtttaatcccagttaatatcttgtgcccttttccatttgtaatgctgatgaaagatctggatgcttcaggggaacatctcaaaagtaagggctctctcctaatcagtaattcatagattttttttttcctgtttccaccccacccccccaccctttcttttttttgatagagacaggatttcaccattttgcccaggctggttttaaactccttagctcaagtgatctgcccgcctcggcctcccaaagtgctgtgattacaggctggagccactacacctggcccccattttgaaataatacttggctttgccatcttcagctttccttttgcagtcataaagtcttttatattctataacaatgtatggattacaaacttttctgtttctatttgtttttaaatgatctttctaagagatcagggctagtagtatccctgtagctaaaggcattgagtttcctagaggtgtagtgatttgtccagaattcaaacctaggctttctgactgccaggtgttcttcactctatccattctcttttgccagtagatatataaaaagaatttcatgctcatgagaagggaaatataattatttctttgacctatttcaatagcaattatattttcccttgaacagcgagtgatttatacatttccagcattctttttggagcgcagtctcagatactctagggtattgtgacattgtctgtttggagacgtaccagtttccataagattattctagataggctctctgctgcagaaggtctctttagttcttgctgtaggcagccagagaacattattagagggagtcacagaaggctctaacatggaaggatggcctataaaacccacagagtaatagaacgctgaggctaccattcactgagttagccagccactgaatgtgggttatcacttgctcttttcaataatcgcacctgttacaggtgccatttctaccctgttttatggatgactaaagtaaggtaacttgctcagggtcagctggtgtgtaaaggaactaggatgtgagtgtaggcagttttacttcagggtcttatatattatcatcttcacttatcagatggggaagctgaggccttgagaagctctgtgagttctcctggccacatagctgtgtatagcactctgtagctggggcatagttctcagacttttagaatcaagtgtttgagtctcatcgcattgctgtcgttggcgtgtgggagaactgggttctgggtgtactgacatgctttggttttttacagatttgggctgcaaacgctggtgtcacagccagccccccaactgacctcatctggaagaaccagaactcgtggggcactggcgaagatgtgaaggttatattgaaaaattctcagggagaggtatggccagtttatcaggaccaccacaatgttaatttcacttaaagttcactgtgcaagtataatcaagatcagattgaaacgtgcaataaccgattgcataaacagaccaaagctgctaagttaattgaactgaagctgtctttaagttttaggaataaataggagtgtattatagagtactgattattagcacaggctccagaacagattttctgtgtcctgtttctgttttcactgcacattagctttgtgactttgggcaagttacttcacctctcttagatttgtcatttaaaaatggatattaatgacacaatatccatgagctaataataagaatgagacagtacttgggaaatgcttggaatagtatctggcatagtacctttatctagtaaatgcttaaattattaaccttgttactagctctcagaatgttcatgaaactgtgagtttgaagattgtggagtgtacatcttcttggagtgtgtgttttcagtgtgtcagtcttagaatccttgtcaaagtaccttaccttccccattgccacataaagacactgcatatacccctaccaatactagtcttagaaatactacttcctaataaagcggctaaagtgtgctttgaagctagtaaaacatggcttcctccttgtctttccctagcgaatcaccttatccaggtgctgtaccacgcatcactgagcctctgtttagaatttgagtccctcctttgttgctattgccataagcatgttaatggagcttttgttgtgagttcagcatggtttgttcttctcattttccttttagttgtaatactgctttttcatcctttgcctaccaggagagctgtaagttggcttgcaaggaagccattggtcataaccttgttctgacatgcttactgattctgaccttttcacccagtttccaggctggcaggctctgctgtttgtaccttacaacctgactgggtatgcatttcagtctgagtggtgctgaaaggagatatatagggggaatgttaggctggcaaacctggtagggaagctaaccatatttacaagtgcagggctattcatttatttggaaaatcctgagtatctgctgtatgccagccactttgtgttaggaataagcaggaaaaaagccatacgtggtttctggcatcatggagcccacattgtaaagagagtaagggagccagggaataagataaagtgattttctgataaaggtaataaagataaactgtggtatcaggcccagcgcagtggctcatgcctgtaatcccagcactttgggaggccgaaggtgggtggatcacctgaggtcaggagttagagaccagcgtggccaacatggtgaaaccccgtctctactaaaaacacaagaattagccgggcatggtggcacgtgcctgtagtccaggctactcaggaagctgaggcaggagaattgcttgaactcgggatgagctgagattgcgccattgcactccagcctgggcgacagagcaagactgtgtctcaaataaataaataaagttacaggactcgctgagtaaagtttgtcaggagagggtccagaattgagccctagaaaatattgacattaggaataagagcaaaggaagtagaagatgcagccagtgaagtcagaggaaaatggtgtgtgatgtcaggaaagccaagggaggaaagtatctgtgaaaggagtggtcagcgggtcaaatcacaccgtccccttaggggttttttgtctgctcccatagtgccacgggcaggcctctaacctgcgtggtgctcatcacattgttctcactcactagaggaagcacactgagggcaagggcctgttctggtagatcctggtatcatgcttggcacataacaggaattcaggaagcatttactggatgcattttttaaaaaaaaatcagacatggaccttgacttacgttcagagaaataaagcaatagcagcattcattataagagtctgaggtgcctggataaaaagttctgttcatggccatcttcctgtctatccctcactgtaaccatgtctcttgtgaaacattgttaagagtggtgattggctcagataagactgaaaagcactgttataaggggtacaaggcagattaaatggactttcgtgagccatggaatctagtcattatttatgtcattttttttttctctgtgaaagtgtgttccaagttagaaacaatgttataggaggatatttggaatggagcagtaggtttaaatgccccaaaaaatagatacagtgacatgaacaaagtagtagatattatgacatgggatgcatcttcagacagtattactagtattactgatgacatattagtaaagctaactgaagcttagctccatttcataactcaaacattgaatagtagattatttgattgattgattggttggttggtccattcttttttttttttttggtgaaggagtttcactctgttgcccaggctggagtggagtggcatagcacgatctcggctcactgcaacctccgcctcctgcctcagcctcctgagtagctggaactacaggtgcgtgccaacacacctggctaatttttatatttttagtagagatggggttttaccatattggccaggatggtctcaatctcttgaccttgtgatccgtcacctcggcctcccaaagtgctgggattacaggtgtgagccaccatgcccggccaaggttggtccattcttttaacaaacttctaataccttcagcttgcgaggctctgttttaagtgagttctgtcagaaatgaggagagaaagtattatgaatacaggtcttatttcactagacagttacttttggcatttattcatttaattcgataagaccatatttgtcagtagggaccagaccacattaggaacaatctataaacaatccccgccataaagaccagtttgcagtaagattgttggtaactggcttagtcagttttgtttcttatgtttttttttttcttcttgctggggcattggaaatgtcagaaaacccaattaaactggcttagaaataatggaaattttttgggctcacataataaaaaatttaaatagtggacctaatccagtggctcacagcatgtccccggggatctgtctgttgtttctcttctggttgcctcccttggggacgcaggatagctgctggctgctcccagaggtacgtcttttctatttgctttttgtgggaaggtgatctttcaaaaaagtgctctttatggtggagtttatagattgttgctaacgtggtccggtactactgacagataaacatggtcttacccaattaaatgaatacataccaaaagtaactgtctaatgaaataagacctgtattcataccactttctctcctcgttcctgacagaactctctcagaacagcctagcaagcagaaggcagtagaagtttgttaaaagaatggacaatccagcccaccaaataatctgatattgagtgtttgaattatggagggaagctaaacttcatcccctgtgaggcacccatcctgggcttcactcacactggactagggtgggtcacgtgcccacctctaaaccagttcctggagttgggagggcggaattagagctcaagacttcttcctcccctctacagccacattgcactgggctccttgtgacacacgtgtgctccatggggggtgtgtacccaggtaaacctaggggctcttattcaggagggaaggggcactgggtggttaaaaacagcgattgtcaccatggcaaaaacaagatgttttttatgagggaaataaaaaataaagcagtccttccaaactttccagaatatagatataatggaaacttttgtatatgcaaatgattacttatatatgtagagatgcaatatataaaatataaacaatcatctttcgtccacataagatcgccctgatttgtagcatttgctaatttctgtggtataaatactcctactgtggctgatgccaggcttccagcattatgtgactgagcacagagctgtgcagtgatgagcagcatcagcaggtgcagccagctccgggcaccactgcacagatcagtgcaccttcatatgcccaaggctcgcagcaggggcggaccaatgctgcattttatagacagagtaaagcctgtcatgtaagactatttatgtgaacctttcaggacacttggggtaaacacatttatttagtagcatcttgactaataacaatttccttgatctaaacctcccaacagctttttggttctaaattattatttattatttttctacctagatttttagacattagctcacccattttttatacggctttctgtattagattaattggtttttgcatgttttcaaatgaagagtgcttaacagcagggttacacttaaagtagttatgttaaggtaattcataataatgaagacaggcaagttgctgttttctgaggttctcattgaggctaatagtcttaagctacatcatgagccttaagagccaatgtttgcatatgggatgtataccacgagcttctagaagctggaatgtggtaattttgttatagaagattttatttgactcgttcctcattttaagatgagttgagaaaagctgggtactctcaaagttttttaagaatttatttttctgctttatatgctgctatctcctagttgatagcttgaacggtggttgatctaaagaatcacattttttttattactaatttggttaaaacactgatatttgtgaaatggctatttctgtttgtaaagatagaccaatttcacagaattgaagttactggctaattgagaggctcaaaatggtccatcttccttggtcctgcaagagtaataaaaaatccccacaaaatactgttctgccaccttactttatttacaaaacacattattgggcatatttcaaatcgaagtctcatttctgtgacactgggttttgattttctttctctgccattgtaaactagctggtctgtgttagataagcttttactgaagtaatattgtgtcttcccctgtagcattctctttcttgagtgaccttaggacagggtacagaataaaattatatgctctgcagcactcttgaggacacactcatttacttgctgccagatcatcaggttagccttgtgcttaagcaaaaacactgctgcatttgtgccaagtcagcattttccacaggaaagtaatctgtatttgacctttttagtagaaaatggaaatagttgctttctgtcatacctttagtgaatgataggagacctatttctgtacagaatacattggaacctcactagtacgttattggtaaatagtgtacagtgttcatctgtcttgattttgtttcattcaagaggtatcagttgctgaaaggaatgaaaggagcttgtcctttcttctcacttatcaggtggtcctgttgctggtagtccctgagatcacagttggcttccagcttcattttattcagcatttatttagcaccttatctttgccaggagctaagatctttaagctgaattcatgttgagttttataaagaatttagtatgtcaaataatttgtagaattcttagtaacagaataggataaaaagcagtggaaacttctcagcagatatttcgaattggatagtacttcctcccctgcaggaaatatggaaggtataagaactgctactaattatgcggaaatttcagtttagtaaccagaaagttactgatatacagctccccccgccccacccctttaaaaataataaacaggggccaagtgtggaggctcatgcctgtaatcccagcactttgggaggctgaggtgggtggatcacttgaaaccaggagttcaagaccagcctggccaacgtggcaaaaccccatctctactaaaaatgtataaaaattagccgcacgtggtggtgcatgcctgtaatcccagctactggggtggctgaggcatgagaatcgcttgaacctgggaagtgaaggtttcagtgaaccgaggtcatgccactgcacaccagcctgggcgacagagtgagactctgtctccaaaaaaagggatgaataatagtaataataataaacagaaatgctgtctcttttttttttcttttttgagacagtcttgctgtgacactggagtgcagtggcgtgatctcggctcactgcaacctcaatgcaagccattcttctgcctcagcctcctgagtagctgggattacaggcacgtgccatcatggccagctaatttttgtatttttagtagagacggggtttcaccatgttggtcaggctggtctctaactcctgacctcgggtgatctgcctgccttggcctcccaaagtgctgggattacaggtgtgagccactgcgcctggcaagaaatgctgtctcttaagcaaagaaaaggtccctctcccccgcatttggtgattttaagtgtgttttttaacttaaactactattgtttttaggaggttgctcaaagaagtacagtctttaaaacaaccatacctgaagaagaggaggaggaggaagaagcagctggagtggttgttgaggaagaacttttccaccagcaggtattactttatttatttaatatatttatttcaaattttattcacagaattacatgaagaccaagagtgtggttgggtttttcccctatcagttgatgaaccagcgcagttatctaccaagtggggtttgtactccccaaagggatattcaaggtgatactttagggtactggaagaatatgttggcacttttatttttattttttctcattgtaccaagtttcagttttgtcctttgttttctaatgtgcattatgtgttacagtaaaacatgtctatggattggatgtttactccaaacttgtttactctgtagggtcctatgattaaaaggtttagatcactaatttagagcaagaatctgcatataaactttaaaaaaacaaagtaatattcaacttcagtgtgaaacaaaattcttgctgtattaagttcctaatcattatctaattgaagatagattttggctgatggttgggcttttgagagcccttgaaataaagaaactccaaatttggttttaattataattaaattggaattattaataactaatgagccttcagtttatattctcaagctgtttgagtccgatcattaatcaaagtgtctacccttatcctgataagactttgtttccatggctccagatttttagtcttaagtctgctttgcttcattagccctagtcctggtctaaataaacactgtctcatatatttaacccccagggttgagaaccacttgaggtgggttgcatgaagtagcatgaattttttacctggatgccttctcatacattttggaggaatattttaaaacacatatgttacacttaacttacaagaaacaagcacaagttccattttctgtgcttcaatgggaaccatcgtaattactagaagtaaaataattatgtaagagataactcaaggcaccagacaagagggtcagcatgagttatatagcatgtcagatgctagaggaggtactccaggccagcagagtagttgagaagaactctgtgaggtgatgcttgtccactaatttgaaggatgggtgattatttggttattggagagaaggcagatgatggtgctctgaggatgttggaattcaccattgcttcactaacagaccaccccaaagcttagtggcttaaaacagtgatttcttacttcccataattctgtggtttgactgggctcagctgggcagtgtttctgttccacatgctgcagactgaactcaatcgagcaggctgtgttcagctcagaggttggcctcggctggaatatcttttaggtctctttctgtgtggatttctatgatttaagagtttagtcaaagctttatagcatggcaattgtctaacagagtaagtggagggtacaggtttctttcttttttcttttttttttttgagatagagtcttgctgtgtcgccaggctggagcgcagtggcgcaatctcagctcaccgcaacctccacctcccaggttcaagagatacccctgcctcagtctcccaagtagctgggattacaggcatgcgccaccacgcctggctaattttttatattgtagtagagatggagtttcaccatgttggccacgacaatctcaatctcaagagagtaccaggtttcttaaagggccctttgtaacattctcttagtcaaagtcatgaggccagtccagattcaaagtgggggtaaatagtctccacctgttggtgggaggaatggcaaagaattcatggtgatctttaactcactacagaggatgtgtaaagaatgtggccgggcacggtggcttacgcctgtaatcccagcagtttgggaggcaggcagatcacaaggtcaggagatcgagaccatcctggctaacacggtgaaaccccgtctctactaaaaatacaaaaaattagccgggcgtggtggcgggagcctgtagtcccagctactcgggaggctgaggcaggagaatggcgtgaacccgggaggcggagcttgcagtgagctgagatggcgccactgcactccagcttgggtgacagagtgagactctgcctcataaaaaaagacttaatgcaccaactatatccgctcatccagttattttgtagggttcatgtgagagttaaatgaagttgaaagattggaattaaactgacatagtctggaatgcttagggatgtagcttctgtacaatttggaacaaaggagaagttaagactgcattttaaaatatcactggccaagctgaatcagagggactaactctagagaggagattccagaggcagtgagggaatatataatggaaatttattaaggcttagtgactaaacttgagggtgagagaagaaaaaaaataaagatgtatgaggtttttagcttttgtgatcacagaaactaatgataccaaggttcataagagggaagatggaagggcagaacaggcgtttgaacttcatatttgaggatgaatccaatcgccttttgaattgattagaaatattttggtgaccttcaaaaaaccagttttagttcaatcagtggtgagtcacaagtcatattgtgaggttatatgaaattaatgagtgataaagaaatgggtagaggagccatgttgacttcaccttggaggacaaatccactgcagatggcttgggatgtgtaagttcaggatctagcaagctgtagtctccgatgtggttgttaaaagctgatccactgatctcctatttcctaagttatcaaaagaggttattgaacaatggttttcaaattgagctgcacattagaattactttaaaattatatatagatagctaccctttcccagtaaaatgagaaattcttatttgattgatcaagggacctagatcagaatttgttttaaactcctcaggatctgaatgtgtagccagagttgacaattactgttctggaatttgttggggggtattctagaaagaagtccataaaagaaggttagaggccagatacggtggctcacgcctgtaatcccagcactttgggaggccaagggcaggtggatcacttgaggccaggagttcaagaccagcctggctaacgtggtggtgatgcacacctgtagtcgcagctgctcgggaggctgaggcatgagaatcgcttgaacccaggaggtagaggttgcagtgagccaagattgcaccactgcactccagcctgggcaacagagtgagactctatctcaaacaaacaaagaaaaagaaaaaaagaaaaggttagaaaagatgagagatgataaagggtccatttgaggttaggtaatatggtttggtatccctgtagttaaaagtttttgtcttattttagaatactgtgatctatttctttagtattaatttttccttctgttttcctcatcagggaaccccaagagcatccaatagaagctgtgcaattatgtaaaattttcaactgtcttcctcaaaataaagaagtatggtaatctttacctgtatacagtgcagagccttctcagaagcacagaatatttttatatttcctttatgtgaatttttaagctgcaaatctgatggccttaatttcctttttgacactgaaagttttgtaaaagaaatcatgtccatacactttgttgcaagatgtgaattattgacactgaacttaataactgtgtactgttcggaaggggttcctcaaattttttgactttttttgtatgtgtgttttttctttttttttaagttcttatgaggaggggagggtaaataaaccactgtgcgtcttggtgtaatttgaagattgccccatctagactagcaatctcttcattattctctgctatatataaaacggtgctgtgagggaggggaaaagcatttttcaatatattgaacttttgtactgaatttttttgtaataagcaatcaaggttataattttttttaaaatagaaattttgtaagaaggcaatattaacctaatcaccatgtaagcactctggatgatggattccacaaaacttggttttatggttacttcttctcttagattcttaattcatgaggagggtgggggagggaggtggagggagggaagggtttctctattaaaatgcattcgttgtgttttttaagatagtgtaacttgcttaaatttcttatgtgacattaacaaataaaaaagctcttttaatattgatatactgtcctttttaacgctttaaaaacagattttgaggggagaaaagtattgtttcagttttgcttttgataaaaatataatttgacttctttgaactggatttttctttaaggctttgccagttgtggaagataagctattttgggggtctttcagtatttaattgtcattaataacaacaataataaaagcaataataataactaatgtttttgagccagatatcatgctcaatgcttcattacattttttagcttattaacaataaggccttttaaaatttcttcaggaaaaccaaataggaacagtagaaaacattgaggaagacattcctttttttttttttttttttttttaaaagacagaatctcactctgttgcccaggctgtagtgcaatggcacggtcttagctcactgcagccttgacctctcctgggctctgcctcccaagtagctgggactacaggcacacaccaccatgtccggctaatgtttttgtattcgtagagagcattttgtcatgtttcccatgctggacattcctagtaaaagaaaaaatgggaagaatattttagaatgtaattctactgtcttttaaaataggaagggccgagaaattgattaaaagccaccttttagaaaaataacatgaatgctatgaaatacgaatgtgctgtgtgtggggtagctttattatgtatggtgctaattatggtgtcaattcgtgtggatttggggaggttttgtcttgattgctttagttaagtgagttcatcttataggaagtgcaatatctgaactcttcctagaatggacagataatatttcagaagctaaccctagtcagtgtttgtttttctcttaaaatattcctgcagtaagctgcacaaagactaccagctttcacttgaaaataactcacaaagccccagaattactgtgttccgcagatttactgcatactttggtgccgtcgcagacacaagataaatgctgggttagaaattctgtctggtaaagcagataaaatgataacttctcaacgcagatttatcttcagagtgggaatggcattacagtacacagccaaactcagctgtgaaacattttgccacaagatggggttcttgtcatcaaaatacattctaggtgcttttattgctggataaattaggttataaaagccaacacttgaattaatttgggcattaagaaaaattggcagttgtaacatagtagaatagtgtgtatgctggggaaattgagagtacaaatgcagggctcaacataaacagtttgttgcccctggatgtgtggcagtagtagattcctgagtctgtttagactgacaaactttggactaaattgaggttttctgaaattgagctgcacctaaacccattcccgcagaatgtgagtgagctagagggcacgctgccatcctgtgtattaaaatcagcatctccgcatgaaattgatgttaggcatacagcatatatatacatttttggattatttatttgataacaagcatgattcacattttccccttgttttgtcttcagtgtttgttttcacctctgtttaggtatggatttattttattattttattttattttatttatttttttgagacagagtctcgctgttgttgcccaggctggagtgcaatggtgcaatctccgctcactgcaacctctgtctcccaggttcaagcgattctcctgcctcagcctcctgagtagttgggattacaggtgcacaccaccacgcctagatatggatttatttttattcctcttgttcaggtcttatctctgtgttcttcattaagaaaattttggatgttcttattttgttgagtattatctcatccccactgtctgttctttccttctggggtttcttttatacctgtgttgaacctgtcctgtttcatgtattttaggtttctccacactatattctcagttaactccttcgtat

SEQ ID NO: 12503 - DNA, 37792 bp, Human
cgccctggaggacaacgcaaggttaacttccctcccacctcctcttgtaggcacacagggtgccccttagccagcgaaatctccgcgcccgagatcctctcacaatttcaggctggtgaattgtagtaggagacatggtttagtttgatgtggttaagtcagtcatcatggcatcttcgtaccctcagccccaaaccgctctcctactcatcaccctcactttcatttctttggattatctttcatcggcttaccaccagccttcacagcctcacccaaggctgaagcagggctagcagggtggtgcgtttccttccctggttgagctggtgactgctgtgggtaagcaggtccaatgtgaactcaattttacattgagaaagagaaagcaagagtgagtgggctgctaagactgttgcttcatggtttcccctaagccccagaaatagaaaggcagacttccgactggcagagcccgtatgctaaccaccagaccacactgccagataagaaaaatgttcgattgtgtcatacttccctcattggctccagtgtctgaaaatggccctgaatttcagagagtcttaccatgacccagggatttagagaggatcgaagagggaggacaaaggaatcaggcaccttctctctctcttttctggggtaaatttattttcaaccacaaaagtaaaggaaagaaaaagtcacaacagatgagttatgagctaactttctgatttgcacatgtaagagaaagaaatgaactggatatcattagacattgagaaagggagtctgcaagctagcaatgtatcttcggcctttttgatttacacgtgtttatttatgagtacctactgtgtgccaggcatgatgcttggtgctgccaattcaaagagaaataagacacctccttgcaaagtgagaaggcagaactagattcagattcacctagatttcaactcttgtgctcaggccaccaccaccaccatggaaacaattttgcttgactctcccggcgcagccgcggcaggcgtgtgtgttgtcagacactgcaggaagagtgatggcctgggtgttgacaggctcctaattggaaggtaggaggtgccaccagagatcagctataaaagatatctttggactggggtgggctgctaatgcttggaagagacttgtgggtgaggcccggtgagctgtcacctcggaattgggccttgcccagcagacagacatgcatgcgggggaggtagctgacagacaggggcgcatggggaagcagccattccagagaactgcaacagcagattgcaaaccaggacttcaggactcagagggggacaaggaaaggagagcctatagtggccccaaagcccagggtcagaggcagggccaggagagcagctgacaagagctttatggtaaggacaaaagagaagacagccggagtctccttttattcagctcataaagacccaacttctgtgcacttataactgttcagaccctgaggggttcaaaaaaagaaccgtgttaggagaattcaatatttaattaagagatgatcagatccgtgcaccgaaattattgctgggtaagacaatactgtgtgtgttacatagcattggaacttaggaaagctctttccttgtgttgtttaatttaatccactcaacaaccctgcaaagtgggtaccattgtccctgttttttatgaatgagggggtgaggtgctgagaagctgtgtacgttatttgagtttgtctggctagtcagtggctgagccaagttccaatccaggtcatgtgagcctctgaactttctgataaaacctgcagacccccttaactgggataatatagtcatgcattaagcaagaaggagaagtaaatacaggctgatggtgtaggggagaaattcaaagggagaaggcctaggagggagagggagctatgtgtgaacagaaccaaagatggcctctgggaattggaaggtctcttggaattcgtccaaactgaggatcacaagtctccacattctgagtaggaggatgagggtctgagttaggatttgggtcctgcagggcttgctaaggaatcccctgatggcctaggattccacgcagagcacatctggtgtgagagagctcgctgcaagggtgaaggctccgccctatcagatagacaaccaggccaccaagaggcccagccctccaaaccctggatttgcaacatcctcaaagaacagcaacgggccttgagcagaattgagaaggaaatacccccacctgccctcagccgttaagtgggctttgctattcacaagggcctctgggtgtcctggcagagaggggagatggcacaggcaccaggtgctagggtgccagggcctcccgagaaggaacaggtgcaaagcaggcaattagcccagaaggtatccgtggggcaggcagcctagatctgatgggggaagccaccaggattacatcatctgctggtgagtaggcttcattaattctctgatgaatggacgattgcaagggaacttttttcatcttcaaggagccagaagaagtggtgattaaattggtcttttaaaataaaaagactccaaaggggtacaagtcttcaagcttcccctgtggtgttccgggcactctggcttctctttcggagggaggaagagcatctattcataggctgtgacttggagaggccccacggtgagtcaggcgcttgctgtgtgagccgctggttgctaatgtcttcgggaactgctaatttacccatctaatttgttcctgtacactggccacaaagggagaccactcaattattctgatccaaaagagaggcttgtgtttaccatgatctccccagcaactgtgtgagtgtgtgtgctgtgtgtgtgtgtgtgtgtgtgtgtgtgtgtgtgtgtgtttgcctaacaaccttaggcaatgacgaagaggtggggctgctgcccttgttagcattttcaaacacattccagttctgagttgagggcaaagattgtaatggggtgcttcagagaagccttggctcccaaggaggttataacttcaaagggtgtttttgaaaaaccaaggcggatgaggaaagtggctacaagttccttccatcacagaggatcaatgaaggggaacaaagatttgggagcatctactttgtgccaggtactgtgcttgggttttacacgtcttctcttgttgactttgcataactcccctttgaagcagatattactccaggttcttgccgtaatgtttcagcttaaagaaaaccaacccatacttctttaggttgccctgaaaaggtgaatcttctgtgaagccttttctgtctttatctgttaaaattaattaagctcttgtttgtgctcccagaaaatcactttagaccttagaaagatggcagcctcagttttctcatttgtaatataggggtacccatagggtcattgtgagaaataatagaaataaatcatggaagtgcttggatagtagctggtacttagccctcatcagtcatcattgtcattgttgttaagagtaataataataataatatcacttattataattactcacctctaggtttttaaaaaacttacaggccgggcacattggctaacgcctgtaatcttagcactttgggaggccaaggcaggcagatcgcctgaggtcagcagttcaagaccagcttgggcaacatggtgaaaccctgtctctactaaaaatatgaaaattagccacgcgtggtggctcatgcctgtaatcccagctactcgggaggctgagagaggagaattgcttgaacccgggaggcggaggttgcagtgagccaagatggcactattgcactccagcctgggtgacgagaaactccatctcataaaaacaaaaacaaaaacaaaaaaacttacataaatttatggggaacaagtacaattttgtgacaagcgtaaattgcatagtcgtgaagtcagggcttctaaggtatctatcaccagattgatatctattggtatctatcaccagattgatatctattgatatctatcaccagattgatatcaccacattgtacctattaattaatttctcatcatcctccccccacccttctgagtctccagtgtatattattccataccctaatgccatgtgttcacattatttagctcccacttatgagtgaacaatgtgatatttgtctttcagtgtctgacttttttaacttaagataacagcttccagttctacccatgtggctgcgagagacatgatttcattcttttttatggctgaataatattccattgcatatatatacaccacagttttaaatccaatcatccattgatggacacttaggttgattccacatctttgctattgtgactagtgctacgataaacatacaagtgcaggtatctaattatttcttttcctttggatggatacccagtagtgggattgctggattgaatggtagttctaattttagttctctgacaaatctccatactgttcttcctagagattgtactaatttacattcccaccaacagcgtataagagtttccttttctccacatcgccactaggttgtaagttccttgaatgtagggatcatgtctcttttcttcattgttttataacaagagcctaggagtgtttggcacatggcaagtacttgttttctagctgacagatgaatgaacaaatgagtgaaggatgcttcctcctcactgctgtgagcttctgagaatggacccttgtctgacctgcttctgtatctctagtgtgactgctttgtctggcacaacagaactgctcagcgattctgttgaacggatgctgctgcctggcccgtatctggcctggagagtctggctgcgagctcatctgtgctctggtctggctaaggttagctgcagccctaggaactcagagagtgtgtcctggacatttcacccctagttggtgagctcctcaagggtagggacggtgtcttgtttatttttaaattcttagtgcccagtacagtgcctggtacacaggagatgctcaaatggctacccctagcctctgaggtcccactgcactcaaagaagagcagagctccaaatgaccttgtcatctttcccctattacccaaacctgttcaatttccccatttctgtttattaaagatccattttctcagttacaaagatccaagactcctcgagggtattctaccctaacggaaataggacaggctttgtagtcagacttgaaccctggctttggcgactactagctgtcctgcctggagaagttgcgtacccttcctgagcctcagttttccctttcattgaatcaggatgataatacacacttcattcatccactcagcaagtgtttactgggcgcctcatacacagcaggaactgttctaggcactgcggatacgtagacgtcaacaaaacaaacattgctcttgcctgaaaggggcttacaaacttgagagggggagacagacaccaatcaaataagcaagtacacatatagtatgccagatggcaatatgtgctagggagaaaaataacacagagtgagggaaaatggaatgcgctggcccgggttattagtgtcttactcaggtgatgaaggaagacctttctaataagaagaactcacatctggggaagaatgttcccggaagaaggagaagagcaaaggccctaaagcaagagtttgaagaatgacaaggggtcctgtgtggatgaagcagagggagggaaggaggaagggagtgtaagagaaggggacacagagatggctagagccagatatgcagggccttataggactttggctttttactctgggcaagaaggaaaccttgggagagcttcaagcagaggagcgaaatgatctgatgcaggttatgaaaggatccccctggcagtggcacagagtatggcccctgacctgtgtggatggggcagaagcataaggctggccatttgcatcccacaaatgacctcagtgtgagggatgagcgagatcatatacgaatgcgcttgcgtgagtatgcatagagcaagtgctcaagccatggcagcttctatcaatggccctgcagctgcctggctatagctccctggtctcctgcagacaagtcttggccagtcacgtgagtgcctctgtcattgcccactcagtcattccccctgcccccacctcctttcttcaacccttcactggtggttaagctcctagcacagcagcctcacctccagcctctccccaccccaacccaacccaaatgcaactccactcacatccttcccctgttcaagagtcttccatggactagtggctcattaaatccacattcttggctaggtgcagtggctcacacctgtaatcccatcactttgggaggccaaggcgggcagatggcttgagcccaggagtttgagatcagcctgagcaacatggcaaaaccccatctctacaaaaagccaacaaacaaacaaacaaaaaacaaaacaaaagaacaaaacaaaaattagccaagcgtggtggcacacacagctgcttgggaggttgaggtgggaggatcacctgaactcagaaggtcaaggctgcagtgaaccacagtatcaccactgcactccagcctgagcaacagagcaagaccctgtctcaaaaaaaaaaaaaaaaaatccacattcctggagacttgcagctaaggccttccacaataagatgctgcatttacgtttcccacccataatcaactgctatcccaaacatattgaatatctgtggagaagtatgggtgggtgcaatatgtcactcctagcagaatcactgaggaaactgaccacactcatgatggaaaattgacggtaatgagtccttccctcaggttccccaaccccacaatatgccctaaccatggtggacatgtattcctgtctgtcactggctcacttctcccaccaggctaccgcaaactccacaatgatgtatattctcttaaagctacaaaatggcttgtggtttccaaatcagttttccttactgctcttatctcccttgatacttgcccctatgggcccctcatccataataaaatgccctcattttacacttactagttctgacaagagtcccaggttccaagtcatggattcccatatgggattgctcctctgatccttcattcctatatcttttttcaatctatccacaattcacaaagcatcggtgtcagaccaatggcaaataataagtgggacctgctggctatggatggaagagcgaagtccctgacaacatgtttctaccagcctggaaatgaggctctcccatcccctaacacatctaccagttgtgatggatttaaaggctggctaatgttaagcttgttccacaggggatagaatattggcccctggactgacacctaccaccatgtggatcttggagcaagacaaaggagccccccaacattcgtgttctgaaataacaatgcctgaggctgtctattccccaccacggatgccaaagcacagacagccactcacagctgtgggatacagatgcccctgtcattataaaaggccagccctaaatgctattacagagtctaaaaactgaaaatgttattgtgaaacctttaggttttttatagctggctatgcctgatatagctggtggcctgggacacagtttccctactcagcgctgggacacctcggcaatactgcacccacagtgtcatccctatctgtttggaatgtacaattcttctacaacaccatgggccaggaatatcacatcatcctgagcagccatcaggacaaacaaaaaggaatgtggtcctgtatgtttagtcccacctcccctacaaactacttttatcatagaaatgatgcccaattgtcagcccagcgcatgtggtgtcctccagcaccccttctaaatgtgccctcaagcaccccttcttctttgtgcatctttgtgacacccttccagatgtcagcctatatctccatgacccaaatctgacttaagagttgtggccgggcatggtggctcatgcctgtaatcccagcactttgggaggccaaggcaggtggatcacctgaagtcaggagtttgagacgagcctggccaacatggtgaaaccccgtctctactaaaaatacaaaaaaattagccaagcttggtggtgggcacctgcaatcccagctacttgggaggctgaggcaggagaattgcttgaacctgggaggcagaggctgcaatgagccaagattgtgccattgcactccagcctaggtgacaagagcgaaactctggctcaaaaaaaaaaaaggtgtaccagcccagggagacaatggccacattgcaggtgatgaccacagcccagccaaccactgcatcctggaggctgcccaccagttacccacatcatctaccaagggacccccttgctggagcacaaacagcttcccttgggggatccctcaatcagcatttgtcacatacctgaaaagggtggccaccacccaggccaccaaagttataactctctcctctcacttcctccccattgggcacaataaacctcattgccattgtggctggaacttcccttcctgggcctcccaaagcaattctactgcctaaggctatctccgggctaacttgtatgtacacagagataaagccacatcccagtggctggacctcatgcaatgttgggcctcctatctgcccccatgagcaggccactcccttatttgcaccacaaaaccaccaacaccaaacacttctggtctaggctcctaggtcttgccctgtcctatgttggctcagatgttatccagtctggtccccggctcatgagtccagatcatacatctatccaaatgtataaatacatgcctatgcttgtatcttcctaggcccacacagcacaactagtgtcatggcccaccccagatattaaaggaacacaagagattggaagccccagagggaacctgcttcacctgttccactcctagataacttcttcctgacgtcccaaatacctaaactcacctgcacactgctaagtctgacaacccccttcacatttttctgactgttctgcaatttaaccctgctggtcacagtccccagtcagaggtgatgggcagtcttcctacccattgtcctgggtataagcatgacttggggccagaagagtgggactaaggtcttacaatatgatcacaccaggaaaactagcagatacttcagagaaagatctgaggtcctatcagcccacgtaacacaaaaaacagcagcactggaagctttcactgaagggcaaaaacccctaactgccagggtggcagataagagactagctccagatgatatgccagcttcccagaaggagtatatgctctcagagggcatagtgtatcctgctggacgtggataaatattgcaaggcaaagtaatccaaatagcccaatggatgtaccaccaaacagaaaccaaattctacatgtggtactctgaactccctaggacttggatgtcccctatagcctggggtgaccttgttttaggagccctcctgcccacaagtagacttacatactgcactggctatgtaaaattggtacagcctatatacaagtatattagctctttggatggtgaaccaaatgttagggagtgaattttgaagaaattgagttgagtgcaaaaagttgctcccagcaaaatgtcatttgtccaaatagttaacacccactggggcagaaaccatcagggcaccccacccctcaccacccactcagccccactcacctctgcagcacctagtaatcatatgcaagaaaactcacccttactctttttgattgaccacccccagcctgacccccaatggagcagatcactcaaaattaatcttcccccactacctcctctcggcattattcaacaggtgggcccctgtcctatatctacgtaggtccccagcaccaggctctttctcctccccagaagtcagggagtcctcttctcagtggggccctcaaccagtggcttccctcgctgcctatgcctgcataagtaatacacctttgaattgcctgtgatcaccgggtcaggtgtggtgcgttttggcatccaaggcttttaaatgggagagaacagcagatctggttcctttcactggaatattgttatggtccaattctgcaaccagctgacttcattactacctgtgaactgcacctccagctcctccaactgaccccatacccagacccttacttgggctgtttcctaccagacacacctgctctgttaagaaaaccattattgaaatcaccggctgttaattcctactcagtccttagtagctctgtgagctggagcaagttctgtaggctttctgtgactcagtttcatcacccataaaattatgattacaatacttacttcattagagtgttgcaagggcctaaaaaacactctatgtatagctcaaagtacaagcctgacaacaaaggaagtttccagataatcgctcatcaaggggcaactcgattttctgcttcctccagaaagccttccatgctgatgtccatccactctgatctctccctaatccaatctgattgcagttttgatcagcacctcactgttgaccatggatttcttctccattacaaatgtgttcattttgacttccaagtaagagataaaggtcttggaaagaagtgattgcattttacctggctctcctactgactttctgtgtcatcttcctcttaattttggggagactgagtttctttctctgggatggcaaatacatggcctatgtgccaacactttcccatcctgaaacctcaggacacacaccagtgttctcatcttctctccagaacctgggtccagactcacaattcttcttaacacaatactttggacagtgtctactaacttatctaataaatatgttttgagtacttcgtaggtaccatcccccttggtcagtttctagaagttaaaacgttggacatcttgtatctgcacttatggaactcatcccttagtggagaagaaagacaatatgcaaatacacaaataagaaaatatcaagtagtgacaaatataatgatgaaaattaaataacggtgtgttagtgcctggggaggaggctattttttagatcaggtatccagggaaaggccttctgaggtttctcccttgatctgggagattgggtgtgggcctaagaatatgtattcctaacatgcaaacgtaggaaatttgggaaacactggcatagtgaatgaggtgagggcatagtcagaagacctaggtctaaattccgtctcctacatttatgcagctgtatgaccctgggaaagttattgaaatttctctctcactttcctcctctgtaaaattggaataatattactgatctcaggaggttttttatcaggattgaataagatcaagtatttaaaatgcctggcacataataagtgctcaataaaaggtaggcattgtttgcaacaattaggtctatctatttataactgtaatcttttgtttgaatcactcaagagacaaatccaataaatgccgctaggtaatacggtgtctgcgtgttggcttttgcctcatgaagctcttcctcttgaaaaataaattttcaaaagacattcctgtgagcaagaatgcccgagtctaaggaacaagggtcatccagttctctagtttaggcatgtttgagatttgaaagggctttggcctaatttcctctcctatcaaatgggcaccaggctacctgccctttttcactcatgggggatttctgagactcagagggataagagatttgcaaagcgtgagacacaaacagttgcagatacagacagaacacttgctttctcagaccggcaggtgcatacaatggcaaggccacctgatacaccagtcctgttcatttggaaaagggacaactccttcacattcacaagctgggctggtaagtgaagaataagaagaaaaaaaaaagaagtcggcaggaagcagcctcttcaaccagcaaagaaaccgttagaatccatccctgcgccctgatgccaaagttccgcctgccccacccgtcacgctatcaaggacacccgcctgctatcagaaagccctgggggtctttttccctagtttatcaaggacctgtggaaacatttctctaactgaagataagaattttttttctctctctttctcctttctacttctagctgtctaaaccagagggttcctctcattttctttcagtaacaactgctctgaaaagaagatatttttcaacctgaacttgcagtagctagtggagaggcaggtaaggtgggtttcattaattcatttgttcattcattcattccttccattattgtatgcttcctgcatgccagaaactgggctaagaaggctcttggatttaatcctgggcagaatgagcttgaggtctttggggaagccagactgcacttaacaattacaaaatgcggaattgtaaattgtgatctgaacttggagtgagagcatacatatttgagctgagagacagtgtgtataataattttttagatttggctcttgccctccaagtggacgttttcagggttaaaaagatgcctcagagcctagatgacttgctaccattccgtgccagccccgtctcccaacccaagtcacaattgcttgacccttgtgaaggcgaggatggaaatgacttgttggagtgatagagaggctagcataaacctgccaagacctccttcaagatttggttcattttgcaaaagttgccagataaaagatatttccagatggagggccacgcaggaaatacaaatggaatatttgttaatagctcttcctttgcgagatatgacccaaggcggccttctgcaatgtgatgggaagcactgtagcttgaaagcgtgagaggagtcagcaggcccacggcagtctcgaagtctttggaaaggggctctggcctgagcaggcattaaagatgctctgctcatcagagacgcccccttttccaccaccaccatcccaaatggagatgggacctgctatactctaagtattggattctcagacaggaggccagatatctagaagaatattgagctccttaatgctgtggctttgcataataacaacctgcactctttttttctgtccttggagtcaaatgggcttctgcaaagaagtttatccagaagtcagggatgagcactattcgaaaagtcctaagtgggcagggattgccactgattgcactgaagaatgtgttggagctcatgagactggcttccccataacatttggttgtcgaatggttccacagatgaacctgagaagaccgtgagctccctggaacaatatgtaaaattttgcatgtaggaacagagctacacctagggaatggtctttaacttttgtcagatttgtttggggcgtgtgggggttaaatacgtacatcgtaaaatttaacatttaaccactcccaagggtacagttcagtggcattaagcacataaatattgttgggtgaccatcaccactatatagctctagaactttttaatgttttccaactgaaatgttttgtccattaaacaataactatcccctccccctagctcctggcaaccaccattcgactttctgtctctatgtatttgtttaagtacttcacaaaagtagaatcatatatagtctttgtcctctcaggactggcttatatcactcaatgtcttcaaatttctttcatgttgtagcttatgtcagaatttcctttctctttaaggtggaatcatatgtgtttgcatgtatatatatgatatgtatatatatgatatatatgatatatatcatgtgtatgtatgatatatatatcatgtgtatatatgatatatatatcatgtgtatatatgatatatatatcatgtgtatatatgatatatatatcatgtgtatatatgatatatatatcatgtgtatatatgatatatatatatcatgtgtatatatgatatatatatatcatgtgtatatatcatgtatatatatgtacacataaaatagtatgcgtatatcactttaaaaaatccatctgttgatagacacttggttgcttccactttctggctattgtgaatagtactgctgtgaacatgggtgtacaaatatttgtttgagttgctgttttcaattcttttgggtttatgtccagaatggaattgctagatcatatggtaattctgtttttaattttttgaggaaccggcataccgttttcaataatgcctgcaccattttacattcccaccagcaatacacaagtactccaaaccctccagatcctcaccagtacttgttaacacttgtgcattagccatcctaatgggtatgcagtagtatctcattgtagttttgatttgcatctctaataattagtgatgtagaacatcttttcatgtgcttattggccatttgtatgtcttttttggagaaatggagattcaagttctttgcccattttgaaactggattgtttaaatccagacagagcttgtcttgctctgtcgcccaggttggaagcgtgatcttggctctgtcgcccaggcagtggcacgatctcagctcactgcaacctctgtctcccttcctgggctcaagtgattctcctgcctcaggctcctgagtaactgcgattacaggcacacaccatcacgcccggctattttttttttttttttttttaagtagagacaggagtttcactatgttggccaggctggtctcgaactcctgaccgcaggtgatccacccacctcagcctcccaaagtgctgggattacaggtgtgagccacagtgcccggcctatatgttctagatcttaatctcttatcagatatatgatttgtaaatatattattccattctgtgggttgccctttcactctgttgatggtgtcttttgatgcaccaaagttttaaattttgatgtagtccaatttatctatttctaattttgttgcctgtgcctttagagtcatatccaagaaatcttgctaaatccaatgtcatgaagctgttcccctgtgttttctttaagaatgttatagttaccaggtttttaaaaggtttgtgacaatgcatgggctatcttcaataatgattctggagtggccttcctcaccaaagcaaagacactcagggctttgtaaatatcagtgtgaatctaggaactgggcaattgataacatggatgtgatatttgaaggcttcaattcaaaaggaatgattaagtatctccatatctatatcagtaccctgggagctagtgaagatgaaaaccatggtctctcttctccaaggacttaaggcaagatgttgcaggcacacacgtgaaattattgcattgcaaggcagaatctaatgaggcacctagctaggcactaggaccaagggctataagaactcagaaagggatcaccaccatgagcttcaggggacagagaaaccttcagggtaaagatgtagcttgatctgggtccacattggacaagatttggagaagcagagaagactggagaggaatttgtactaactgcaataatcattgccatttactgagcacctactatgttccaagcactgtgctctgcccactgcatacattatctcaatgactactcctaaccctacatttatcattgtctgtattttatcattcaaagcactgaagctcagagattttcctaagatgacccagatagtaagttgtaaagcagagacttgaagccaggtttatttatctcaaagcctctactcttaatcactctactattctagtaccaaagctttagaacagggagaaagcagacatccccgatagagagaaaagagtaacacagtgcacagaaatggcacaagcaggatatttaagatcagagaggagaacaggctggatgggaaggttcagggtccaggactgtgggatgtaaagttggatcaatggagtgagcaggattacagggtgcctttaatggaagcatgggaaatttggtctcgacctgctagaatgacagaatcacacatagaatttcagctctaaccttccagtctgcctcttttctctataaaatgagaaaattgaggtctcaagaggttaagcaacttgtggatggtcatggacgatagggaactattgcaaattcttgagcatggtgttgacagggaagaaaacagtattccagatcagttagtgtggcagtaaaacacatgaggggtgactgaagggaagcagcaaaaactggcagaaaaaacaagcagctctttctctgttttttttttgccaaaggatacctccctcaacaatgggcattcctagggagcatcattaacaagattccagctctactccttcctgctgaggtttgtcgcttaagaatctggagacaggtagggtgcagtggcttacacctgtaatcctagcactttgggaggccaaggcgtgtagatcacctgaggtcaggagttcaacaccagcctgaccaatatggtgaaaccctgactctactacaaatacaaaaattagccaggcgtggtagtgtgcacctatagtcccagctactcaggaggctgagacaggagaatcacttgaaaccgggaggcagaggttgcagtgagctgagatcacgccaccgcactccagcctgggtaacagagtgagacactgtctcaaaaaaaaaaaaaaaaaaaaaaagaatctggagacagcttgtaggggcaagtgctatcagaaaggtcagaatcaccttcccctgccaggctcagtgccctttgatggcccagatgccagaaaacacagctgccccagcagcgacctgtcctcatcctccccacttcctccaatagaaagcctgtctagggtgcaatggcttagatcagagacacgtgactctgaagagccaatggccaggaatggcttctggcaccttctttatgttgccttcctgaatgtgagcctgggccaggcctctgtgaacctaactcacctgtcccatggaggccaccataccaggagaggtaagacaagacactccgttccccaggcaagaatgttgaccccaccttacttgaactaagcccttgtagggcagaactccacttatccatctatgtccagccaagaaagccctgccctggttgactattgtcctctgaggttctctttgcttagttaattctaataatagctgccatccattgagcacttattctatgttgatcactgggctcagcatttggcatgcatgatttcattttattcctacaaccccataatgaagatattgttatccctgttttgcacatgatgaaactgaggttcagggctgttaaataatttgcctaaaaccatgtacttaaaggagccaagactcaaacacaagcctttctctctccaaagcctttgcttttactcatatgattgactgcattctacactttagtccttgtagagggtagaggttctgcagtggagagtcaggcttcaaagagtggccttgttaattccagacaccacctgtttctctgttcctgggagccaagagcctgatctctttcccaaaccaaactcttggttccaaatataaatggtatctggaccattattcttctcccagtaatgatgctcaagaaaaacaaaggaccttgaagttccttctacactttcacccagagggcatcatgcaggcatgctttggccaaggggaatggtgctgccatttgtacagtcattcttttaatgaatatttattgagggccagccacacgttaggcacgttctaggtgctgaagacacaactgggaacaggtcagaaagagtttccaccctcacagagtttacattctagctgggaggaaaggccaaaacaaaacacacaccaaaaccctgcacatacatctgtagtaaagagcaaatagtgatgatgctaggaagaaaaacaaagaaggataacggggatggagagtgaggagaagaaggattttataaagccctctgaggatgaaatatttgaacagagacctgaatgaagtacatgggagccatggggtgatccagggggaaagcattgcaagcagagaaaagggcaagtgcaaaagccttccagtaggagtcagcttggtttgttttaagaaccagaaagaaggccagtgtggttcaggcagacagagtgaaggggcatgctggagaaaaggacaggggggcagcagaggccagataatagggccttccaggccacagtgaatttggatctcaaatatactgtgccggggtcccaggcactgtggtgtgtcactcaggtgtggcacctctgcatagctacagagaggagacaggctgcctaaacaaagagcacaaagacagctcagtgagtcagctcacctggctctgactcccaccttgaacttgaagcagcaaataaagcccagggtttggtacccaaaggagaaggtgggggaaggtttgacaatggcctgaggtggaagaaggagctgttgaccctgtatgtctcatttgctttgtccatcaaagggtctgaattatcaatgggtgctcaaactttttttttttttttttttttgagaaggagttttgctcttatcgcccaggcttgagtgcaatggcacggtctcagttcactgcaacctctgcctcccaggttcaagcaattctcctgcctcagcctcccgggtagctgggattacaggcgtcagccacctcgcttggctagtttttgtatttttagtagagatagggtttcatcacgttggccaggctggtctcgaactcctgacatcaggtgatccacccacctcagcctccgaaagtgtcaggattataggcgtgagccacctcgcccggccgcccaaacattttaaagttagaatctctttttataagcaaaattttccatagaaggtgactgtgtgccactttcctctccaagcacctgatctgcttcatttcacagaatccttagaacagctccacgagtaggtactctgaatactcccgctttacagatgtggaagctcaaatgcagagaggttgggcaacatgcccaaggtcaatgaatgcagaactgctgcagtgggagcaggggtgggtgacacccactagggaggtgctttcaaactcctactgctccaaggagcaagctagaaaatcccacttctcaggccccttccactaggacacactatgagcttaacactgctaagaactcactgaggaatggtgacatttgggggcggctccttcagtgctttgtttggcttcttttttaaattataaatggtggtttgaaagttgttggaggggaaaatcagatgaaatcagggatgtggctgaagcagtcagtgtagcagtgtagcagagaagcagagaagctgtcagcagcctacccaggccccgaaatgggcacagccctgcatttctggcctgaggcttgccgaggtcttaggtgaacttcagctctttctacagcaccccagtctcagcactctttggtggatgtcctgattggctgggagattgttgcttcctgatacagtggtgattacttctgaaagatggggtaataccaacagctatcgtttctgaccatttactgtgcagcatcactgtgcaaagtatttttatacatatcctattgactcctctcaaaactcctgtgaggcaagcaggcaccccagtggcctcatcctagttctggccctggtgacattatgattgcctccatcctccatttgataggtacagaaactgaggttcagagaagtgaagtaaattcccccagatcacgcagctagcaaacagctgagcttctatgctcatcctaaggctcggttgaaatggattttttaaaagatgtattttgggctctttactatatagaaaaccgaatctgtttatcactaaggttactaataggccttacatctgtgaaaacttatctgtcagctggccctgaaatgttctgaaatgagtctgagcacaggatgcctgtgacaaccgaatagtttaaaaaaattctccatgggagccgaaaccctattaagacaggtctttatttttgttcctgaatgccacatttagaaacaaaatgtcatatttttgtatatgaatgtcacaagtgacaaagcatatgttgcaacttggcttctaatggttgaaaaaaaaagagaggtaaattatcataatgttgggatcttctcaattatatttgcattttcatttctatcagaagtccattttagcaaaggaatgtaaccttagtcacttgaaactgctgttcccttagaaaacaattgtaaatgtaataagcaaaaaggatagaaaatgcccacaggggaaaaaaatgatccatctggggtcagagccatcgtgtagattgattcattcttcttctagcattcttattcaggaaggaaaacttgaacattttctagattttaggatatttaagatttgcaaggaattgggggaaagggaaaaggaatgaaatttcagtcccactggcagggatcaaatagagattttctcaacttttaaaagaaccgttttacatgtcccaatcacctcatagttcctgagtctctcttctgcataaggcatgtactagttgttaagggaggatacaataaggtcatgattgctttaaaattattcataataaaaacacattttgagacttgattctaaatgttaaacttaaatttgagcaatttaattgcccgttgaataggaatgaaatcccaccggtaggcagttatttcttacaaccactgtgtgtgaaattgaaatcttaagataccatttcaaatattcaccttctctaaggaagttctccccaaagagttgtgaaagataagaaactgacccaaagtcatatgcagtaatctctttttctttacacactcaggtcaaagtagaagcatattattaaaaagaaacgttatgccctgaatttggctgttctgaggttacctcttggaacccaaggatatatttaatttaaaaactgacttgagccccatgcaaaactgtgacaaggaaagtaataatttatcagattaaataaaaacaagcagatgtggccaggcgcggtggctcatgcctgcaatcccagcactgtgggaggctgaggcagatggaccgcctgaggtcaggagtttcagaccagcctggccaacatggtgaaaccccgtctctactaaaaatacaaaaaattagctaggcgtggtggcgagcgcctgtaatcccagctactcgggaggctgaggcagggaaaatcgcttgaacccaggaggcagaggttgcagtgagctgagatcgcaccattgcactccagcctgggtatcagagcgagactccatctcaaaaaacaaacaaacaaacaaataacacccaagcagatgcaaacaggtcatttagtcaccacgataatgaacgttaaaatggaaaacacttacatgttttatttaggagaagaagggggtgaggtgaaggaatcctgtttcctgcttttaaaaaacaggaaatagtttccaaatttgggtgggcaattcttattttaaacccccatttcacctttaaatttaatttcaagctcttttaaaattatcttaatgatgccctttactataacatagcagctgccatttatgagtgcttactatataccagttgcttttcatgcaagcaacttcatatctgttattacccccatgccattacaaatctatgtgccacccttttgtgcactaactcatataatccccacaataacttaggcaataggttctgtcgtctccattttacagatgaggatactgggagtttatttgtttgtttgtttatttattttgagacggagtctcactctgtcacccaggctggagtgcaatggcgcgatctctgctcactgcaacctctgcctcctgggttcaagtgattctcctgcctcagcctcccgagtagctggggttacaggcatgtgccaccacacctggctaatttttgtatttttagtagagatggggtttcaccatgttgggcaggctggtcatgaactcctgacctcaagtgatccacccgcctcggcctctcaaagtgctgggatcgcctcggcctctcaaagtgctgggattacaggtgtgggccaccgagcccggccaggatactgggagtttaaattcctgctgtgagcccaggttgacacagctggtcaaggatgggttagaatccaggtagtctgactccagagctactaccgcatactgcctcctcagattaaataattttcctaggacatgctaactgataagtaagagtctaaatcaaacccaggcagttgggttccaaaattccagcgtttaaccaccacattgactggttataagtaggtaaactgttcatcacaacctatatatttattttcatttctgttagaaatgaaagtagtgtggtaggttacatatttatcacatagtttaggcttgcctaaattctaagtattttcttttttaaattaaaaacaagggtctatcggaaaaaaaaaacccaactttttttttttttttttttttttgagacagggtctcactctgttccccagactggggggcaatggtgcgatcatggctcactgcagcctcaacctcctgggctcaagcaatcctcccacctccgcctcccgagtagctaggatttcaggcaagcaccaccacgcccagctaattatttttattttttattttttgtagaaacagggtctcactgtgttgctcaggctagcctgggtctcccaaagtgctgggatcacaagcatgagccaccgagcacagccgaaaaagtctttttgtatactgaagtctccactaggacaaaaatttgctcttaaggcttcctttgggacacacacacacacacacacacacacacacacacacacagcttttgattatacccattagggacccaagccttgggacacagggaccagaaaatgacaagagcatgcaggcagtagtaaactctggttatacttaaaatgggaacagaaatgtatgcctatgatccagactgatcatataaaaccatggatcctgaaagtacgttccctctttacaagccttaatgactggcatcacgcacaaataggcctttcagcttctgaacgcagatattttcaaggaactctgaggcccaggagagcctaagtttttctccacggaagggcaaactactagcctcccccgcttcccctctgcgttcctgcctctttctagaaggaggctgagagggggaagcctgaacccccaaatcaagtccgccttctttctctgtgcctgacccagggcaaaataatctctctgatcctgttcttgaccattgaaaaagcactttctctggtcgggatactactggcactttacatggggggcagtttaaccgcaggagtccgctttctgaaaggtgcagagggaggggattccgccaccagccgactgagaggagccccggccccgcgtggtccctcccagccaccctccctctgggattagctgccctggctctgctctaggcgtccccagcccgtgcagtcccggctggcgcaccaccatcgcctctgcagagcgcggccgcagcccggagcccgcagcccggagcccgcagcctggggcccgcagcccgtagcccgcagcccgcagagccgcgctgtccggggcatcccagtgcacggcgtccgtggacctgggacctcgaacctgggacgggcggaaaatccactgggaacacttgcatttctgtaggtgcttatttcacattcttgtcttttcttgcttgctcgagctgttcgtgggttactttctgccttagttaaaccaaaagggaaaggcggaagaggggaagccctgaagaatgatttagtggttgcccagcctcctttccaaggagaggtgttcgctgagcggctctccccgtccccgacactggcccctttaagaagccaagtcagtcctgatgctgctgtttgtattgctaatccccaggagccccgtttaaaaaaaaaaaaaaaaaaaggaagaaaaaaggggaggtggggggaccgggcagctgtctctttaaatgtgatttccttctattgtatttgaatcgtgatcaggaaaaaggaaatgaaaccagagacagagggaagctgagcgaaaatagaccttcccgagagaggaggaagcccggagagagacgcacggtcccctccccgcccctaggccgccgccccctctctgccctcggcggcgagcagcgcgccgcgacccgggccgaaggtgcgaggggctccgggcggccgggcgggcgcacaccatccccgcgggcggcgcggagccggcgacagcgcgcgagagggaccgggcggtggcggcggcgggaccgggatggaaggttaagtcctgagcagcagcagcagctgcagccgcctggagccaggctgcgcgccccggcccccgcctcggccgcggcgcgcccgcagcccggtgattcgctctctctctttggcgtttgaagggagcgcggtgactgtccttgagcgcggaggggcgagctcgccggcggagcgccggagcaagcggaggcgcaggagcggcggcgacggcggcggcggcggcggcgcccgagcacccgagggggtccgagccccggcagccggccagccccgcgccacaaagggagcgcccccgccgcccggcaccccgcctccctccccaatgtcctcggccatcgaaaggaagagcctggacccttcagagtaagtgcggcccccctgcccctgccacccccggtgtccacggcctcgcgtcccggagcgtcggggggacccgggcggcccgcgagggggctccaggtgcgcgctcgcggcgtgcccttggccccctgtgccgagcgctgggctcctccttcctcccgggtgattccgggggctctgggagagggactgggcggcgggcggcagggacaggggtcggcccggcgcctctgcgggccactccaggctactgggacgctccccaaagccaccacgggccagaaagtttgcacgggagcaggcacgaggagagcctggaggcgcgcaggtgcagtccggagagcgttctgggcttgactctgctcccttcttccctctccttctcggtcctttctctttgtccatttggtcttggaaaggggaacattccaagtggcggcctccggggtccccaacggccgccttcccggtccgcaggtggagccgctgccagccttgcggataacgggcgggtgaggggtccgaccgtccacctcggagctggctctgggcctccagggatttctagagcagcgaaatccggagtaaatctgagtaggtgtacccctcctcggggtccaccgatggggacatgtgaacctcgaaagttaatgcaccattttgtgtataggtgaattattctggggagtagagtctcgtagtttttagcagagtcttaaaagggtttggggtcagggaaccagagctctaatgagcattggccgcatctgttttctgagccgcgtactggtttggaatgtttttctatccctcacccattcttcagcgttaacatggggagtaaggggtgtttaagatatcattttcctgtcaacgcaaatgcccttttaagagtcattagctgtctggttttgagaatttttattcctttgaagtccccctctaatcctttgaagggatttgttacacaagaccaaaggagctggttaatgacttgtccatttgtgcttttaagagacatttgttttgttttttcttttcctgctttaaaagaattgtgctttcctgcttgaaataccgcacacacacacatacacccttcaatttcggctttctatggtgtttatttacctgggttttaccctcagttaccagcataaaagctcaacatattctcataaaacacaggaagtaccaccatccaatgagaatataaacatcactattcagtcttgaaggttaagacaccagttctgtaatgagctaggtttgttataacaaaaacccccacttccttcaacaaattctcaggagaaaaataacattcctttttaaaagtatgtttatgcaaacaatgggtttaaagggtggtttgatcacttttttaaaataaacttaaaactgagctctgagtttcagagactgggcaagatcatagtaacacaataagggagtgaattggatgaattggtgcctcatgcctttttgatcagcagaatttagtcactaatcctttcaatagaagattaatctgaaggtttcatttccctgaaggaagtttgcttctttcaaagtttgtgctttttcactgaggttagaaactgaaacatcctaacttcctaatacaacagatatctactgctggaggctcaccagctccttccttcacttcactatttgcccaacgaagacagattctgatcaaagagggacaagccagttgagaaattgctgcagcacattctccccatgcccttagaaattgttatgattgtcccagaaatccaggcttaaatgatactcaggtgtaatattcaagataagggtctgggagaatataaaatattaatttgagggtgaatcaatctaattcagtcattgtcttggattgtccactaagtataatgtgatattatcattaattaagtatagaaagacagagccaatatcttatactttacttctccatctcatctcaggccatcaccgtaactcttttactttacattcctcctgttgtccagtatcctactagatgcttcattgtgtacttcctcaaatccagcttgggtcattacaatcagcatctccaaattacagatggagacttgcctagctatatgcaaatgaaacatttggacagaaagccagccagaattcatgaacacagattcccttgctgtgctactggtggcccccactgcctcccctgtgagtaacaagagcagttcatttgaattccaggcagttttgcaccagctaagggcaaattctcttctttcacagtcctttggcagcatcaacatcgggacatccaatgtgcgtccaggttccatgagtggttttgaaagcccagagtaagaccatgggctgtggaaagagaagagatgcaactctgagttgatacacatgaaaaagctagggtattagttattagaaggggaaatggcagtccttatatacaatctgtagaaacaaaggaaagaaagcaaggcttcagtgaatgaaacctcgtctctacttaaaataaaaaaaattagctgggcctggtggtggacacctgtaatcccagctattcgggaggctgaagcgggagaatcacttgaacccaggaggtggaggttgcagtgagccgagattgtgccattgcactccagcctgggcaataagagtgaaactgtgtctcaaaacaaacaaacaaaaaactatagttttgaatttttttgagctagggtctcactgtgttgtctagtctagagtgcagtgctcactgcagcctcaacttcctgggctcagatgatcctcccacctcagcctcctgggtagctgggactactggctcatgccaccaagcctgggcaattttttatatgttttgtagaaacaggattttgccacgttgcccaggctggcctcaaactcctgggctcaagtgatcctcctgccttggcctcccaaagtgctgggattacaagcgtgagccactgtacctggccattttttttccccagataaactaacttgagcttcccattttcttgttccaaagatgatagtctcatgaagtgctgttacactgtgtctagaaagtgtgggcatggctttagcactcctaaatattcataaggaacacttcatacttcacatgacgggatcacctgaagttgtcagagtgttatagacattgagccacctagcctcctgtccccaagtataatggctgctgggctttatgggcacagaccaattaggacacaaggtcgcctggtaagttagtaccagttagaaataggagacatggatttatacctgcagggtacccaggaggaaactccctttgggaattttacagatggaagaaggtctgttttttgaaacataatagatttttaagaaatagatttgtgtttaagtaaggttccagagaacacttgctaattattataaatcaacacgtattaagtgtttgctgtgtcccatgtgggggacactagaataattccttccactcctttattttcttttagcaaagttatttatttttaaatgtaaaaatgtattcagattccagtgaagcaaagtgaacaggagatgctatgcatggcgtattaacgaaagaacacgtgtcacagcctattaacaattgctggattgagatgtcagtgtctgtttaattgccttccactctctttgaaataatcattgcccccacttcattttcttcctcaaatcaactttatccaaatcaattttactcttataaaaatgttcaggtaaggaaagaaaggcctatttgatgtccttcgtgtaacaatggccttacgatatgggattttcctccaagtattccttcagtaggaagaatggaaaatggaatttctgtaaaaaagtaaaattaggagaattcctattatgtcctgatggaattttgattttggaaagagaaagcaacctaaaataatttttggtctcattcttctttcttcctcacctctgcttttgtgcagttggttagggctggagggaggatggcactggggatttgcagattcttagcactctgggtcatctgctgccctggcagtgagcgactcttttagtccagagtgcgtcctttgaggttaggcagtgcccttgggtgtccaggttatgggaggaggaaaatgagggagatctgtgaagatagagtcagcggggagagtgggaaaaagcagaaggagaccagaggtgcccaggtagtgctgggcatgggcaggggcacagtgccacctgcaattgcctttgatgcctcttggtgccctgtgtttacttcttagacatctagggagtaaggtctggctctttcccatcttaacccaaggttggttgggactctgcagtctggccaagggatgtgttgtcctgtcccttctcccttaggtcactgaaaggcagtcaggtgagatgccctgtctggcccaaaacgatctcggaccctcggtgctggtctcactctggtgaggctgtccctgatgcttggccttctctccagggaaccagtggatgaggtgctgcagatccccccatccctgctgacatgcggcggctgccagcagaacattggggaccgctacttcctgaaggccatcgaccagtactggcacgaggactgcctgagctgcgacctctgtggctgccggctgggtgaggtggggcggcgcctctactacaaactgggccggaagctctgccggagagactatctcaggtaccctccccggcactccactgggccctcggaagggaggctgggtggtccatggacatctgcagtcggtgtgtgttgccccttaccctgctccaggctcggacaccacctatagaaagaggtcagactgcagaggctgagtctcagctcctgtgctgagaagcagagggcatttcttcctgtttgagaagcatgttctcagggttacgttcctatgtggtaaaatactaatatctttaaaggcaagagaattgtatacccaaaattcagaaaagtgcttcccttggggagcgggagaagctaggggatgggattgaggaggagtacacacggaggatcagagggactgggagtgtttctaagtttggaggtgggctctgaggacctcatttgaatgcttcagaacatatatgtatgttataaattttttttgtatgactccagtattatatgatgagaaatttaaaaatagaaagcatatggagctccaagcattgactcatagcaggaaggcagtcttcgaagagcagaaaggcaaaggccctgtaggcagttggaggtttgagtcccaataccattgcttcccagcttggtggccttgggcaagttatttaaccttcctaagcctcgatttccttatctgtaaaatggggatgataatagcacctacctctaaggatgtggggaggatttgatggaataatgcagataaactacttggcttggtatggatcaaatagatgttagctgctcttacataatcattattttccaatctaatgagcaaagggatggaagaatggaagagtaaaataggaactcgacaacaccaagtaagacaggagctgaggacatctcccatgctctgggccatcctattggccatccgaattttccagcactgtgtgaaagcctttgcctagaatgtactagtgtttctagtttccgatgagctgctgtggaggtaactgtctctgtgccctctactgtcagatctgctcaactgtgtagctgtcagtatttctccgttttcctggagcagagggtctgtgaagcatgcttccctgatacaccaggaccatccaacccatggaagcttgttgagacctcagcgcccttggctgctgggccagcttttcctcccaaacctgccctcagagcattttacattatagaaacaaaacaaaaccaaaaaaactgcaggcagtttcacagtgaaggaagctttacctaaagactgttagaagaagctttttgtccttgaattcccagataaagttcttgcagtccttgcagatatggtggttccgagaaaataagtaggattttgcaatgatcatgcttataattttggtcagttttctttttttttaagtcacagaaaatagaacttggataaatacagacctggttttgctcactcccagtttgccaagtcagtgagaaggcagacgggtaaatgattcccatcggacccttgactccatccctgtcaaatcatttgaatcttattaactgaagtgcagatagagtaaggtcagaagagccccagcttctccctatctctaccgttttatataacattcaggaataaaaccagtgctgcctgggcttgttaatcctttccattttcaaaaaggagaggaaaaaaaaaacagtctgggagaacccaatgttaattaacttgtgtcttggtgacatgaaataattcttctccctgccacattcctaggcaacatgttaattaactctgcattagtgcaggcatttccagccattctttaatatttatattattgttattaaaatgggcagcagagagcttaagatgggacatctcttgacagaggagaaaaattgtcttttgcgtcagggatggtcctttagccaaggtcttgtttactggcattcttagtatatctggcaggatcttttaacaaggcaagttggaggagtaactgaacgggccctctaatgtgtttgagttcttcttcacccctaggataacttgtccccgtgaggatttccaatggctgagttgcctgttacagttcttttccgacatttagcttcaaatattcatgagacccccatgcagaacctcaactctgctgctgtgttgtattgttgggaacccaagagcagctgttcatgtctgtgctgagccagatctccttggatcccttttcactaattcttgtgtgctgggagtggtggggtggcggtgatggcagtggttttgcttttaacagccagcacctgaatctgttagagccagaagtatgcctgccccaactagacccccaacggaccttaaccagtgacagacatggtgggagtaccaagccccgcagccttgcctggagccaggcataacttatattccagggtccctcccctctgagggactttgcctgaggatacaacttggcttggcttcctccccttccctccagcctcccctgctgccttccaggtttttcctgagaatgcctcattcataaatcactggcacatcaatccttgcctcaggggctgcttctgggatatccagcctaagataccaattcttggtgccagaggttaatgctcaagttaggtgtcaagtcccggcttattttttactaatattagaatctccgaatcccagagctggaaggggctacagagaccttctttttcagttcccttgctttacggcttaagtcacagaagcctgtacaggggactccatttgctcaggtcacctggcaagttagaggtcatgctgggacctgaacttgtctcccacatattcgtcctttgtccttcccttcatagctgcctgatgtgggttgtaatttaccccctgacttccctttaataagctccctccttccttaaggatcgcacaccccaggcagttggattcattccatgcacactgttttctcagtcgttcatccttgctcaggcccaaacttaacttacagagcagtcaggaaaccagaactgtctttccactctgtgacctccaatgtggcggttacctgcagctccaccatctgctacgttgggataaaatgttctccccccagtaatgagtttgctcccaggcggtgctttgaaaacactcagagatcttcaaatggaaagcaggattcagaggcaaattagctggccctggcccgaacaatgagctctccactcacagaccacctcttgtcaattccattaatctcgcccaaatattgcaaaatgtgtcaactgcccttaggtcccctacaacctctcagaatgtacccactgattctctgatatcctgaaatcaaccagaacttccaataagagcaagcattcacctaaaactgtcctaaaggttttatgtagaaaccacctgctaacatgctatgttttcagccacgagtgaaaattacttcctgcagcaagactggcgcagctgggaatacacccaagatgtgttaaaacataaccagcgttggcttagcccttgaccatgggtgccctgacatgcttcgtttggttgttttaacagctgagtgaggtggagcctatgatggctgccatttcactgaggctcagagaatcagaggtctctccagggtcactcagggctggtccgggacattgaagctgggtcttctctgcttccggtacttgtgttactgcacttttgctgttgcttctcaaatgtcagcctgcaaccagtcccccggaagtgttcgttaacgcacagactgctgggccttctccccagggtgtctcagttgggtagggaaggaggagggctgagaatttgtttttttgtttgtttgtttagtttttgcttttcttttgagtcaaggtatggctctgtggcccaggctggagtgcagtggcatgatctcggctcactgcaacctccacctcccgggctaaagccatcctcccacctcagcctcccaagtattaatagctgagactagaggcatgcaccaccacacccggctaatttttgtattttttgtaaagacacagtttcaccatgttgcccagggtggtctcgaacttgtgagctcaagtgatttgcctgcctcagcctcccaaagtgttgggattacaggtgtgagccactgcgcccagcctgagaatttgtatttctgtcaggttcccaggcagtgctgatgtcgctggtcccaggaccaacactttgagaaccactgcactgagccctgccatgttctgtctcccaccttgacactgaatactgcctgaaataagtgactgatcaactgaggcttgggagagtcttgatttaaatgtcagaaaagaagtttcccttttgattcatgccagtgggcagcgagggccatgaattaagatcctcccttcatggtggagagatgctgttggtcctccatatctcagaggcacgattagctgcaccgcgtgttttctgtggaactccctgtctcccagcagctggggccccagcgaataatcagggggagatgtgctttgcagcttatggaggtattcaaggccagctctccccatgggtagaatcagtggctgttgacatgatagagtttgggagcctcagaagaatgcccgttttattgcattcctggtcagtaccctctcaaaggggcccctagggtctctctccagctgctcttctgaaatgagggttcccctgggaggggacaggtaatacttgcctaactccttatgatagatcacatcagctgagagccttgcccacagaggaggagccagggggcagcctaggggaatgatgagcggttgctgcagacaaggagagggctcagaaaagggaggagttatgccagatccaaatgccagtttcatctgagttccctctgcctgctggtgaagactgcactagccggccctccttctggagccgaccttccctggcttcctgacatcctgaaagttcggcctcctttctagggctcatccccgagccctgtcttccaggattgtccctttcactgtcttcttagcttttctttcttttgccccaggctttttgggcaagacggtctctgcgcatcctgtgacaagcggattcgtgcctatgagatgacaatgcgggtgaaagacaaagtgtatcacctggaatgtttcaaatgcgccgcctgtcagaagcatttctgtgtaggtgacagatacctcctcatcaactctgacatagtgtgcgaacaggacatctacgagtggactaagatcaatgggatgatataggcccgtgtccccgggcatctttggggaggtgttcactgaagacgccgtctccatggcatcttcgtcttcactcttaggcactttgggggtttgagggtggggtaagggatttcttaggggatggtagacctttattgggtatcaagacatagcatccaagtggcataattcaggggctgacacttcaaggtgacagaaggaccagcccttgagggagaacttatggccacagcccatccatagtaactgacatgattagcagaagaaaggaacatttaggggcaagcaggcgctgtgctatcatgatggaatttcatatctacagatagagagttgttgtgtacagacttgttgtgactttgacgcttgcgaactagagatgtgcaattgatttcttttcttcctggctttttaactcccctgtttcaatcactgtcctccacacaagggaaggacagaaaggagagtggccattctttttttcttggcccccttcccaaggccttaagctttggacccaaggaaaactgcatggagacgcatttcggttgagaatggaaaccacaacttttaaccaaacaattatttaaagcaatgctgatgaatcactgtttttagacaccttcattttgaggggaggagttccacagattgtttctatacaaatataaatcttaaaaagttgttcaactattttattatcctagattatatcaaagtatttgtcgtgtgtagaaaaaaaaaacagctctgcaggcttaataaaaatgacagactgaaatacagtgttgtttatttgattacgacttataatttgggatggcggggaaatgctctgctttttcttttctaaaggagaagcaaataagcaatttactcttaggtcaaataaaaacttctgtgtattgcaagggtttgtatgaggcaggcacatttctatattactggcaattatgtaacaggtcatcatgtagctcagaggaatgtagaataattaaattgttattgtacaatatgcatttcacttcagcattgtatggagtgagtggaaggcaagatcattgcctttgggaaacttgtaacctagaaaggacacaaatacataaagcagattccctttgggagagaaggtaattacctagtttgaaatgtggcaaagatgctgagcttgacacttcgattttccaagacgggtgtctcagggtgttttatgacaagtggttaagaggacctttactttgcggatttaaagcaggcaccttggtttgtgtgtttgccttcccccgagtcaggccgcccccatgaactgatgcagagcgccaccttctggccatcaccttaaagcgcgctagcccaggagggtcccgacgtaggacaaacctagatgaagaagaatatgcttttcaatgatttccttagagtactcggaaatgcaagaagtctaaatgtgttcagttattaagacacaagaaacatgcagctaaggctgcatgttaactataagattcctttaaatcttcctaaggtttgtgatctttgttatttttaatttttttaaatccctggacagagagacaaatgattttttttcttctagaggagaaataatgaagtgatggctctcttggtctgtaaaatgctacaagtagttgggaaatttgactgcttaaggtggcctatttaaaacaaatccagttacattgcattccagctcaggtgatggaaaggcattaccagcgaggggatgtttgttctaagtcagtggttctcaaactctctggggaccagcagaatcaacatcacctggtaacttattataataaagaaacagattcatgggccccaccccagataccctaaatcagaaaatctggggatggggttcagcaatttgtgggttgtttgtttgtttctttgttttgagacaagatctctctctgtcccccaggctggagtgcagtgttatgatcctggctcgctgcagccttgacttcttgggctcaagcaatcctcccacctcagcctctgtagtagctgagactacaggctcacaccaccacgcccagctaatttttatctttttggtagagattgggtttccccatgttgctcaggctggtcttgaactcctggactcaagtaatccacctgcattggcctcccaaagtgttgggttatagacatgagccaccgtgccccacctgtgttttaatatgccttaaagatgattctgacgcatgctcaagtttgagaatggctattctaaaatatctcccagttaggaagatcaagcattctaagttattaatatttgatgcaaaggttaatcactgaaactcttccacatgtagatactgtctacccttggttcctaaactgaaaactttcacatacattcatcactcatttgttctgcacatcatcttcaaaatcaatcacaatttaattcaccattttaaaccatatttacagtaataatagtaatggtaatagattttatctatgcaattatcttataagcagtattaagtaaaaatacaaatgatcattgctttggaaatctaaactttattcttaatccccattgtagcacaacacacattaagattcaagaaatcagccaatatttttgtcatgctcaacaaagcaataattaaccttttccatttgtcaatggcaccatcttgcagaattgtggatgcgcaggcagtctttgtagcacgtcaccccaggggcccaaatatctaacccacaactgacttaagaggaaagacatgt

SEQ ID NO: 12504 - DNA, 27684 bp, Human
cggctctctgtaaaatggaccaatcagcaggatgtgggtggggccagataagagaataaaagcaggcttgcccaagctggcagtgacaactcgctgaggcccagtttacgttggcgaagctttgttctttcactctttgcgataaatcttgttgttgttcaccgtttgggtccacgctgcctttatgagccgtaacactcaaccgcgaaagtctgtagcttcactcctgaagctagcgagaccacgaacccaccgggaagaagaaaaaactccagacgcaccgccttcagagctgtaacactcactgggaaggtctgtggtttcagtcctgagcccgtgagaccacaaaccgaccagtgggaagaaattccgcacacatctgaacatcaaaagtaacagactctggataggccgcgtttaaaaactataacacttaccacgagcatccgtggcttcattcttgaagttagtgagaccgagaacccatcaattcccgaaacacactgggcgcaaatcttcccttctcagttttccaagtagctgggactacaggcgccaaccaccatgcctggctaattttttttgtatttttagtagagatggggtttcactgtgttaaccaagatggtctcaatctgacctcgtgattcacccgcctcggattcccaaagtgctgggcttacaggtgtgagcccgcacacctggccaccagttatttttcaattgttctgtttccctgttcttgccttactaagaaagtaattttgaaatgaccgatccgttctttgttttttgtttctggtttcttcagcttattctgtctgtaaaacctgcgtcctctgctccgctccatgaagacgctcattctgttttatagaagttagtaagtgtgatatatctattctttgtttttgtctatagttcctggctgacagcccatataaccattgtaatttcctaggagactagagtgtgataagagtatctttccttaaaatatttggcctttcatcctttgttcttgaaacagctctggagcagctccagagtaagcataaaggtgaaagatgggccgggcggagtggctcacgtttgtaatcccggcactttgggaggccaaggtggcagataacgaggtcaggagttcgagaccagcctgaccaacatggtgaaaccctgtctctactaaaaatacaaaaattaggtgggcatggtggtgcatacctgtaatcccagctgctcaggaggctgaggaggagaattgcatgaactcgggaggcagaggttgcagtgagctgagatcgccactgcactccagcctgggcaacagagcgaaactccatctcaaaaaaaaaaaaaaaaagtgaaagtcgggcttgttgtttggagccacaactgagcttaacgtttataaccacaggatggatggctgcttgccaggggatccaaccgtctgctcagagccccaccctccacattcggggaggagagaggaaccgaaggttgatcaccaatggccagtgatgtaattgatcatgcctacataatgaaatcgccataaaaacccgtaacgactgagttcaggggtttcccaggaaggtggtcttgtatggaagattttgtattcggggatggaagcttttgtatttgaggcccttccagagtgtgccccgtttatgtcttcatctggcttttcatttgtatcctttaaaatatgctttatgataaactgctaaacgtaagcaaatgcttccctgcattctgtgaggtgctctagcaaattaatcaaacccaagaagagggtcatgagaatcctgatttatagccagttggccagaagtacaggtaatacaacctggggcttgtaattggcactggaagtgggggacggtcttgtgggactgggatctgacgctatctccaggtagatagtgttggaattgaattaagaacacccagctggtggccactgcagaactggctccttgcttgatatgggggggtgggggaaccccacacatgtggtatcagaagtgtgtttctggagtatagtaggagaaattgagtttgttttctgctcatacacagagaaacaaaatcactaaagagcaacaaattgtattctgttcagataatatagtggaagaaatattccacttatagtagtaccaaaaaggataaagtacttaagaataaatgttcagacgatataaaggacatttcaaaacttctaaaggacacaaaagacatcaaaacacaccatgttcaaggataggaagactcaatatcataaagattgtcattttcttttttttttttttgagatggagtctcgctctgttgctgggctgggtggagtgcagtgactcaatctcggctcactgcaacctccaactcccggatgcaagcgattctcctgcctcagcctctcaagtagctgggactacaggtgcatgccaccacgcccagctaattttcgtatttttagtaaagacggagttttacccatgttggccagaatggtctcaatctcttaacctcgtgatccacctgcctcagcctcccaaagtgctgggattacaggcctgggccaccatgcttggccaaagattacaattttctatgagttacttgacacatttaatataatcccaataaagatacaatattctttttaaaaaactacaccaggtcattctaaagttcattgaaaaaacaaacactagtcagataaagacactgacagtattctttttaaaaaactacaccaggtaattctaaagttcattgaaaaaacaaacactagtcagccatggtaagtggcttgcatctgtagtcccagctacttgggaggccaaggtaggaggatcacttgaacccaggaatttgaggctgcagtaagctatgatcacacctgtgaatagccactacactccagcctgggcaacatagcaagactctgtctcttaaaacaaaaaaaggcagaaggtctttcttaagaagcattaaaaagaattcctcctatagatatttaacattttatggcaccccaataattaaagtggtcctagagaatggataaacattagcccaatggaacagagcagaaagccccactatagacctcaacacaaaaaattcatggtgttgaaaaaagggggatcaatattttatactttatacttatttaaattccaaatgagtttacaattttacaagtaaaaaataaaagagaatacattaaattctgttatgatctcagaatggaggttttttttacttatgactcaaaatccagaagtcataaaatatttatcaattcaaatacatttttaaaatttcatgagaaaacattataagcaaagacaaaatgcaaaccaacaaattgggtgaaaaatttacagctcatatcaaaaatggctaatcttcctaatatttaaagagctcccaaatgtcaaaaacagaaatagaaacaaccagcactagaaaaatgaacaaagtagataaaataacagtttgtagaaaaggagacacatggctcttaaacatattagaagatgctcaacctcactcaaaataacacaaaagcaaatgaaaaggtttctaggtaattcaatggggaaaagatacctttaaacaaaaagtgctggaacgattggatatcaccatgaaaaaaaagaacgtcaacttttacttcacaccatatacaaaaattaattcgaaaatggatcacaggtcaggcaaggtgtctcatgcctataattccagcactttgagaggccaaggcaggtatataacttgagctcaggtgtttgagaccagcctgggcaatgtggcaaaaccctgtttctacaaaaaatataaaaattagccaggtttggtaatgtatacctataatgccaactacttgggaggctgagtggggaggattgcttgagcccaggaggttgaggctgcagtgagccaggattgtgcctctgcactcagcctaggcaacgtatggagagtctctctctctcttttttctttctttcttcttcttttaagagatcaggtcttgctgtgttgtccaggctggcctcgaacttctgggctcaactgatcctcccttagcctcccaagtacctgggaatataggcatgtgtcactgcatccagctatactaagaacttttaaagctcaacaatattaatagcccatttcttaaataagcaaaatattgaacagatagttcacaaaagaagacacgtgcccaataagcaaattaaaagtggctcaacattgtcagtcacacctgttagagtggctaaagtttaaaagactgactataccgcatgttgacaggaccactttggaaatgtttgacagtttttcaatccagcaattctaggtatttacccagatgaaaatatatgtccaaacaaagacttgtacacagatgtctggaggagctttatttaataaccaaacctgaaaactactcaaatgttcatcaatggatgaatgaatacattgtgcctctatctagacaatggaatgtgttggcaatacaacaaactacagatacacagaataacatgtattactctcaaaaccattacagtgagggggaaaaagctagacacagaagagtactgtgcactcatttcattcatatgaaatgctagaaaagtgaaatgtgatcagcggttatggaaaggtcagtggctgctcaaagctggaggtggcaagcactgacgggaagtgacgtggagaactttgtgagtggatgggaatgttttgtatttgattgtagggggtggtggttactcaggtgttcacatttgtcaaagcacctcagatgacactttttattttatctttatttatttaattttgagatggagtctcactctgttgcccaggctaaagtgcagtggcatgatctcaactcactgcaacttccacctcctgggttcaagcaattctcctgtctcagcctcccgagtagctgggactacagccgtgtaccaccatgcctggctaaattttgtatttttagtagagatggggtttcaccatatcggtcaggctggtctcaaactcctgacctcaggtgatccacctgcctcggcctcccaaagtgctgggattagaggcgcaagccagccaaataatacattttaaaagggtgtttgttgtatgtaaattacacctttaaaaaatatgtaaatgctaggggaagagaaaccaaaccaaaccaaaccctgttctttgctggagctagaaatccaagacttacaaagcaataaacaattggacaataaacaggctgggctagatggctcatgcctgtaatcctagcagttagcgggccagggccaggtgggaggatcacttgaggccaggagttagagaccagcttgagaaggccctgtctctacaaaaaaaaaaaaaaaaaaaagccaggcatggtgatcctttaagcctgggaggttgaggctgcagtgagccacaatcactgcactgcactccagcctgggagacagagtgagaccctgtctcaaaacaaacaaacaaaaaacaaaaaaataacttgaacaataaacaaaaaaattacactgagatacaaattttcactttccagaatgtcaaaagacccaaaagtttaataacacagtgtattgacatgactatgagaaaaaaacaccactgacaatgggagtgtaaattggtataatccccagagaaggtattctggcaatatttactaaattataaatgctttgatttagcaattccacttctaggattttatcttatagataaactctaccacaaatagcacatgttaaaggttattcattgcaaaagtatttaaaatagcaaaacacaagaaataatcaaaatgtctatcggtccacgacaggttgaataatttatgatacatccatactgtggaatcctatgtaagtacaagaaagcacagggaaaggctgtctgtggtaacatggaaagatcctcagtgggtaatgttaagtgaaaaaggcaacattgtgtttctatgttgccatttgtataaaaacaggaacaacaaaaacccagaagatacatatttggattttcttgcatatatttttttttaaaaaacaaaaccttcaggaagaattaccaagaaactaatcgcaggggatgggggaaggcatgggaaatatgtgtggagggagaattttcataatatgctttcctatctttttaaatgtttagccaaccaaaatttaaatattggctgggtacagtggctcacacctgtaatcccagcactttgggaggctgtggtgggaggatcctgcgagcccaggagttcaagaccagcctgagcaacatggggagacatccttatctctacaaaagagattttaaaaattagccggttgtggtggcacaacctgtggtcccagctactcaggaagctgaggcaagaggatcgtttgagccccagagttcaaggctacagtgagctatgatcatgccactgcactccagcctgggtgatagagcaagacggtctaaaaaattttttttaaatgcttaaaaataaggccaggtgcggtggctcacacctataatcccagcactttgggaggcctaggcaggcagatcacttgaggtcaggagttcgagaccagcctggtcaacatggtgaaatcccatctctactaaaaatacaaaaattaaccaggtgtggtggtatgcgcctataatcctggctactcaggtgtctgaggcaggagaatcacttgaatccgggaggtagaggttgcagtgagctgagattgtactgtactctaacatgggcaacagagtaagactcttgtttcaaaaaaaaataaaatacttttcaataacatcaaaataacacattatatattaatatattaactaggatacttaaactattatcattattcaccaggttatcttgaagaaaaatataataagaagtgtctagtccggtataaggacatatttggcacacagtaatggttactatttctataccctgcccctcaaatgcccgcacacaacctgtctggtacttcaggttctagttccccgaagcccagttgcctgactgcctcttccagctgtgcccttgcagggacttctcctctgctgaatgattttccccatctcttcttattgtccacctacttggtagctgggatgtggaggacatcacctcctcaggaaagccttctctgattgacacacaccctcctcctccctcttcacaccgaccctttaggtggcccttgtccttcctcccctgtggactgcagggtctgctcagtcctctgtagtcctggagtgctggccaaggatcgagctcccctccacagggtggggattcatggcaggggcaggccttactctccacctacacagacatccagaaaagtttcggtttcccctaaacgttatgttgatcttcccatgctcacaaagaagagtttgggtttcccctaagttgtgatctcatttttcctgtcttccctaccctccagccctaccccagccaaggggccgtgccagctttcatggtgaagatgcctggggtttcctgggcagcccttcatatactgtgtaatagcaatggaaggaatccacaggtgaatgctgatgcaggaagctcccagtccagcagggagggcagccatatatgcaaggagcagaaacacacaatgtggaatgggtgcagagagccaggcaagggcacagaggacaagtctcactgggcctcaaagggtggccacagtgtggctgcggggattggagggcaggctttggaacagacagcctcagctagaaagccctgggagggcccatgagaggcctccaagtaggcaaaggggcaacagcaggtgcagcagcctgggactctaggaaggggccctggaaacctgaacctcaatggccatggcagtgacagaggggtctgtgctgggctttagggaggtgcctcaggcaatgtggaggacctccaggaggcgggacaaggcagtgtctggcaaaggcagggacagacagcaaacaagacagagccaggcacccaggaagggcagagacccctggggggagagggaagttgcggtgccacaggacaggctgggggctgttcttaaggggaggctttgatttttgtggttttgtttttcccagaagtctctccaaggagtaagattcctttcttaggactcaagaagtcagaggcccccttctctggggcccctggggtttgggcgagagtactggagcagaaagcagggctgggctgggcctggggccagacctcgatgactgtttccttcccgtcagcgagcggagaagcagtgacagagtgtaccaggaggggaagctgacggtggccccaactcctctcttgaatgggatatgaccaccccacctgcccctcagtgtttgcaggacactctggcacactcatgccttcctttcctggtgaacctgtatcccactacaaagaggaacagaactccccacccagccccacccttgcttccaggggctttgagacactcaggagaaggagcttcaaatattgtgagggtctgtctgtgtcagccaccaggatgtcaatccctgcctgggctggcagcatggaccttgtggaccctcctagcccaccccatgcccccaggagccccgcttggcttcttctcttttatacattgtaaacaccacatttatttgtctgaggcttgcaaacctctggtaagaagcacagaacgcagggctctccttcatgctgccctgggccccagctcgccaggcatgcaggacggagctggcagatgagtcagaaatctttgggagcagcgccagggaagcagcaggccctgctccttcccatgcccaatcccgccagcacgggcctggactgcagccaggaaggtgggccagccaggatccccaggtaacttcgccacagggacctcttcttggagctgccttcccttccctccccatccctctccaatccccgcagagcttagagcctgggccacatgcttggtccctcacacaaggaccaaaccagctgctgtcaggctgtttctgtgggtcctgtctctccagtcaggaagccagcagggcagggcaggcctggctctcctcctggaatcacaccgtgcacccagctcagcgctgggcactcagctggggaccgggatggacaaagccttgtccagagaaccactgtaggggagacgtgcatggcagccggactcagcctcctgcagcctccattcatgggctcttggctgggcctgaaatttgttagggcctcaactctctgtggtgcagatgaacacctcctcctccaagaggcccctcaggcttggtgccaggcttgggactgggctctggaaagtcagccaaggctgctacttcaaggccctgaggacagcctccagcttcatggccatagccaggtcgcccttcaccttcagccgtccactcatgtaggcccccaggggccgcagctctctgcatagcagggcccgcaggtctgcctcggccatctccaccaccacatcagggatgccatcaggcaccccgtgtcccactcttcctcgtcctgtggggcaaaagaaaaccgagtgtcagtaggggaatggaggaacgtgaaggagatctatgggggtgggaggggctggcatttcccactgggaggagagtactggttaagagtttgggttctaataccctgggtttgagtcttattggctgtgtgaactcttggatcctcagtttccaaatctgtgatgataattcctttagagatgacaattcctaaagcataggctcatggtgagaagtgggtgagataatgtacaaaaagtacttggcacagagcctgacaggcagcaggcctgtaacacgggcaggcctcttggtattggaagcctggctgcattgtcctgcggatggcggggagaccagggcatagttaatgcctggaaatggtgtctgagcccctgcctgccatgggttcaccccaaattattggcaggagcagggggcagtctacgagagcaccactggggtaggtaacaagaaacctagcaagctggatgggaaggagaggcaaggagggcagcggcacctgtagtgaggtccaggaagtaggcgctttgggtgccgctgggcaggacgacattgaactggtagcaggccccgacttggctgaccagggcctcagacaggaagggctgtagagcagtcagtagcccctccgccagaggctgcttcggactggacctggcaccaacttgaggggcaggtggctcaacttcactcaccatctccacggtgtctgctgggggtggccaacagggttggggaaggaggcagagaggaggtcatcgtgttgccaaggtcaggaccactcactgtggcctctgcaccttttgtggcagtttcctcttagatccccttcaggcctctgttcaacttcctcctctaccagaaaggtgcccctgagttttcagcctaaactgcaaactcagtttctaaactactccagcctcagatataaaattctttccagctgcccttctggtgatgtcgcctcctcccatggaggctgccaatggcctctacacactcagacacctggcctcctctcactgccttggctgtggtcagtgtgggctgaacatctgtgcagggtgtgtactgcacagagctgctgggatagtgagcaaagtctgtgctggcaccaagctggtaaacacccccgctctcctccccagggctcctcacctggccccggggacggggcacctcctgccattgagttcatgcttcctcccaggaagtgcagggccagctgctggagggtgctgtccaggttgggcccagctgggctgtcctggggcggctggagcacggcctccaccgccagctccacgcggtctacctccagcccccaggccctggtcacatcgttgatctccagctggaggacagtgtgaggagaaatgtaattaattcaacaaacctttcctgagcaccttctttgggcagactgtgtggccgtgcatggacatggaggcaccacaccgcccttgagacactcctagcctgggaacacaggcagagggcaatgacctttcagctgtggtaagagccaagacagaagcaaggcctgtggtgagcccccagcagaggagggtggtgccagcaggagggagtcctcaggtggaggaggacccttccagcaacaggaacagcatgtgcaaaaccccagacaagaaaacctggcatgttcgtggagctgcgaggaaccagagttccatttagctggaccctcacatgtcggctgaggactggagacagctgaggggtcagaggtggggtgtttctgcttactttgatttattctgaggcaacaaagagccccagggaggagtttgagcagggaggtgatacagcagacttgctttaaggcaagatcctcctggctgctgtggatgctggattatagggggctgaggggagggatggagaccaaggaagacattgtttcaaaatacagccaaggaatgatgcagctctggcgagggtggaggggagctgtgaagccaagatccactgagggaggcatgcctctatcaactgtactgagccacaacagggcactagagaagtgcaagcaccaggctcggggctgcctcgatgtgtgcaatgatatgagagggggcgggagtggggaggagtcaggctcctgaatggatgagtgtggcattcactagagaggacacacgggggtgggaagggagggatggcaacttttttttttttttttactactgtaagcttgaggtgtctgtggggcagtcaattgtccagtaggcagctggagaaatggcccagggtacagaagcatcagggctagggcaggacattgtgaataatcagcatccacaggcagcagacagcccagatggatgagctctcccagggaggtcacagatgagaagaggccagtgatgaaaccctggaaactcaagggcaggagaataagtggcagtaaccagggatgacagggaaggaggaagtacagggggttctgggggctgggggctgggtcgaccatgtcaaatgctgccaccaggtgatgtaagggaagggctgagaggtgcccactgggctggcatgtgggaggtcactgtgatgttggccagcgctgtcttgggagcccaaggaggccaggatgaaggatgtaggggcaggggctgggagcatggatgaaagtcttgcagaagaaaaggggagaaagggagtgggagctagagggcactgtggcaaagggagggcacatttctacacagaaaggagaggtgacagagagagagtgcatggagtggagggaaggcatcctgggatagcagggggcccacagcactgcgcagtacagggatgagcctcagagaggggaggcagaaaggcaaggaggcaggaaagcagcacagaggcaggtgggtttgaaggggtgaaactggaggaagcagagtgctcatcctagagtttttctcctgagtgttaggaggcaaggcctgctgcagagagcaatgagcagtggtggggctggaggagggcagtgaagggctgaggcagctggcctggagcactggcaggtaaggagtggtaactggctaaggaaggtccagcaagtgagaggtggggactctgatttctctagaagaaaatcaggcaaaaaggggcatgtgaataagtgtacgcctgaaccagggcctgagggcggtgtgctggacctcctgaggttctgtctcaaccacaggcacagctctcactctaccaggtgctcactcagtctgggaaatgggacttaaaggactctcacatcctggtgtggaactgacctccccaaactgcctgtctcacatcaaaacaatgtgcaacaagactgagatcagttttctcttcctaaaggtgaattaacacggggcatggttttatgaataaaagttgttatccacttgctatctgagttgtgttagatcaagcactggattgaggggcgatggtgggatggaggcaggtggtctagctatggctcagctctgcccttgaccatagctctcagaggcaagtcaaattatttcttagccttagcttcctccctccaaaataaaacagtagtaccgacttgcagcaaaaaatgtcaagctcagaaatgctgggccagacaaaaggactttgtaaaccataaactgctaagcacgtaagagctactgttaggatctcaaatagtatttcctcaggaatttcccctcgctgcttccagtgggacctccaggactggcatttatcccattcccccgactgtcctctaaccttgattccccagggcaaagcagagccaagaggaatggggagaaatgtcacctacattcccctgtcaggacacaagaggaagcacaagttgagtgtggctgcaggggacacaactctgcatgtgtatttatttctaccccatcttgtagcagaagagatttagggcaaactccaatatacacatggagaagaggcaggaaaaagatccaaatgtcctcatgttcctttgttctgttccaaacaaggaaacaaaaatcacaagcatgcacacgctgcatggtgagcctggaattccccagcaggtgactgggctgggagggtccctgctccatcacccatctgcctgccccatgagtcaggcccggaatgagagctgtagaagccagtgtcatcatggcagagcagtgaggggtaaaaactaaggggcagaccccaagaatgtctgccggggccacttcctcttctcagggacaagtttgcccaggatcgttatggtctacgcccacctgccattcctcaactcatggccccacccaggcactggctcttcaaaggtggttacactattgggacatatggtaaactgaggcccagagtggtctgactctttgctcaaagtgacctggcaggtggagccaggccggtgccacccctcaagctccgtcttgtgaggggctgcctaccagaagctggtcgctgatcttgagcttctccatctggatctcccgcagcggcctcttgagcagggccttggtcatggcgttctgggctgtcatgcgtgtggctgtgttcaggtctttcacagtcatcaccgacagcaccgggtcccagatgcgaaactggacatcggctcccacggacagcacagccccgtccttagaggccagctgttgggggaggccatgagagagagacactcaaggggctgggggtgcagggaggtcaggcccactggggccacccagcttgaaccacctgcttggcagctagctcctcaagggcaaatggtgtcaccaagtatgtagggttaggtgtatgaagcaaggatgtcctcctagcttccatcaattttctggtctcttcttcccccttcccccctcagatggtgactcacaggctgaggtcctggcaccacagtacattctggacaggcccccagttcctctgtcaaggcagctgagaagcccctcaccttgcagggagggacgttgaaggctcgtgtcctcagatccaccctctgaaaggagtcaatgaagggcaagagcagaaccatgccaggtccctggggggtgcggatccggcccaggcggaacacaatcatccgctcgtaggtgggcacaatctgtccacaatggcaagggaaagagttgaaagtggtcagcctaggctggccaatgctgtctgcctaggtcccttcctcacttctctcctcctcacctgggtcacagttaggtatccctagcactgtttccagatgagaaaaccaaggctcagggaagctaagtgactgctcaaaaattgcatagccctaagtgaaatagtgaagatttgaatgcagttctgaataactccaaaggccatgtgtcttaaccactgcactgtattgacttgatccttagagaaacttttcatctctgtggtctgaagttagacatgactcataccaggaaactgtctgtccttggattagttaggagaaaaggctcggctgccctaacagcacccccggggaaagggctttgtcaactttaggtccctggacctcctagagaagtagtgatgtccaaattgagaaatgaaggcccagagaggcaaagaaacctgttcaaggtcacatggcatttgtttctgtggcagttttagaactaggatataaggccatttaaggacccccttgcagaccacaccaaacccagaggttttctagagagggactgttgcctagggctacacaaagggcaaggcctccttgggcttccaccttcccccagctttcacgtgcgatgctgaactatagctccatggttcatccttttcccactgtaccaccccttatggaaaatgaggcctgaattcctattatgcattaccagctgggctaagttgggtgttttcatttctaatttattctaacccaaagagaagataatttggcaaagacatctgcgtgtaccttaaagccagtgtccagatcccaggacttaggagtttgggacttgcttctaccccctactggctcccagtatgactttagacaagcccaagccttagtttcctcccctgaccaatgtgaatgaatggttcttgcctagcccattacacaaaggggtaataatatttagggaaaggggacagaggataggcaaatttattcatcaatgccaaagctctcagtgtggcccaaccaccctgggggctgacccagccagccttaccttcagggcaaaccagccagaaatggggaaggtgaccaacagcagcaagaaccccaggaaactgatgaggccatgacagaggcaggagggccagctctggggtacatctgcaggtgagagcagaggtggtcaactggacctgccacgacagctgccaagcggagtgaacttgggcaagtgtaccttacgtccaccttcccctcgagaggctccttccttctcagggctctcaatctggctccttgcctaatattcccgtatctttgggcagctgcaagttagggtctgttccctcctcccatacatcaacactcatttgtcccaagtccaacaaccctcacaaggccttattctctgctaggcaacagccattcaatctcagaatccagtccgcgtgatgatgctctcctcactggactgagtaggggtcaatcctctcgtttaatttatattgcctacccatacctggcatggagccaggagcacctgggcatctgtaaacatgcactgaatactgctggcaaaacacattcctcctataccatcagccccagaagtgtgctttccaggagtccttatgaagatgatgccttagcctacagggataaatcataaatagcttatcaacgggagccacagatgaggaattagattattattttctattccacacccaactttaatgccttaatgaccattaaaaaatgcctatttcacgagatggcgccactgcactccagcctgggggacagagcgagactccatctcaaaaaaacaacaaacaacaaaaaacaaaaacaaaaaaaaaccctgcctatttcaattcaagaaaattgttaggggtcggggtcaggggcagggctagaaagatgaggcttatccaagccaaatgtcctggcccctggagattcaggagcccaagttgggagcaaagccgagacagctccagaatctgggatgaggttatttgccgctttcctcccaaccctggacaggaagcagtcgggagccctgctccattcttccaggaagccctgccctctgggctaagccccagagcactgaggctccactttgtgcctggctctgatccaccaggcctctcaagagacttctggatagggagagctttcaggacaggaaggccagggagggatcaaatccaaggttaggcggttaggctgaacagcgtgggatctggcctgtaggccaaaggagccacagaagactttgagggcaagacagaagcagggcagatccaacaggcagctgaggacctgtcattttggcctgcacatccaggagatgcctagttcccgggcttctagaggtgccccctagggcgaaaattcttccatttccctgcagcaggtgcctttagggtgctggtggcctcctctgcctagacctcggtttcttctatgcgaaatagaaacctgaaacgtcttcccaggcctaaagggctgataagagccgaggacaaatgtggtgaggtgaggttttggaagataggagcaaggctggctggctctggggccaaagccccatgaccctagggagggcggatcggcgctagcaccaggcgccgggtccagccccctctccacatcgtatccctttctcagtcccccctcgtagggtgcgacggcaccgggccggccgactcctcggaggcagagattcgggcctgggggttgccggccggtcccccccgggtccgccgtgccaggcggccactcaccggcccctgtccccacgccgccccgctccggggacaagcagcccttctgcgagcccagaaagccgaagctcgactgctggaagcggtcaaaatcacccaggggcagcgcccggtacccagacctgccgagcatggcttttgacaggagacacgccccgcgcctccgcgcggcgccctccctggccagtgggccctacgcggccccgccctcctggctgctgcttccggcttcacccgcgcggccacccgcggcggcgcgggcgcaggaagaggaggccggccggggcccgcttccgccgtcgcatggctccccctgcgctgggaggaccgaactgcagcccagggctactgggtgtgatcggcgttcctcggagcccgctggggtcatcgcctcctcccctcttctcctactcagccctagaaaagctggaggggaagctgggcacggtggctcactcctataatccatcaatttgggagactcaggcaggaggatcgcttgaggccaggaattcaggaccatcctgagcaacatagtgagagcccatctctacaaaaaatttttaaaaattagcctggcgtgggatgcctgcctgtggtcccagccacttgggaggctgaggcgggaggatctcttgagtccaggagtttgaggctgcagtgagctatgatcgtgccactgcactgcagtcggagcgagagagcaagatctcatcagggtttacaggaagccaatcttctccaggatcaaggacatgctatatcagccttctcagcactctttctctcacactggaggcaggacatgccatatctggactttgggtttctctgggacatagtctgcaaattattcctctttgtgaacccacagcccagcaagcagggactggcatagggcaggtctcaatacttatttgttaagtaatggcctggccaggtcaccgtgatcaaggtggagtaggaaggcctgaactttggcacaaaaagaaagaagtttcacatgcagacttcggggagcatgggagtgtaaggaagaaggggatagcacagagctacatgagggcaggggccccagagcaccacagaggtgaggccctcagtcctgcaggtccagaaagagcatgccccttgatccaggtacctggaattaacttgcctctccagggcttgagaaaacctgaatgcaactcgtgaatttcctttgagaagtgttaacttccaacaggactttggggtagtctgggagcaggctatcttccaaagcaagcaaagaaatgaataaagcttccccagctctgcctcctcagccaatcgcctctggcctccgaagccccatcctgccatagcccacttccaggtcccttgtgcagatggctgcccaccatatttggctttcatggactgattctctaaaggcctgggagtactgaccaggctggagggaagggcaggctcctgaggccttacagtccctaggaagttgcgtatctgcccaacccctgctctccaccctgcagactgtaaggtttacaagagccaggccctatcatcatcctttctagtctgtttctaagttggaacagagtacggaatgggtacacaggagccagcacagtggttgcgatggtttaagtttgaagccggggcgctgacccagtgaggtcacctggaactgtgcccctttccccttaccagctgggagtctgacatgcttttccattggcgaagacctagctggctctcccctcaccctcttcatacccgctctccagctctccccctccctcctgcccccaccacctcagatccaccagcctttccagctgtcactcaaggcatcatcctgctccctcacctccagtcactggcttcccaggatctctgaatcaagtccctcctctgcatcccacagccactgtcctagaccagggcacctgctcctaggttgtcagagtgactgtcccatcatgcacagctgatcgtgttgttccctggttccaaatccttcagcaacttcccatcactcacagaactggttcaatctcctcagctaggatcttgtcctagcacactccttgggtatcatttctcatgaattccctcttaaatctgaaaatggccaaaattagttcccaaacaggcttttgcaagagctatcttttctgtttcaagtgtcccccgtaccccaccacctacaaccctaaatccctggtgaatttccactgcttttgcaggtcccagctgtgggctctcctttccagaatgtctccgtttgcaggcttgctcttccattacatctacggctcttagaaagcaggggctgcgtgtggctcatctttgtacgcccagctcccggcaggacgtggcacgaagcagtgccagtgtgaacggatgaatggatcaaagccgggagcagggctgcccccctgcagctctgccctacctctcccgctttaccgtaagtcagcggtaggtctgcagctctccgcctctacctcctccccgctctgggcgtgtctttaaaacccacagtcggcctctctgccccctagaaccgcccccagcttctgtctcacttcctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagaggtactattgggttaggggatgatggggttaagctttgttggtttgctgtggtggggagaggcgggaagagagggtctaacggaggatttggtcaagtaccctagagagtgacacaaagcgggaagtccagacaccagggtcctgaccgtctcgggtggggcagggaagggagggtaggatagagtagaaaagaggacacggaggagttggggcggcctcgctgggctgcggtttctccactgagcagttgggcaaggtgagaagggtcagtggcctccgggcctgggcccttccgcccaccctcgagccctgcctcaactttgcctcagatgcaggacttcagattagggaggatggaggtagtacccctgttgcgctggcctggagccaggggcatgtcccaggcacggcaaaactaaaaccaacttcccagatccgaggtgagaaactggctcagactgaagaggtatctttgccaaggcctcccagctcatgtggtttctgcttaaggaagcctccccaacgaacccttctcttgccacacctttcctgcccacctcccacctcccccgacaaaggaactacttgggtttcttgctctgctgcctttcaggcccttttactccccttcatgaaagtacagaggacaccgtattacagtaacttttataaacattattacaactaagaataacattacttaacaatactaggtaacatttatgagcacttcaaatgtgccaggtactgtattaagcactttgtttttttgttgttgttgtttgtttgttttgctttgttttttgtttgtttgtttatctgtttgtttttgagacggagtctcacactgtcgcccaggctggagtgcaatggtgcgatctcggctcactgcaacctcctccttccgggttcacgccattctcctgcctcagcctcccgagtagctgggattacaggccacgccaccatacctggctattttttatatttttagtagagatggggtttcactatgttggccagattggtctctaactcctgacctcgtgatccacccacctcggcctcccaaagtgctgggattacaggcatgagccaccatgcccggcctgtttttgtattttacaaaatgtggtaaaatatacctaatggataagttcctatgttaaccatttataagtgtaccattcagtggcattaagtagattcacaatattgtgtaaccatcaccaccatctatttccagaactttttcattactccagaaactctgtactctttaaaccataggggagggaaagatggcttgcctccacccttctagtttccttggctgggctatgaattaaatagcctatgaattaaatagtcataaaatagattaccagcggaaaacccatatttaattacatatgtatactcaggagtcccacaatatatgagactcaaagaaaggtcagatgattgaagcctgtataacatcctgagctacggaaaagagcttggagcttctgggtgatggtgataacacaagttatgggagggtgaggagaggagctgtttggtgaatagaggttgtcttgctatgtagattaaaagttcttagataataaaagttgtctggagcagccctcttttaatatagatcattttactaatgtagattttcttttaagatataaatgcctttcttttttacaaaaggagagcttttcagagctattcctgtatcagcagtttctcagaataaccagcttaaaatatgccaaagaagtatatttcaagagcctcctgcagtcatactttgaagtggtgtgtcctgagccccagtaatgcaacagctcctcattttctccttcccctagcccttggtaacttctaatctaccttctgtccctatgaacttacttattctagatatttcatgtaagtggaattgttaccagtagaggatcttgactgcaaattgttcaggttcttggcattttgaacaaagaattggacaaaatgtacagcaaagcaaggaaagagtgaagcaatgaaagcagagatttattgaaaatgaaagtacaccccacagggtgggagcggctagagcagggctcaaggaccccagttacagaatcttctgggttccaaataccccctagaggtttcccattggccacttggtgttcaccccattggttgcagaaagcaaccaaccagacgtactttcaattttccatctgccctgcaggaaatggggtgatttgcaaagagagtagcctctcttccttttgttactgaggcatggagagttgcggttttcctttcgatttagttctaggaagtcagagggaatcggccttaggttccctgcctccagaccctattctcctgcctcagaatcatacagtatttgaccttttgtgactggcttatttcacttagcataatgtcattgaggtctatctatgttgtagcatgtatcagaatttcatttctttctaacgctgagtaatattccattatatgtgtagaccacattttgtttatctattcatctgttgatggatacttggattgtttctacattttgtctattgtgaatagtgttgctgtggacattgttgtacaagtatctgtttgggccttgtttttacatcttttggttatatatctaagagtggaatttctgggtcatattgttgttccatgcttacctctttaatgaacccccaaactgtgcattaagcactttatatgaggttggtacttagtgtatctaccttccaaactgagttccttgaaggcagaatgtatcctacacctcttatatctcagagcctattactgtgggtgatgagaagtagatgctcaataaatggtgcagtgagagctggagggcctgaataaatgggggtattggggtgctgataagccagggttttgcatcatccaatgactggctggaatggaatatgaggtcctactccagggtccagctgtaagggtggttggccggtaggtgggggcttttgggacttctccaggcctcacctgcctctctggtcccccagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccaggtgagtaggccggcacagggtggggtggtgcatccaagtaccaggtagagggcgagaggagcaaagatccaaagagtcacacagctgaggacaaggagcttctggggccttgcaactctaaatgtggtctgcagatatgcagtgtccgtgttgatgaccacaatttatgctgccagtccccacgcaggtggatagtaagtttccaatttcctcctgtaataaataatgctgcagaatcatctttgcatctttatccagtaacttctttaggataaatttttagaagtgccactgctgggtgtagggggacgggaattctacatttgatacatgttaccaaactgccctttagaatttagtggaattttccgagagcactgacacggaatctcagtaaggctggattctaggatcagagacaggtagttagtttctgtctgaaaagttgaaaccattaacaccaggcagcgctatctgagaatgtctgtatggggaaaaaaaatcacatccagttgtaattatttttattaaacagattttaactcagttttttaataggtaatacattcgtacagttcacgaacaaaatttgtaaagaggagagagagagtgcaatcttctgtccatgcccaactgcctaattcccaccacttctccctcttcccatccacaggtagccattgttactagttttgaatgtttcttctgagagtttctttacgaatatatatgcaggtaggagcaatcttatcaggtcctattttccctcttttagccaaaaaggtagcataactatgtgaacttttcaccattagcaatagattgttcatagaaggcgcttcttggttcttagagatccacttgcaaaatgaaagcatttttcgctggtttttgacaactcagaactatatatggctaaaccacatatttgctaaactacatatctgctaaactgactgtgatttgtttcctgctttaggataaacttcccacactatcagaataagctttcccctccgactcctcaacagctggtatcaccacgtttcttagcttattgtaaaggttgagtggctttccacttgtttattggccattgtgtttctgcatttgcgagtggcctgtttaggtcctttgcctgttgttgttgttgtttcctttgaggaattaagggactaattaaagaattcaggaacaaattcctcgaaagaaaaaaatgtatgcatttcttttgctcttacaatttatgcagttttaaaacttacatatttattggattttgattgaaattgcaataaattaggagaaattggctttatctctggttctatcttttggatttaaaaaattttttttaattttttttttttttttttgagatggagtctcgctgtgtcacccaggctggagtgcagtggcgcgatctcggctcactgcaacctccacctcccgggttcacgccattttcctgcctcagcctcccaagtagctgcgattacaggtgcacatcatcatgcctggctaattttttggcatttttagtagagacagggtttcactataatggtcaggctggtctcctgacctcaggtgatccacctgcctcggcctcccaaagttctgggattacaggcatgagccaccatgcccagccttatactaatttcttaatgaatttgtaagctttcatgttttgaacgtgataatgcagccatcccacgggatccatgggagtctgtttcaaattcatagatgctcaagtctctgatataaaatggcatagtatttgtatataacctctacacatcctcctgtatactttattttttattttatttttattttttgagacggggtcttgctctgtcgcccaggctggagtgcagtgctgcactcgtggctcactgcagcctcaatctcttgggttcaaacaatcctcccacctcagccaccagattatacaggactgcaggtgtgcaccaccacgctcagctaatttttaaattttttgtagagacagggttgcacgacattgcccagactggtcttgagaactcttgggctcaggcagcaaccctccctaggcctctcaaagtgctgggattacaggtgtgagccactgtacccatcccctcctgtatactttaagtcatctctagattacttataatgcctaatacaatgtaaatgctatgtaaagagttgttttactatatttttgaatttgtatatttttttattgtggtacttttttaattgattttttttcgcctgaatatttttgatccaagatttgttgaatccacgggtgcgtaacctgcagatactgagggccaactgtacatataaattgtttagcgtagtgcctggcacatattaaatactcagtgaatgttaaaattctattataatttctctgctctagaacaatttgaagaatataagaaatttaggcttataaaagttttttgaaaaaccatcttggaactggtgccttttttatagtagatttttgggaacttttcccatttttgccatggcattaatctgttttggctcttgtgtcagatttttggaagattttccagttcatcctgagttatctttcattatttaaaaatctcctatatgcctgtaactataccccctttttttatttctgatgttgtatatttgtggtttagcagtcttttcaaagtactgtacttttagtctttccttagattgcttactgattttaatgttttccttctttctgtttgatcattttatttttgtcattttcttccttctaacttttgtcattattcattttctagcttcttgaacttataattcatttatttgcaatctttattgtttaataataataactttttttttttgagaatctccctctgtcacccaggctggagtgcagtggtagatcttggctcactgcaacctgtgcctcctgggttcaagtgattctcctgcctcagcctccccagtagctgagactacaggtgcccaccaccatgcctggctaattttttttatttttagtagagacggggtttccccatgttgaccaggctggtctcgaactcctggcctcaagtgatccacccgcctcagtctcccaaagttctgggattacaggcgtgagctacaatgccctgcctaataataactcttttaaggcataagttctctgtatatggttttggctgtatgccataactttgataacttcattagtgttctcatagtcaatcatttctcaaatttcatttcagtcttttcttaaaaaggttctcttgcttaaggtcaagagttcgagatcagcctgggcaacatagcaagacctcatctttacaaaaaataaaaaaaattagccaggcatggtcggtggtacatgcttgtagtcccagttatttgggaggttgaggcaggagggttgcttgaacctaagaatttgagcctgcagtgagctgtgatggtgccacttcactccaaccagagcatcagaaccggaccctgactcgaaaaaaaaaaaaaagaaatttttttctcttgaaaagttttagagaatagtgttttctaaaattttcaagtggttttgatgtttggtttcttgttctgtcacccaggctggaatgtgatggtgcgatttcatacttgttaatttctgcactatggccagtttatacagtttgta

SEQ ID NO: 12505 - DNA, 670689 bp, Human
  misc_feature (1)...(670689): n = A,T,C or G
ttctggttctggcatgcagtggaaggccctctgattctgtttccttacctattttaatagtaacttatatttgtgttccttcattaaatgtacaataaataataaatgtttgcttacggcatgcttgttaagtataaaacaaataatcaaaatgaatgtgtaatgaccctttggatagaccaagtagaagctgcttttaggacacatgattggaccatttctagatatctgcctaatttgtaaatgaaaaatatgtaagctacacaaggagcactgactcgtctaaaatcttaacgactgactgatttgggcttggggtttggggcttgggtccttcatgccctgatcagagctgtttatagcttgaagacttcctgggggtgagaacaagcaacctcttggtgcagtccaaagccaggaaatgggtgacgattttgaaaaaggactcatctgacctccagaaagcctttacaaccaacagtagaacgagatcactaagaaacagaaccaccgggaagccaagatgtggtacttggattcccatctcggagcacctcctatatcccgacacaccatttcccctagtgtctgatctctctttctcctcctttaattcagtctggagtcattttagatcagattcattcctgattggcttcactgctccaacttagtcatcacagaaccttagggttggaatccatgttacaagttaaactgagcaattcacccccacttttcctgacaacagtgttctcttgagagtctggttttattctgagtcttccagcccggtgtctgtgcccatgaaggactcatgccaaattacattctcaggaggactcccagaccaagagactctgggcttgggcgtgagagacttggggctgttctttttctttttttttttttgagaagaagtttcactcttattgcccaggctgacatggagtttcactcttattgcccaggctggagtgcaatggcacagtcatggctcactgcaacctccgcctcccgggttcaagtgatactcctgcctcagcctcccaagtagctgggattacaggcacacaccaccatgcctggctaatttttgtatttttagtagagaccagttttcaccatgttggccaggctggtcttgaactcctgacctcaggtgatcctcccgccttggtctcccaaagtgctgggattacaggtgtgagccactgtgcccggccgagaggagttgttttgagactcacctgccatcataggaaccatagcttaaattcttgtgaccttttcaggtgcatctcccaaaatatctcccctccaccaaattaatgatttatttcataaatttagttgcattctggatggtctcattcttaagatgagcttaaagcctttcagaccagtcacttccttgtttggggtggaggaggttttttcctggaataggacagtgtatggaagggttgagaatccacttctttagcggttaataatttactccgagtaaggaattctttgttaaagtggggcatgttcttcaagtgccagagaagagagaagggtgatttttctgacatcctccagcctgcttctccatatttggaaatgtttacccaccaggctgatctattggaagagagggaggtgactcagggtttaggagaagcaggatttgaattcttgtttccagaaacaaagtcgtccccccaccctgcccccacccttcccccttcattcctctgtcccttgttctggaagctgaggcgagaatgtctcagttctgttcccttcaggcttcgagaccaccgccttgctgtgtcccgtagtggactgagggcctgcaagagggagtgagggctagtggagggccagctgcctgtgggggctggacatcgtgtgagtacatcattactgccatttctgctcacagacctggggcttacagcctgtgggctggctcacttgcatggtgatgggacacgttgctgggagtgctggtcacttttatttgggggtgtggacagctgctttcccaggggagtacttcttacagtgggatttcaagacaagatcggcctgaagaaaaattatatttgtatattttttaaaaagtaggtatttcctctcatctgaggcctaacttgagttgggtagaaagacaatttgggagtgctgttgtctgatgattaaggctaaagcaacaagctggaagggatgtcgggatgtctgtggacatgtagggaggggtagttttagcttgaaaacagttatggtgggatttaagagtatgcaaaatgttgatgtgtagcatttgcacagcatccacggtctggaataccttgtgtgcaggtcactgtgtagatttgatgagttgtcagagttggaagagtcctgcagagttttcagcacatctgtctaatttcacagtgtgagataatgggcagcagagacccaggccctgaagacagatggctcattatgtgggattagaacccagatcttctctctcagttcgttctccttcccctagacttaagctgccccctctattgcgagatgaggaaattgggagatgttagaactgtccacacttactaatctagttggtgggaaattgaggactagaacctacttctagttcagacctcttcccgttaggatatatgggctcagatgcctagatttgttgtttttgtatgaggctcttttcttttctttttgttctttgatttttacttacctttcccttcttttgttcatgtgaatgtcgtatgaatgcaaccttctgctctcctttgctccctatatctttctctttcacgaaaggggatgatcacttgtccaaaaggcagaatgaatagtgtggaacttcctttctatccatggaagtgaaaattatgcaattttccctgagagaaattcagcaaggcttcccatctgagcctctaccactattcttgaagctgtaagaattctggaatattatgcccattcaaaggtgagtcctgattctgattagattttaaacacacacacacacacacacacacacacacacacacacacacacacactttttaagcctaccaaagcaggatagagacccagaagacaccgacctattacgtcacctcagatgtttcacagccatcaggagtaactctttgtagtcagctcagtttcagatcaacttttttttttttctttctttcttttttagacagagtcttgctctatcgcccaggctggctggagtgcaatggcgcgatctcggctcactgcaacctccgcctcctgggttcaagcgattctcctgcctcagcctcctgagtaactgggattacaggcatgcaccactaggcctggctaatttttgtatttttagtagagacagggtttcaccacgttggccaggctggtctcaaactcctgacctcaggtgatctgcctgccttggcctcccaaagtgctgggattacaggcatgagctgctgcacctggcctcggatcaacttgagggccttattttccagtgcagggaagatggtagaaatatgttttggggaagcattttattaccagtggcattaggtggcagatgtaatagagcagaggaagtgctctgagacctatgtttgttctggccagttttaaagagaggggaagcgactctctaatctgctttgaagcaagtgggaggagggaagttgcacaggactcccaggaacctgtacacaatctgtctccttctgtgaccagctgaggctgggtggtgactgtaagccctgttcatgagacaggaggagagagccttgaagaaggaaagcctggggtgtttttctgtggtgctgagggacagggacagtaagaggttggagtaaataataccagtatgaatactaatactctgaataaggacagctgacaagcattggttgcttaatgggtgccaagcacagggctaaacactttacctaaattattgtggcactatagctgcctttgagtaggaactattttttaaaatattatttttaattttggtgtaatacatataaaatttgccatcttgatggtttttaagagtacagttcaagcctgggcatggtggctcacgcctgtaatcccagcactttgagaggccgaggtgggcagatcacttgagcccaggaattcaagtccagcttggccaacgtgatgaatccccacctctactaaaaatacaaacattagctgggcctggttgcatgcacctgtggtcccagctactcagaaggtggggatgggaggattgcttgaatccagggagtggaggttgcagtgagccaagattgccccactgcactttaacctggatgacagatcgagaccctgtctcagaaaaagaaaaaaaaaaaagagtacagttcagcagtgttaaatacattcatattgctgtgtaatcagtctccaggcctctttcatcttgcaatctgaaactttgtacctataagcaacagctacccattttcctctcctccagcccctggcatcctccattctactttctttctctatgaatgtgactactctaggttctgtatctaagtggaatcataccgtatttgtctttttgtgactggcttatttcactaagcgtagtgtccttaaggttcatccatgttgtagcatgggtcagaatttctcctttttaagggtgaattatattctgtggtaatgaatataccacattttgtctatccatttaggtactattttttaacctccatgttatagaagaacagcaaccagagacttcaaagggttaattaagtaagtggcccaaagtcacatagtcagtagtggagactaattttacctaagaatggcatgtgatcaggagtaagcagatattggattctaattggcaagagtgtgacaaatcagggtgcttctcaactggatggtgacacctccttacaccttgctatggcatttcaataaagcaagtgttccaaagggctgtacgcagctatgcttcctttcttttgtattgggctctaggaagcccatagctaaatttaaagctcacctctagcaaatggtatgagacatccagctcttattttttgtatccctttctcctttctttgctttattttctcctctccttacccactttctcacttaaatcatgaactattagcatcttttgtcaggtacctcagatcatttctggaacaaggcagaatatatagatatgtggcatgatatctaatattttagtaattattaagtctgtggaatagtaggccaaaactggccatgatttttctgacttgactctgctcgtcttcttcttcttccttttttttttttttttttgatggagtctcactctcttgcctagactggagtgcagggcgtgatcttggctcactgcaacctctgcttcatgggttcaagccattctcctgcctcagcctcccgagtagctaggactacaggcacttgccactacaccccactaatttttgtatttttagtagagacggggtttcaccatgttgaccaggctggttttcaactcctgacctcaggtgatctgcctgcttcagcctcccaaagtgatgggattacaggcatgagccaccacaccccacctaactctgctcataatgcaatgtttcatctgggcaatgccctgcccctttctgagtctcacttttctcacctgaaagaggaggttactgttgatgacagtgaacatttaggctgtgctgagttttacactaagcatcctgtctctaactctcccaacactcccacaaggcaggtgctattatccccattttacttttgagaaaattaaggcctaaagaagtgagaaagcttgtccaaaccgctatagctcttgggcaaaggcattagtgaccaatgtgtatttgactccaaagcccaggatgttagccacagtgcagggctactatccttttatacaatctgtcaggcttcttccatccgtggcatgtattcatctaattttattaaatctttattgagtttccacttaggtgccttgcactgttctgggcattatcccagtactcgatttagagcaaagagtaagacacacacaacaacgatctcttggtgcttacacgctgctgcaggtgtgtgaaggaggcagataaaggaacacttaaacaagagggactgataagtaacccaagggaggagtcacaaagggcattctgactgtgagtgagtggggaaggactctgggaggttatgtttaagctgagatctgagtgacaaggaggccaccttgtagaagttgggggaagagcactgcaggcagtggagacggtcaatgcaaaggtcaaggctgtgaagtgggaaggagtttgtgtttgaggaacagaaggagactgatgtgctggcaggatgtgggctgcaggggaagaagcaggagaaaagaatagggtctagcaggtggtggtaagtgagagacctgagcttcttagacctgagtccagatgtgatgggttatgtgttacaggcatctttccagctgctgtggagggaacctgatagtaaaagggagtcaagggtagaagcaagaaggttaggctagacttttaccgtaattcaggtgtgatgtggtggtaactttgactagggcatagaagttgggcaggagaggtaagtttggggcatgtttgggagtgatcgtctataggatctcaagtgtgatttccttcagagaaatgctgagctaaatgggcaggaatctgggatactcagagggaaatgaaaataggtgccctagggggttgcccagataagcagctggcgttccaagaccaaagagtatctgtttctcacccctctcccatttagtttctaaccttgagctttgggccagtgcacagaggatggtggcttcctgcctttggcttcccagctgagagctgttggaacgccccaaaataagccctgcagaacgtgcagcttcctttgctctccctgggtatttttgtaaaacattctttcccaccaagaatgaggaacgttcagagtgatgctgactttatgggctgtatttaacatgttgttttttcatggtgttgtctgttcatgcagagatttctgtctcctgtaaactccctggtaaggaatcttcaatctccatgtgagatgggtctggaaggctcagtgggagcccagaagagctggggtttgaaagcctctccttgtcttgaggactggactgcggtccaagggcacctaccagccctcttttttcatttacatttgaattcacagttgctgccctttggcagttccctgtaattccttttaacaggctgggctttcctgcagatacttcatttttcaggtcttggagaagttaggtagtggctgaatcaggtagagaatccaaaattctgaccaagccccatcctctagccaccaggccaaagcaacttagcttgtgacctcatcctcctgtgtatcccctggcaatcttatactataatcagcctaagcccagagatgctcagaaatcatacactaagtcatctaaaactcatttctgaggctttctcatgcgcccctcttgcagtctgtagttaccaggttttcaaataattagcataatctcttaaaaacagtgttttgttattgctcattcaagtttcttctaaaatttcttttatattacctattcattgagttgacaaacatttattgagttcttactgtatgccaggcattgtgctaggtgctggggattgattcaaagataatttggaggcgtatggaaggggagtggataattacagcacagtgagataagtgctataatagggggatatataaagagccagaaatagcactatgaataacatctttgaacaaattgccttcttttttccttttggattattcccttatgtatattgcccaaagtgggattactgggtcatttaaaagatgaaaacaatttggcacaaaaagatgtaatgacttgcctggggaatacagctcaattttcaacagagaaagaaaaaattgttgacaaatccagatttagatcactttaccaggaagatggggcagtttttatactaccctttcaacatggtggcttttaggggcggggtgggggggatttattctaaacatgttagcctgcgtgtaggaatcacacgtcctcatatttaatctcacaacttgattgttctcacaagaacctagctgtatacatattaccgtttccattttacaaatgaagaaactgcacccttgataaaaggaagtaagttgctcaaaattccatagttaataagtgtagaatccaagggtcaagcacagttccttttattctttgactctatcctgttccccatgctgtgtttaccaattgagggtacctgtgctctagccggggcccggaatttaatatttaatgagtcacggaggctcttaagatgatggtcaggctctatgaaataggtgtagattttcttacctctgaagtcatagccagggaacaatgtctttctgtatattgacctgaaaggacccaagggcgcattattcctgaccctggctcaggtgctgaaaggctatttgcatagccctactgttagagcacagaatcccaagtaaagctgaaaccatgccacagttttgctgtgaaacatttattacttttctagtacttaacagtattaagtaaaaactcctgcccctggtatccaggacctgtcataaatggacaccaacatcggtccactgtgggtccatgtgggtccttgatgctcctgcttacatatctttaaatcaaacacatttcctaccaacccccagatatatcttgcactttctcaccttcatgccttagcacatgcctttcctttagcctgagataacctctccaatcttcattcatagaactcccaatcctcctgtaaacttctgcacagacgccatcttgggaagggaataatccttgatcaccacctgctctcccatccattagaagtgatctctgtgttctctgttctgctaactcaaccacagttagctgtgaggcaatagagtacaaatgtatgctgcatatgagcatgggatatggatttgaatcccggctgtgatacttcctcactgtcagttaacttgcttgagcctgagttttcccatctgccagatgggtgtgatacaataggtgctccccctgaaacccaccatgttgacaggagtagtataaaaatggtctgattctcccggtgaggtcacgtaaatctggaatcgtcaacaattttcctttcctttgttgtcatgacttttttttatgacatcacctcatgtcaccgtgtggtatgaaaatttgcattgttacctgtgcttcttctgtggcacttgtcctcccttacttgatgtcttatctctccttctagactgggagctcttcaagggcagggagggcattgcatctttgaaggccttgacatatggatactgctacaaagtttcctttaagggaaaggaggattccatacaacctaagtggtgacatcagcacaggctcattactaatctcatgtcacgaggtttcaggcctggctgagaactctgtgagctctgtgatgttgagcttcaggcacatagagtacaagctgggtaggcctctggctcctgcttaagagacagcagaaaggctggatggagcctgtctccagaccagcttcttctgattcaaggagttgggtgggactggcagttcactgaaggcagagtggtagtcctgcttggaacgtgaaactttgtttctttcctgggccttccagtgggtctgttatgttggtgagagtttcagacctagaggaaagggtcactgaaggtatgggttaagagcaactctgaaagccacctgccccccgacttctctgtgagtggggccacagggagaagatcccttcataggtagctcccctacccttgctatgcttggaaactgaccatggaaagggattcatttcttaaagggatagggctaccatttaactttctattgtgtcacttcccgaaacgcaacacctatggcttaagatccaagtgctttagaacatgagatacaaggtcttccaggctctggctgccacatccctttccaggcgtgtgtcccaccacattcctctgcatcctctgtcactggcctcaccagattagtcactttctctgagaacaccctgaactcatccttctcaaggcctttgcacattgtgttccctgagcctatttttctcctcctcatccgtggaaatcctcttgggtgttcaggcatcgtttagaagtcacatcatctgcagagaacttttagaccctcaaaaggacgttgcatgtactcgtgcttttctacacttttcattctgtcttttgtgttccagtgtgtcccccattgaggctcttcgacacccctaggcatgtccaactcagcacctacacctgctaggtccacacactgtgttatccaagacagaaggtgttagcaaacctctctttggtgcgcccctgaatgcagaacatgtgacattctgttaactaacagttgtgccagagtggtttccatagcccatactggggttcccatgatttgtttgatcatgagcccggccattcgaattgtttttgaattggtctgatatcagctagttaattgttaacccttttcaggtttgtttcccacataccagtagatgtctgcttagtgccagggttctgagctttttatttcacttaagaatataatagcaaggtagaattcaggaaagatttacttgctgttaatgtgaacttttaaaaaaatagtttgaaatgtaggctttgtttttatcccaaagctccatgaaatatgaaaatagcaggagttttaaaggtatatttccacctctagaggaagaactgtccatattatagttgtaattataaattaataaagcctgtgtcatgaaacttgattttgaacgcctgtgttcaaatcctggctttaccacttactagcctagagatattggatgagtgtctaacttctccgttcctcagtttcttcagtgttcaattgggaaatttttcttatggttgatggaaagtttaaataaggtcttggatatgaaactgggattttattagtgtgtgtgtttcaaaatgtggatttggaggccatttaaaaatagcatttccaaaaagtttgcttttaaagcaaagtacttagatatataaatttttatgaattttttttcaaatgataaaataaatgagtttacagtcaggagacatacagtatctaacaaacttagggaatatgcttggcttacaagacgtggttttagtccacataaattagaatcacagaactataggctttgagaaattataaaagccttggaaggggtgaacgtgaattagtgcatattgtgtgcaggctttgtgccatacgtgctagatatgggatcccaggaaatggttgcatacaccttgttgggtagatgatattaaccctgttttgcagacagagaaacctgagctttgagaaaatcctttacacaagtccaatatcaaagtctggaacttcaaactgcactcctgatggcttctagaaatcctttccatttacagatatgacaagacttgctttcacattgttgattttttttttatcctctctttctctgtctctgggggcagcactaattcagggccagatagaactgtgaaaatctgcagtgttgatgtcacataacttgtttaatgaatctagattagtgtcttgacttttcctgccaagaatctgctcataaagtgtcttgttttgagctcctttaactgtactcattcatcagcctttacttattttcttctcttttggagagatacttgccattgcccataatgtttgaggtcaggagtatatttgaagagggctttatattttcttaaaaaaaatacaggtggaaaatcaagtttatcagctatttcataccatcttcttctgccatttatgggcaacatgtggaagaggtggcagggagctgggagtttggaataatgtgtctcatcttgaatttgtcgctgaccagggaaaatactcaaggccaactccatcattcccttttgggaattcggtgcttcagctgtaaagagtgagggcactactaggtgattcctaagatttaaaattctgcatgttttgtggtgtcaaaaccatcaatttctggtgagctgcgtgatcctgcagctgtttctctgatacttttcaatctttagatttaatctattcaacaatgtataattttttaaagggaagcttttatagatacttctgaactataaccgggtgggggggataaatggatgttaaaaaatagaaaacaaccaattaaatagtatatagcatgtaattctccttggaaacttaccacgaaattgagaagcactttaacaactggtaatttaaattgcgtttgaactctgctaatggtttgtttgcatgggaacttcaatcatttcacagtggttctttagcaaagctgcttgttctctttatggaaaataagaaaaaattattaaaagagaagttggctatggaaaatggagaccactttcatttgtgcctggagggaagctggagagtgtgagtgagactccctcagggccaagggtggagagctcttcctttcagtgaagtttaaaaatctgggaagtcagatgccctttgctgctgttgtagaaactgttgtgatttgtatctctctctgcaaggagaagctttggttttatgcagcttgcgggtgagggtagggacaacctttttcgtttgttttatgaaattgcattgttcacaggtctaatgttggcttcctaacaacccatttctcagtaagtttgaaattatgcctctctctcctttcagtggaaatggctttcagaattccaatgtccttgaagaccactaggtctcaggaaactccttgcttttctgggctgatagtgattatactccattttgcctacttaatttctgtctgctgttgaggttactgggagagcgttgaaataggtgttcgaggcctggatttgtaagtcctggtttggctctaggtgtgactcatgtgaccaagcacaagtccctctgcccagtgtgttttgttgtcctttgtcaaagcaagcagtcacttgatccagtggatcaagtggctcctgaagaggtcacctccttacccaggccaccgggttctcttgtcagttggaaaagttgaggtgggtcatttaaaaaatccctcccaactttgaacttggaattgttttgtacacaaaacaattgtatgattggctaggtaatgtttacagtgacaacaatgaaatgggcatggtagtttctcgtatgtggatttctcctgcatacatgaaagacaagttttataacagcccttgccttgggatacttgtctgttggcatacatactgtgtaatcattagcaaaacaataatagttgctaatgaaataaaacctgtaataagggctgtattaggctattctagcattgccataaagaaatagctgaggctcggtaatctataagaaagaaggtgtaattgggtcatggttctgcagtctgtataagcatggcactggcatctgcttggcttctgggaagacctcagggagcttttactcatggctgaaggcaaaggaggagcaggtgtctcagatggcaaaagcaggagcaagagagggagtaggcagaggagttgccacacacttttaaatgaccagatatcatgagaacacactcgtgatcgtgaggacagcaccaagaggatggtgctaaaccattcatgagaaatccgcccccatcatccaatcacctctgcaggccccacctccaacagcaggtattacaactcaacatgaaattcagaggggacacatatccaaatgatatcaaggacggcttactgggaaatgtcaagattgtttatccctctgctgctcactgattctcacttttcaggcaaggaaactaaagttcaaagaacattaggtcctatagttagaaatttgtctccaaactcatattccttttctttttttatttggtatagtttaggtttatctgttaatttttttcttccctacaatttgagtatctaactgacttgcctctttcacctccattattaagatgaagctgttttcccaggagaactaggagagctgagatatgaacactgaggcatcagcattctctttccccatcattctgagtcaaattagtgaaataagagtgccaggatctgactaggagtttaggaggtatagaagtaaaccacggcccagtcagagactttataagcctgggaatttctgaagctggttaagaccctagagatacataagcaacacccttctgtttttcataggtgggaactttgaggctcagagacagagcagaagacagaacctggtcttctgattccctgtgttctgcttttttcattgttccactggacgctcatcagagggaagatctttttcctcaattggtgagtcccgcacacaaaaagaacacatttgccttttaaaatcaatgtatatgttttaatgagttttaaacatcagtgttttccacttaaagtatgggcatcagtaactaggatgcattaagaataagagaagaactgaaatgcccttccttctttcttgagttgcttttatggcaatagacaatatataaccatgctaataaaatgtgtggcaaagcaaaggcagagctcagctcttggaaggtggtagcattgaacttggaggaaaatttggagtaacgatgatttcaggttgccagcaattgtattgcctccttctttctcatttggcatggaagaaagtgttcatgaaatggaaagaccaaaatgaaaatgtcactgaacagtgtttgggcatttacaaggaaagaaagcagtattattgagtgtctcttgtttgcccttgtgcaaagtgctgcttcttttgtgatctcatttcattttatgtatttatttttttgagatggagtcttgctctgttgcccattctggggtgcagtggtgccatcttggctcactgcaacctccacctcccaggttcaagcgattctcctgcctcagcctcccgagcagctgggactacaggcacataccaccatgcctggctaatttttgtattttcagtagagatggggtttcaccatgatggccaggctggtcttgaactcctgacctcaggtaatccacccgcctcagcctcccaaattgctgggattataggtgtgagccactgcgcccagcctcattttatttctataacaaccctttggggcagagcaggctaaatttgcttaggcaaagggtgtgagcctttgttttaaagggcctgccagagctccaccaggatgtgaggtgcaaatcctgttatgtgctcagaaaggagaattgtgaccaggtaaggtaaactttcccttgtgttttggtgtacctctgtacttaatgggtagagtagaacattatgttctaaaaaatcggggtggtaaaaagaatcaacagtgtggaataccctgggctctaaggaaagctgaggaaattagtaagggaattctgggtgcgacttccacttaggatcctgattcgatggtccccattggctgaggccaattcatatatgcccccagcattggctttgtactgagtaattaatacaccttgacatatttgtggtgtagttttccaaaacagagatgatgccattgtgattgaaaaaaaactaacttcatttaaaagtgtgactgagtttatagatgtgttttgtctctctgtcttttcttaatcagtgtatcttaaaagtacaactgactgtgtgcctattgatctatattacataaaaggctggaaaccactggtttgatgcttaaaccttagtgtctgttaaaatttcaaacatgatctggaatatattccccctagcatacgtttaagtatcaaatgaaaaatctttgtcacctcctctatgtcttgagttttttcagtgtttataattaaactgtgataagtatgaagctttgcacttggacttaaaaaaatcaagtgtgtaatgatagaaagggagagatttccttaacaagagcagactggaagagacttttatttatttattttatttttattttttatttatttattattatttatactttaagttttagggtacctgtgcacaatgtgcaggttagttacatatgtatacatgtgccatgctggtgtgctgcacccactaactcgtcatctagcattaggtatatctcctaatgctatccctcccccctccccccaccccacaacagtccccaaagtgtgatgttccccttcctgtgtccatgtgttctcattgttcagttcccacctatgagcagactggaagagtcttagaagtttttgttgttcataagctaaatatgagccaacagtggcttttgttgggagtggcttccgaaatgctgatgcagccttcacctgcgtttaatagagtatggcatctagaacaaagtgagtgggtgattctgcaaacctagaacacctggaaactggcaagtgcagaggtcatgtgagcctcaggcacagtttgaacaggactctagctctgtttttctgcagcacttcttgctctgcccttttttgtgcctgggcttcatccttggaatgttttacctcatgggccatgagacggctgcctgctgaaacccaaactatagatatccctgttcccatttaggggaaagagcctggtttgctatattctcataggcttggctgactgtatatttctgaaccagtcattgaagccaagagaatgggattatggtaatatgaaccactattctcctgaaactgaatttggacatagtcccatccaaacctcatggtacttacacagtggagaagaggtggccccgcaaaggaatatctgggtgctgttaggagagggagagaggactggaagctccgtgggcaaccacaggccttctgcagacctctttagcccccctgtcagagaccctctagagagccgggctttagttcctgcctcaccttctgaaaaggcatcagccagctgcactgtctacacgaggatgctgagaggaccaggaatgatggccaaccaagaagtgttacgggaatgagaccatggattctgctgcaagattctgggacacacgtgctcatggccatcaagaacatagaacctgggcaggacagggacagcattgcttgttcatgtgtgtgtctccagagtctgctggggtctctggcatgggataggtgctgcatgaattttcatggatagaataaatctgaaggaagtgagggtccctttcccaaagggtgttctatcgggcattggctgactctctgttagggagtataggaattgtagcacagatgaagccagactacgtgatttaatgagaatgaaacaaatgactggacaagctgggcatcgtggctcacatctgtaatccctgtgctttgggaggccatggcaggaagatcgattgaggccaggattttgagaccagcctgggcaatgtggcaagaccctgtctctacaactaaacaaacaaaatcccaaatgactggacagaaagaggcttttgacttaagaagtttgtgagggcataaaaaggcagtgagtatggtgggatgccctaacagaagtcctgacaagtatgagatgtgcaaccctagaaaaacaacatcccttcacccttatttttttgatctgagaattaggaacaataatcattgccctgcctacctctcatgtttgcttagagcaagtgcattgttaaatgccaacctgttttgtaaactataaagtgtggttcctgtatgatacattattacagttgtcttcttccttaaagactcatcttgaatataaagaaaaagacaatgtaagttcagtgcacagcatcgggaacattagacatgctcagcgtatgcccttcctgccaacattgtacctcttcctcctccgggttggatgggcactaactcgtcctcagtcctgcagctagatctgcaactttgcttaatgatgcaggttaaaattgaaatagaattatgtattattatttttcacattcatttttgcctgagacaggaggtggagggtggtaaattaagaaacccgggaagctcagtgcttgagagaacccatagaagctacagtctagcccatttggcttcttactttgttagattagataatcatacctgctgctccaggcgtgactagcccagtgggagtcaggaaggaaattatttccctctgttgataccggtttacaattgccgactgtcgccaagggctttcagttttaatatttcctctttggtcctcagaagtatcaggtattagtctctgccggaagcaaagcattggtcacttccgtcagaggtgaatgtcttggctgtctataattcctcagtcaggtgctttctgggcatgtgtgagcatttgctcagctagcttttattgcttgtatgttatttgcttcaaaaattacaagaggatttgtcgggtctgagcagtgacctatccagtcccctgaaactctatggttcttcgtgtaacccagggatgtcttgtaggaggtatgtttgctgtccacgaaagtaaaaagtagtgatatctctttctctcttttgcttccttcctcctaattccacattctcctatttcttggcttctggcacagtggagatacctctactctacattaggcatggccttaggggatccgaattctcaggtcttcctcaatgagttgctgtgtggtagacagcatctgaagtttgaatgggtagagagacctttgtagattgtggccaaatatttacacctggttcatagagtatgtgtttgctgccctgatctcagtgttggtctgggtgttagtgaacctcatgatctttaggaaactatgtgaattaggcttagtccctgaccctgagaagcttatagttagggaaaaagacaaacatataaaggagaaatacacattagaaacatattcttttttttttttgagatggagtctcattccgttgccaggccagagtgcggtggtgcgatcttggctcactgcaacctccgcctccaggattcaagagattctcttgcctcagctgcccgagtagctgggactacaggtgcgtgccgccacgcccagctaatttttgtatttttagtagagacggggtttcaccacattggccagaatggtcttgatctcctgacctcatgatccatccaccttggccctccaaagtgctgggattacaagaaacatattatttatggtacacatttattaatcaccagatatgtttcaggccttacgctgagtgcttgggaaattgagataaattatagtctcagatctcatggggcgtggatgaagagttgggagaaagaaaaaaataggccaggcgtagtggcttatacctgtaatcccagcactttgggaggctgaggcaggcagatcacctgaggtcgggagttcaagaccagactgaccaaaatggagaagcctcatctctactagaaatacaaaattagccgggcatgcctctaatcccagctactcgggaggctgaggcaggagaattgcttgaacccaggaggcggaggttgcggtgagccgagatcgcaccattgcactccagcctgggcaacaacagcaaaactctgtctcaaaaaaaaaaaaaaagaaaaaaagcattgattaatattatctcacagtttctgaaatttgggagcagcgtggatgggtgccacaagatctctcaccacatcgcagtccaggtgttgctggacctgcagtctcaccggaaggctgaactccggggaagatctacttgctaccaagcacatcgcatgatggttggcaggatttgtttccccacagattattggactgaggacttcagtttcttgccgtgtagggctctctatagggcagctcacatggcagctgccttccctcaaaatgagtgagcaagagagagtccctgagaggcaaatcacagtctttttataagttaatcctggaggtgacacactgttccctctgcctcattctctttacgagaagcgagtcactaggtccaggccacactgaaggggaggggtgaatatgagcacaaggttattaataccaggaggtggagttacacggaaccatcttaggggctgcttaccacagattccccaggtttacatggatgtgctaaggtggaagtggacgttgcctgaagcagttgaataaacccagcacacctctgtggatcaattttacttgaagacatttttgggggaaaactccatttaaaactcttaagagaagcactggtacataatagcacaggatgtaaagttggcatggcttttaagaagaaaaacacaagttttcaattcatgccgtgttcccttacctctgtatttttgccctcctcagcggtagagcttttttggtagaaatgtcgaaaggttcttgcttgagccccttgctgtatgcgtgagacaccgagacttggaaagggcacatactcttccagggccacagagccagcggtagtcaagggaggaaccatctgcagctcctctctgtgccccgccttccaccgctccacacagtctctgctgcataatgagtctgtgcaacttttaggatgttttctcttcttttctcaaactctctcctgtcccagaaacagattaggaaaaataggtcaaaaattggaatcttgagctttgattttgtccctttagttaaatttcaggggtctgcgtctcctggtgggccatgttgtgtcctgaaaagttgcataaatcaatattacacggctcagacagtgtatctctgcagttatgaataacatttgttttaggaacagagagctgatatacaacgttactttgagactgacaagaccagacataaaacctcagccaataccctctgtctggcagggagtttcttttccagagcatccttctcttcccccgaccaaagcagtccttttcaaaatcaagctccgcagtttattttatagaagatgacaggttcccttagagtccacattcacataactagaaaaattaatggaaattggagccttaaaattatggtcaagcttattagtgactttacagccaaaatgaggaacgcacagctttggtcactgagaatgtggctggccagaacgtgaattctactacctgctccatagtccctttcaactctcagcaattttttttaatactcatcttattcttttttttttgagatggagtctcactgttgcccaggatggagtgcaatggtacagctcactgcagcctctgcctccaaggttcaagcgattctcctgccttagcctcccaagtggctgggattacagatgcatgccatcacacccggctatttttttttttttttttttttttgtatttttagtagaggaggtttcaccatgttggttaggctggtcttgaactcttgacctcaagtgatccaccctccttggcctccaaaagtgctgggattacaggtgtgagctgccatgcctggctaactctgcttgttattaaagtgtttcttaccaattatttcatttttattaaaagtacatagtaggaaatagagttttagttggacaaggacaacatggtaaagaggaatttggagtaggaagactgtcacattagtcactgaatcctacctagttcacttagttttttttagcctgttttcacttctgcaagccatggagtgaagagtgcctacttcagagtctttggtgctctcaaagcagcgtaatgtctataaagtacctattgagtgtggtacttcttatgtagttggcacacattaaatgttaagtttctgatcaccttaagagtccataactctttgctggagatcacccttagttcttttctttgttaggccattatctcatgtcctgtttacactgtccccttggattggcctagacctgcagcgtttgtgtattggtcaccccagatttcatgtttcctgaataattaatagcctcaacatttctaattttgcataatgactcccaaggcctaactacaaacatcataatgtgctcatgttttctgatacctggaaatatagtggctctaggaacaaaacctttatccactgtgtttcatggggaaggcttattgggcatcactactggaaagtaagtgttgattttaatggcaagactagtccaggggtgaattctactcaggtgccattagcaacctcttcatctgtaaatggaagtgtctctgggacctgctcagctctgacctgctttgggtcctttttggacttcttcaggatgagatcacctcaccgtggttcaatgccaactggtttgagttatatcagttattaaaaatgatctaatgttttccttttaaatctgaggccctggctcattctatgattaagccagtgatttatttataatatagtgtgagatggctgcagccactctatgatgtaatctaagaatgacatgaaaacaaaataggtttttacataatgaaagtattcctgtaatacagtttatagcaaggctttttccccccattgagaatggagatatattctttacttttccttctactcctgtttaaatcttcttttaccatttattacacttaaggcctttaagtcaatttttaaaaatcagcatttacaactccacaaagtctctggttactcttttaatcttgtcattttcttcgctcccaatccccactgccaccctccatggcctctgtgtgtagccgctgctcaccccctgctcagcactccagagtcctcaccattcctctgcttatgctgtttcttctgctggaatgctcaccccaatcctaacttttcttctgctaaaggcatacttcactggttcccacaaatagcatccttctgtagcctgctcaaatgcacatcttcctttaagcctcctgtgttgctccttccccttgttagaaacccgttatctgtactcttatggaacttagtgtaatagcaaacccccacccctgctccaagggctattcacagactgtcagagttagggaggagaaatgacttagaggaatggggtaaggggttttgatagttcccggtctgctcctaatagtgagacccgggcagtcagtcatggctcatctttgtggttcagtttttctcagctgaggaatgagtggtttggattttatttcacatggccaaatgatgtgttggtagtggttccttgaggtgctgtgctgagaaggactctgaggctgcatcctgactcagctaatgatcacttaggaatatcgccatgggagtggagagtgaaagcatacgagaggtatctgagctgcttttggactaggtgatttaaatgtctctttttgttctaccttctggatgctttgatttactgacttgtgaagtgtcttgcccaagatcacgtagcccattaagttttagaagctgattctctgacacagagatggttaaaagctacacatttgactctcacattcatacacgtaggctggctgtgggagatgaaaagctagaataagaagttctagaagatccatgacttattgaaaacacaagactactcaaactctgtatgtctttgagggtgagtgaggtcacttttcacctctttgtcttctttgcttcctaggagttannnnnnnnnnnnnnnnnnnnnnnnnnnnnnnnnnnnnnnnnnnnnnnnnnnnnnnnnnnnnnnnnnnnnnnnnnnnnnnnnnccccactattcaaatttatgtcaaagttggcagttcaaggtcaaggtcagaaaggcaggtgatcctgccagggtcttaattggatcagccttaccccatgaatccattagatctcctgttccccttcttccaactccagacaaaatgcttagctctctgcaaaaagcccaattgcatgagcagtaggtcagctcagcaaccaggtgattgaacactgggacaagaataaaggaaggaaaggaagagggcattttaggatggctgaaggtgctggaaacttgaaccctagaggaatgaagaaggaactggaagtgcttagtgtaaagaagaaataaaggggcaggaggaggagagagcagagcaggtggtgctgtcctgggtctctgctgtggaacgggtgcaaactcactttttgggacctctggaagagttctggcagcagtgggttggaagcaagagatagatagtgtgagaatgttgatgttttctcaatgtttatggaaaatgcttaatgttttaatattaagagcaaaccacagatggaatgtgtgtttcaggaggtcgaagttcacaatcactgcagatgtctaggtggggttgatgcagttaggtattttctattttaggtattttgtggtggggataaaatgttatacatgatgacttttaaggtcctccctgtcttaagagtctagagtttttttagacatgtttttgtgtacatttaaataatttccattttaaaatgaaggctctttggagtaaagtgattgttcctttctccataatcttggcacatgtaagtgctgacttaccttgggcaatctcttctccacttagcattattgaaggaaaggagactaactgaggatgtcttagaattttttgtactgaatgtatttttgaagatgatttgtacgtttcttttcagggtagttccagggaagtctcttctttaggcctcctccaaccaccatcccctattgtcaatgattggctgtttttgtactaccagaatgctttgtgtatacatccaataaagcattcatgccacttcagtctgctgtataagcctgttttcacaatctttcttctcctctagattgtagaagctccttgagggcatgaattatgtctttttccataggaagtcccatgtcatctagtataatagtttgcaaatagtaataatgatgactcattaactcgagcgtttactgaacacctactatttgctagacactattccaggtgatgggactagaacaaatgttaaaaaaaagacagaaaaattaatgagtaaatatgtaatatttacattgtgatctattaggttggtgcaaaagtaattgtgatttctgccattacttttaatggcaaaagccgcaattacatttacaccaacctaaatatattaagaagaaaaataattgaggttaaaggcatgaagagtagggaggacacaaatgtaaattcactggcctgagaaggtcttgatggtaagagtatatgtgaatggagacctgaatgaaacgaggtagcaagccagagatgtgtgggtgggatggactggaggaagagtgtgtagaactgactgaaagcaaatgcaaataacctgacctgaagcatgctggggacatgccggaaaagtgaagaggacagtgtggctagagtgaagtgtgtaaaagtggtcatgcatgccaaataaaaatagttgcaacaaccagtaagacatacatgagagatattgtgggttcagttgcagaccaccaccgcaataaaacaaatattgcagtgaagcgagtcacacaaaattcttggttcccagtgcatatgaaatttatgtttacactatactgtagtctcttaagtgtgaaatagcattatgtctaaaaatacagtatacctaccttaattaaaacttttattgctaaaatatgctagcaattatctgaactttcagtgagtcctgcttttgctgatggagggtcttgccatgatgctaatgactactgactgatcagagtggtggttggtgaaagttggggtggctgtggcaatttctgaaagtgagacaacaataaagtttgccacattgattgactctgcagagaaagagtgatatcaagctgtatcacttctctgtagcatgtgataatgcataatatcattttaccttcaagaaaacttctttcaaaattggagtcaggcctctcaaactttggatctgctttatccattaagtttatgaaatatttgatatacttttttttttgttgtcattcaacgatgctcacagcatcttcaccaggggtaatttccatctcaggaaaccattttctctgttcatccataagaagcccctccttatccattcaagtttaaacaaaggattacagcaacacagttgcatcttcattccacttctaattctagttctcttgctattttcaccacatcctcagttatttcctccactggtcttgaaccactcaaagtcacccatgaggattggaataaatttcttccaatctcctgttaatgctgatattttgaccttctcttatgaatcacaaatgttcttaatggcatctagaatggtgaatcctttttagaaagttttcaatttactttgtccgcattcatctgaggaatcattatctatggcagctagagccatatgaaatgtatttttttaaataatcagacttgaaagttgaaattactccttgatccatgggctgcagaatggatgttgtgttagcagacaagaaaacaacattaatctctttgtatatctccatcagagatcttgtgtgaccaggtatgagaagaaatattttgaaaggaatcttttttttttccctcttttctgagcagtaggtaacagtgggcttaaaatattctgtaaaccatgctggaaacagagtgctttcatccaggctttgtcattccatttatagagcacaggcagagtagattcagcataattcttaaggaccctaagattttcagaatggtaaatgagcatttgcttcaacttaaagtcaccagccacattagcctctaacaagagagttaccctgtcctttgaagctttgaagccaggtattgatttcttttctctacttctgaaagtcctggatggcatcttctttcaatataagcctgtttcatctacaatgaaaatctgttgtttagtatttaccttcgtcagtgatcttagcttgatcttctggataacttgctgcagcttctccatcagcacttactgcttttccttgcacttttatgttatggagacctagtttttccttaaacctcaggaaccaatctctgctagcttcagatttttcttctgtagtttcctcacttctttttgccttcatagaattgaacagagttagggccttgctctggattaggctttgacttaaagggaattttgtggctggtttgatcttctatccagatcactccaactttcttcatctcagcaataaggttgtttcactttcttatcattcatgtgttcactggaatagcacttttaatttcctttatgaacttttttttttttggtatgcacatcttggctgtttggcacaagaggcctagcttttggcctctcttggcttttgacatgccttcctcactaaacttaaccatttctagcttttgattaaagtgagagatgtgctactcttcctttcacttgaacacttcgaaaccattgtagggttattaattggcctaatttcagtattagtgtgggagatgggagggtccaaggagagacgtgggaatggctggtcagtggagcagtcagaacacacctatttattgatcaagtttgccatctcatatggccatgatttgtgataccccaaaataattatgatagtcacatcgaatatcactgatcacagatcaccataatacatataataataatgaaaaagtttgaaacattgtgatagttaccaaaaggtgacacagagccatgaaatgagcacatgctgttggaaaaattgtacctaaagacttgcttgatacacagctgcctccacaaatcttctatttgtaaaaaacacagtatttgccaactacaataaagtgaagtgcaataaaacaagatatgcctttattagttaagtacacattgaagatgctcaggaaaaaataaattgcttttgtgattcaaagaatccacataaatctaacaaaagaatgacaaaacatatttctgtttttcagctctaagagatgggggcactggatcaggagcaggatggtagtggtgtgcagctttgaacaagtccagttgccgtggggtttccctccatggcagagggctctccactccgtttctctgcccctgcggcaggcacacctgcagggatgcctgggccctgggtgcagatgggcaatcgtaagcctaatcacccattcaggcacacacttacttgttttccacatgcaaatatggcctttttgcggatgaatttaatacagttgttgcttcctcattttatttaaaacaaaacaaatggccaaccatgtcagttgagggtagcaaatagaaacatgagtattatggtctttgctgtttgtgtcgattacacggctgaaaggaatcccaggcaaatcagtcttttctgtgctcaattttatttttactttatatcaccttttcttactatcgctattggttttaacaaaatttttaaagagggctatcacattcctttctcttaatcattttatcaatatttcaggctccttagttctattttgtggtttctacctttgacatttttagtttctgaacttggggcccattgttcaaagaaaggcattatggagtctccaaaagccattggcaggtggtgtctgtgacttccttagcctggaaataaacaaataaacaagcacaaattagaagtctttgccctattactgcactattagtattgattgcgcaacatcatgcaaaaagtcactttaatttatctggcaggtcctatgtaaacaccaatacagtcaagagggcttggatgggtatttgctttcatttctaatgaaatttcaggcctctagggtaggatatcaaaattggtagatcatttgcaatttattttatcccaaacacctcactttacagtcagagaaactgaggcccagagaagtaaaatgagttgctcaaggtctcagagagcaagaaatagagatgggacttgagcacctagatctctggtattgctgtcctgtagttcatggagctggcagatggatacatctgtgacctgggatgatggagagactgctggacccttcagaggatctcatctcaaggtggggtttatgtgtaaatgatatctgtgtgtttcattttcctttcataaactaatttaaaaatccttttggtatcaaattttaagccaaaaagtagtgagggggaacatgggtaggaatagcttacagcttgcctaacaaggttgttgactgcataagagtcaggagttttgggtaagagtgtgtgtgtgtgtgtgtgtgtgtgtgtgtgtgtgagagagagacagagagagaaagaggtaaagaggaacaaatgaagagggagaggtcagattgtttgacagtagcaacttcataggcacagaatttctgagttggaaggaagtcttatacgtactgaatttgactgctttattttgtagggaaggaaactgatgtgcctagagtagttgagagctttattcaaactcattccactgttattgagtagttaggatattagaccagcaacatatttgggtagaaactttcatataaaaaagcgtaatcataactatccaatcatgtcaactagtaaggctgctcaggtgggataacacatcaaccttctttgggattcttccctcagacatggttttggtgggaggagcatggcaagggaggggcgagctccaaatgcagggctgctctgtcctcggcgacctgagcagacacacgagcagagatcagagacactcttagtgaatgaacctccctattggctatattaaagtaatgctctgaaaaagttccgtgtggagagcaaggccagttagggaacattttgtggatcttttatatgtccttaactatatgattcttttatttttaaatgaaaaatgttaagatgttacggggtatgtatgcatagtctaaagtgatgattttagaggtagcaagacagtgagaatgtccctacatgtgaaatgggcacagttttatcagggaagtgtcaatagagggttaatgttccacgtagtggctgcaagaatgataagtggtcatggggatagcctgacactctaggagcagaaggtggtgggtatggatagaactactgatatagcatgaatccaacctgctgttatctgcgcaggcctctctgcagctgtttgccctgaagtacatgctgtacgtttctccagctgatcctgcatgactgggtataaacgcctgtccgctgtgtgctggacagccccagacaccctcggcagcctgctgtgtttgtgtgagacatgctgtgttagggatttaagcatctccctactcgttcctcatctttttctcttctcttccttctaatctcctttcatctttccctttgggggagaaaaagtcatcagagttgtttgaaggttcatttatgttgatttgtttttattttgaagctaatttgtttcctgcttgtatctgtaactgatgtacttcatgtgagaccgtgttataatatacttgagttctccttggccctctgatttcttttctttttttcttttactgaaaaataaaagatttccttctctcttcagacctacagctttctcatctacatggacaacctatttttaaagaatcttcagagagtcgttgactttgttataactactactatatacgtaatttcagatgatagaattgaaaatttaacttgtttttctagaaagagtttattttccctataacttcaaagagtaatggtggggagtaggacattctgaaaataagaagaaacatgtcaaatgaatttctgacttccagctaggcatatggaataaaggtctttattccagtgacctctgctcattggaaaactttgggctggtagatttcatgattctgacgctgtatgtcctcttgagttacagtgagtgatgaggccaaatcgcagggtggatgatgtgctttttttgggctaataggtgttaaggaggcatgctgtcctttggcgttaagacagatcatttcctcagttgggtaatgtttaaggaatccactaaatccttaaatatatggcacacataaggaatgcagagcttttagacactcagccttaacatgggttattttttagcatggctaatggctaaacttgatttctactgggtttgttcaacctatttctaacttataggtaaaagcctgctttttatcctctccatcctcatcacctttttagttgtgtctctgcttgattcttcttgcattcaggtctatattgtattataaaaagaaagagagagacagagagagagagagagaaggaaaagaagaaggaaaaaaaaaccacacacattgaatgggaaggcaggagagtagagctctgaccccagctctgtcatagccacctgtgtgactatttgcaagcattttcatccattcaacaaatacacaccaggtaccggagatacaaaactgtgaaagacacggttcttaccctcaccacttacagtcaggagtagagagttaggtacacaaatagaatgtgaaatcacttctcctttctgggtcttcattttacaaatgcaagagccagaactgggccaggtgatcatcaaggtcccttctgaggctaacatgccatcattcatgcaaaattcattaaacatctgataatcacttacctaagtgaaaattagcaaacatttcccctttctccttagtttgtaggggatgatattgaagacgaatgaggcgatgtctacaaaatgctttaataagcaagttggagaaagagattatgtaagtttgaggcattatgattaatgaaaaatgaaaacaagggctgatgttttcagagagagaacagatggttcctttgttcagaatttgagtataaaaaagagaggaagaaaagatacttgctatattgtttaggccctgaatgtgagtaactttaaaatgccaaaacaatctggttaggaaagtcccatagattcaaaatagctcttacagtgatcaaactataattaatataacaaaaaaaagacagaaaaatactaataagaaatgccacagtgacagctgacacaacctgacaaaaactcctatttttacaacaactctagaaacttgattttttctgttctcaggagttataccacactgtaaaacaaactagtgagaaccgatttaaaactgtttctaccgttccccctacccctcaggttattttagtttcccatgactcataaaggaaatcttcaggattcacaagaaattggcaattcttttccatctttgctgttgagtattgataggaaaacagcatagtttggggcaatttaagtagagaacaaacctccgggggcttggggtggtgtctcagaaggccggatctgggaagggcctttgaaaagcttgcacggaaagctgcgaaataaatcgtttctttttctctttctttacgttctaaaatctcgtgatctgtttctacaatacacaggctaattgatgttatccttttggcatgattcttgctgtcctggggtctatcacttgcaggctatgagaatgaggccatagaccaccacactggcagcactgagcaaaaggtgctagacccttctgagttcaggtgctgtgtaactggtgctgtgattggacagggtgactaacctcagtctctctgggtgtaatttcttcactgtggaaagaggaggctaactagaaagttcactctgacactaatctgagttcaggtccacatctttttttttaattaattattttatttttaaaatttttatttttttgagacagagtctcgctctgtcgcgcaggctggagagtagaggcacaatctctgctcaccacaacctccacttcccgggttcaagcgattctcctgcctcagcctcctgagtagcttacaggtgcccgtcaccacgcccggctaatttttgtatttttagtagaggtggggtttcaccgtgttgtgcaggctggtctcgaactcctggccttaagatatctgcctgcctcggcctgccaaagttctgggattatagaagtgagccactgcgcccagcgcacatacaattgtaggaaggctgagaatggcttttaatttgggagcgtttaaaagcaaacatgcttcctcaagacaacagtaacaaaaaattgacatcgttgaggtgggaacttctttaatgctacctgagcctcttgctgaaatggttctatgcagttttgcatagctaggagtggtaagctcattcacagacatggaagaggcagagtgggcttagggagaggcaccagtctagtggtccaacttgggttctgggttccagtcctgcttctgctactaaccccatgagaccttggaatgcccatctctaaggtttctttcagagctgaatcactgtttggtctgtgattcatcaaagcaattagaagactatgcctctccttcaagaccaagactttggtcagaatactccctagggactttctcactgtgtgtggcactcttctctattagacgctttattcattctccattgtattagagtcaaaagtatgattgtttgttgtagaggtgccttttccgtgtcatctctgataatctacccctctctctctgagtaacctaggcttttaaaacacatctcctttggcttaatcacactgcctggtgtctactcagcattatgtgtttgttgtctgccctgaactgtgaactcagccatgtcctgctcatttctgaagcctcagcatgtacatcggtatctggttcatggtagattttcaatgaatctgagtgaatgaatgatggatgaatgattttgtatctccttactaggcatatgttccttgagggcatggaccgtgtctaatgggtggctacctagtgtctcattcttggtccgttgttagtggtgatttttgtcctcttctttgcactcatcattctaggcttgtattagggtaaattgttagcataattctgccttgtttcccaccctgcccccgccttttttttcttttgaaacagagtcttgctctgtcacccaggctggagtgcagtggcacaatcttggctcactgcaacctctgcctcccgggttcaagcaattctcctgcctcagcctcccaagtagctgggattacaggcacccgccactacgcctgactaatttttgtatttttcatagagacagggtttcatcatgttggtcatgctggtctcgaacttctgacctcgtgatctgcctgcctcggcctcccaaagtgctgggattacaggcttgtttgcttttaaacagtttgtgggcagggatggtattttcttatgattctattcctcacagatcctggcccagagccattagcagagaaaattctcagtagatgtttgctgacctaaacttcattccaccacctttgccttccttttgccttttcacctcctcttagaaggtaccttatatgataatgtcacctatgcaataaagaccacaaagtaaatttaataaaatagaaggcatgcttccctcttttctaaccccacacttttttttttttaagatcaaaataacgttgcatttgtgtgtgccctgcttttatttatttatttcttttgtagacacgaggtctcactatgttgcccaggctctctccaactactgagctcggtgatcctcccacctcggccttccaaagtgctaagattataggtgtgagacaccacacccagcccagccctgctttcacaaaaaacaaaataatgatgaatatattgtactaccctcactgttttcatttgtctgtgaatgcttcttattttatcaggaaaaggaaaaatttctgtttcttgactgtaattgttgaaatgtattttcaaagttttttactttatttttggactgataccataaaatcgtgtgaaatgatgtgaggattttctaatggagaaatgacttagaatatcccttggatgtcctatctgctttttaattgttttatcatcccagacatgtttctctattcctgtctattcttttatctgtaaaatgaggttattgaactagatgctgtctacaactttttttttttctttcattaacattaaatctctggtacctgagaacattgggatcaggctgatatgtctaggtgtctatttctttggtctacccttcaagtaggaatgaaaacccatagaatttctgtaattatcagcctcaataactttctaaagcctttaggaagcagataccctgcaatttatctcactaatttgtttgtgattaacactctctgccccttctcatatcccaagctcagtgttttgatatttaattacagggaattctttcctcttcatagatgatatagcaattgtatttcatttctcttatctgaaatctctgctgactttccatgtcttatgaatttaaatagtctaaatagggcatgagatcttaaatattccttccagtttctacattttctattcagcaacaacattttccctggaaaagggtgaaagcctgtgagtcccccacagggcaggagcactgaatacacccacattttcctaccatctgacatagatgagacacaaagtagggactcagatgattatttaactgaatcaactggattccttaattctcacaatattatccttcctactttgtaaatagggaaatggaggcttagtcacacaaaatatcttgttcgaagttactaatcaattaagtaacttaataatttattgacatctgaggcatttctctctttctacagcctcagaccagaaatgatgggatttcagccttcttttcttagagattggtgagccaagacctggagagagaactctggttgtcttaagtcacccagatgaactattaatagaaaaagaattctactcagtcagtacttaaaagcttgacatgtttgtgtggagacctgtgtgtgactgagttcagatcactctaatttcctgggcctcacttgacccatctgtgaaatggggcaatgagctcttttcggcatgaaggcaaggaactgtccagaagacctctggagaattcttcttaccctgagatcaagggttctgtgagtagtacaactcacacccaaagtcttagttgcagggcactttagtgggaaaaaaaaaaaaacgctgaggctatttttagagccttcatctggttatagactagttggtaggagagcaatacctttgaaaagttaagaaatagttttatacactgtgttaaggatgttgtcaaaactaatactcgtgtatgcaaagactttaacatttattaataattttttctatagattggtgaaattggtttgtaatttttgtcatttcacttttgtggaaattgagcaaaggtgagagataaaatgatgtgatcaggctgggtgcgttggctcatgcctgtaatcccagcattttgggaggccaaggtgggcgcctgaggtctggagttcaagaccagcctggtcaacatggtgaaaccctgtttctactaaaaatacaaaaattagctgggcatggtggcacatgcctgtaatcctagctacttgggaggctgaagcaggagaatcgcttgaacttgggaggtggaggttgcagtgagacgagattgcgccattgcactccaggctgggcgacagagtgagactccatctcagaaaaaaaaaaaaaaaaagatgtgatcaatatcaatctaaggacactgtaaagcagcagaggattgacgattttcctaagacttagtggatgtagaagagtttaaaatattctagcctagtggtttgcaaacttggccacatattaaaatcttcagaggaactttatgctacaatgctcatctcagtcacagtgtctgtgggtgagacccaagctcagttacattttaaagctcccgagagtttagaactattgatctagtcttgatttcgtatcaatttctctgatggtatcttgcttgacatcttacttactgggctgcatttttgtgctgtgtctccctgacacccaagtgaaaactgctggatgaaccgaaaattcacccaaacaacgtgaatgtaatggaaactcttgaaaaggcttacaagccttgaagtaaatgttgggcgaagggagcgaaagggttagcgtttttttgcattgggacctgccttctttttatgcttctaggaacgtttaaaaatgagagcaaggaatatatttcattgctttaattgttcaaggtcttttaaaagcgtgtgcaataaaatgccttttaagataactgacctttgtattttaatgctttttggaagggaacaatacctagtgttcagctgcagtataactttatatatatatatatatatatatatatatacagtcagcagagcttgttttggaatcagagggctgagggttttgctgccttcccagatattttacctgtttctgtttcaacatcaagttccattcagttgatgtttcttgacctcataatgtctaacctttatatctttgttttttccctttccaaacttatccaagaaggagacttcaaggcctgattcattaatttttccttctgctgggaactcaggtgtgtggtggaaggcagcacatgtgacctaatctatattttgacaaagaagaaagctccctgccctcccttgcaccagttcgtttggtaatttttaatcccaaaagccactgctaatacgtttttaaaaattgatgctagctattacgttgttagataaagctcatcttccaactctaaacttgctctttctaaaagtgaaataacactcaggttgcaaacatagtgaactggaatttcagaggcttgaactgacctacaaaacttgtaactgtagctctagttatacatccactgtggtcttggacatgtgaggtgtttgtctaccctcaggagttttagaagaagaaattttatggaattgctttccatattaagaaattaaaatagccaggtgctattttaattttacagattcacaactgtaatcccagcacttgggaggccgagcagggaggatagcttgagtccaggagtttgagtggagtggtcaacacagccgagaccccacatctacaaaaaatttaaacattagctggcatggtgactcatgcctatagtctcagctactcaggaggctgaggtgggaggatcgattgggcctgggacatcaaggctgccgtgagctgagattctgccactgggtgactgggcctgggacgtcaaggctgccgtgagctgagattgtgccactgggcgacagagcaagagtgtctcgaaggaaggaaggaaggaaaggaaggagggagagaaagaaagaaaaaaggaaagaaaatatacaaaaatctttgtgtagctctgaaataaatatatatatatgtatgcagtgtatatattatatgaaataaaattgcttgtgcttaatttattttaaaatcatgtttgaaaatagagctaattctcagttactacattttcccctctcctctttctgatggtttttttcttaactttttattgtaaatgattttaaacttatttaaaaagttgcaaaataagcatagtccaatatagccatatacttttactcagattcgtctattgttaacattttatcccattggatttatcatcctcccccttcctccctcccttcctctctttctctgtctacacacacacacacacacacacacacacacacacacacacagtctcccccaccccatatatatatatatattttttttttttccagaagtatttcagagtaggtcacttatatcattgcctctacccctaagtacagtgtgtatttcttaataataaaaaaaataaagatagtctcatcatattcacagtatggtaatcagcttctgtacatttgacactgattcaatacttcagtctactgtctgtacttctcctttgtcaggtggctcagttctgtccttgaagaaaactgctttttcccattcagtgtacagtccagcctaaggtcaggtagtgcatttagttgtcaagtctctttagtctcctttgatttggaacatttccacagcctttctttatcttttatggcattgacacttttgttctccccctttacaattatagtattcctcattttgtattagtcactggtttcttcatgttttgattcaattatgcattccctgaaggaatattacaaagataatgtgtccctctcagggatcacatctggagtcttatgtgtccatctatccgtcattggggatgttaattttgagcaactgatcaaggcattgtccagtttctccacagtataggtattctttcctttgcaattattaagctatccatggggagacactttattcttgctccttatcaaaatattaccctacattttttcctaaaccagcatttactatgattggtgcaaaattaggattccatgttactactctcttcacattcatcattcagcatcctgcgttctactgtatgcgggagccccttccttctcctccctccctcccgctctctctctctcttttcctctttcttttctttctttctctctttctttctttctttctttctttctttctttctttctttctttctttctttctttctttctgtctgctttctctttctttctttctctttctttctttctttttctttctttcttttctttttctctttctctctttcttttctttttctttcactctctctctctttctttcttctgtttcccctcccttccttcctcccttcccttcccttcccttcccttaccttgccttcccttcccttccctccccgtgcctgcggtccgggccccccctttttgtgggggccgcgggtcgggggcccgggcgggggggggggggggggggggggggggggggcgggggcgcggcgtgggcgtgcggggggggcggggggcgggggcgcgggtcgggggtgctggccggggggtgcgggcggggggcgggggtgggtggggcgtcgcgggggccggggggggcggcgcgggcgcgcggcggcggcgggggcgcgggcggtcttcgggggccgggggccccgcgggggggggcggtgccgcggtgggccgggggcggggcggcggggtggtggggggcgcgtgccgcggcgcgccggcggggggccgcggcgcgcgcgcgcccggcgggcggcgcgccgcggccggtggtgggtggcgctggcgggggcggcggcgtggggtccgcgcgcggcggctcggccgggccgtcggcggggcaaaaaaaagaaaaaaaaaaaaannnnnnnnnnnnnnnnnnnncgccccgagtagagaagatgcaaattatagtgcgagaacgtaggagtgagtagtgagaaaggaagcggactaaagaaattgtttcgtttcagctaattctcttatatttctttctttgtatcctcactcgttttctcgagttatttcgttggtgtataaatagaattgtcttgcgtttgagctatttttcatatgacgtagccatgtaagctaacatattctcatatcttacttgagacatcgctccatagtttcattatatatctcatcagtcttcttaaattgttatgtaaaataaggaagtaaaggaaaaaaagaggagccttcccgtgccctccccccctgccctcccccccgccctccccccttccctccccttttctttctctctctttctctctctctgtctttttctttctttctctctctctttctctctctctctttctctctattttcctctttctttctttcttttggttatggtcttcaagatttctgtttcaatctttcataattcattcttgctatataattattttggccctcaaattatcccagatttggtcagtgggagctgcatcaagttggctcctgtgtccttgagacatgtccccatcatctttgttgttagcaattgattaattgctggaataaaaagatgttctagtttggtcttgtatattctctgtcccagccatgaagtcaagcatgtcttcattatgtcctcactctttttatgtggagaaagatgttagagaccaatatctgagtgctaggtgtgctcattgctactctggtgccttaacttatagcctctttcaatgactggagctaggaaattttatatataaaaatatatatgtaaacaaaacctacgtgtatatgtttatctgtaaatatatgggtgcatatacaaatatgtatacacaaatactactactattaatttgctaataccacttactacacaaaacaaatctgtgaaaaagagttgaggatttgcttatggtgctcctccttcaacttaaccctgcccaagactgagggtatattgtcaaacgctcttcagggattacctggattagttctttcttcatgtgtctttcccctatatcccaatggtcattatgttcatttaaaatacagttgggttcaaatgcttcagtttgctttgagttttagtttccctccttcccatcctagtttgtttaattttattttttgaatatgtaaaacattaacatgcttccagaagccaaaactaaaccaaaagaagtgccagtctctcagatatttgctccaccttgttattccccacacctcttggaggttttcttggttatctctctggtatttctttttaatcctgatatatatatatatatatatatatatatatatatatatatatatacacacacacacacacatatatcagattatagcgtcagattatctgtgctttccctcctctcagtaaaacctgtaatgccccttcttccccaaacatatatatatatatatatatatatatatatatatatgtttttatatttcctcttctttcttacacaaaagatagcatgttgtatatcttcttttgcactctgatttcgtaaattttttttctttttttttgcactccctctcttcttttcttcttctctccctccctccctttcccccttcttccgtttttttttcctctctctctctcctgctcaaccaatttcctatgcttggacagttggatagttttctgcaatgaataacattatgcatatgtatttccatatcattggatatatttttgggatatattcttagaaatgggtatgctgggttaagagtaaatattttatgaggtactttagttaccaaatttttctctgatggaatgtcccactagcattcccaactacagatgtctgtgaagcttatgaattgttgccaatttgatggatgagaagtggtatctcagtatagttttgatttgcacgtgtcctattaggagtaaagttaagcatcttaatgtatttaatgtccatatgtattcattttgtgagttttttgtgagttacctgttcatgtcttttgcccattttaaaattttattttattttttttgggacagagtctctctctgttgcccaggctggagtgcagtggcacgatctcaactcactgcgatctccgcctcccaggttcaagtgattcccctgcctcaacctcccaagtagctgggattgcaggtgcatgtcaccataccaagctaattttttgtatttttcacggagatggggttttgccatgttggccaggctggtctcaaactcctaacctcaagtgatctgcccaccttggcctcccaaagtgctgtgattacaggcgtgagccactgtgctcagtcctttttttttttttttttaaattgggtttttggtctttttttctcaattagaaaggtcttcggaaattagatatattggcctttcatctatgaagtatattacacatatctctcccaatttgtttatcttttgactttgattacagtgttttattttcttttcagtcatataaaatttttatacttacagagacaaatttaagaatcatttcttttattgcttctggactttgttcgtagttagagagcatttcttaacacccgtgttatctgcatgttatcttccagtacctgtatagtttcatttttcacatttagatctttaattcatctgcagtttgtgtgtaacataatgaatggatctaattttacttttttccaaatggttatctggtgtctcaacaccatttagtatgaaaatatcttctcatacttcccgtgtgatttgagattggtggttactttttaacctacaccatgactaggtgtgaaggagaatgatggtaaacagtggaacagggtagttagaggaaaatgaggtcccaggtagataatgactgaaacccaataagaacatacatatttttgacttcaacacagagctctttaccttttacaagtcatcctctctggtccatttttgtcaaaaattaacgtatttaatagagaaggtgtttaaaacaaaaggagggtttagagattatctgtgctttccctcccctcagtaaaacctgtaatgccccttcttccccaaataaattatgagaatggggctgcataaattttctgtgagcatgtgtgactatgtttcctctggttcctcgccgcatggtaattactctgtgctctctcctgcaaactgcccatgtttcactgcttgtaggtcaaagctgtattgagtaagaagtgaatttgggaagttttgcaagtaaagtgctacctgagtcagtgactgtgtcttaattcacctttttgcttccaggttcttgctcagggccatctgtgcacatggttttcactcaataagtgcctcatgaattttaatgactacacattaaactaaaacaaggtctgcccacctattcttaagaaattaaactctacaaatgatgtattccaaaactgcaaaagagagtgaaagccaaaacagatgaagctgtccttatatgggcaggaaaaactcagtaagattttatcagttcagtaggtgttgcatatggtgatttggaactgtctgccagttccaagatggccttactttattgtatggtcagtacagtttgtatctagtcctcatcaggttaggcctggaactccccaacccctgttaaaaacagcaaatcagggtttctgtggtggaatggggaggaaactggcttgcattaattgatgtataaggtagcccatgataaactcaatgccacttttatacacatctgggagcaagagcttttggttaattggcttgcctatgtttttgctctgccttggatgctacagaaatggaattgtttgttagagtcgttgcatggtgaaggaaaaatcagagccaaggttttgaaggacctaagggagaacattctgtgttctgcaggcatcttcctccttgggacacaaacagctccctgcctaccacacacagtggataggattccttcaatgcctctcctcgggtgaaagatgtggcatgtggaactgaacgatcaaaatcactggggcaactgtatgggcgccctcctgcagtgtaacatcctaacaggacttttgacaggaatggatacctaaatatttacactcctggaggcctcgtctgtctcaaccatacttaccagtcaccacagtgtctcctttctctgtgtagtactggataaatacagataaattctacaccctgacttactcctacctcatgcaaggaagttataaaatgtttgagtagcttacttaagtattactcctgccatggcttcttgacatgccttgatggagctgtggaaagcatcttggttgcttcaacacaaggctgtgagttgtttcatagggcagggtactaactatagtttgctgaccttatccactgtgtggattcatcttgggaaaggagcagagaaggtactgagaataccacatctgctgaagactctgctggatgctttctccagacatctcatacagtcttttcaacacccactcaagatataggagctgttccatttcacagacgaggaaacggaggctcagagactttgcattagtctaccaggtcataaagctagtgttcacagaactgagactcaaaaccaggtctgtatacccatgaaattggtgcttttcctctatgcctgacacatgacacatcatatcaaggcatcaccttttcttgaatcttattcatagattctgggcaagcagcctcagcttggtcctatgaaacctttcctgacctcctccacacaccccctacacacactctgtgaacattgtaatggttagttgtatacacagttgtttccagtgctggactgtgagttcttctggatgtcttcctatagtgtttaattcatagctggcttttgatacgtatgtaatgaaaattctggttttctgcaccatactgtgtttccatgctgacactaaaaatctagacatgctttcttagaattaggcaacccatttacctttaaggatgcactgactttggtttttgccttaatatttggccaaaacctgctctttgagttcgacctctgctttgcctttaggagggtaaagtagccaaatacctacctcattaacattgtaggcaactctgaaattttgcaggataatcattgcattgatgcgaacatcacactggttaccgtcataccgtatcagcataaaaatgttggcaatgaatacgtatatttttcaaatttgttgttaataaccagatatgtacttttaaatatagtgagcattttacttataacttggaatggaaaaccttcttaaactactttgtacgctgagactccaccaactaattgaaatataaaggaatatattatattaagagtaagatgctacaatatttaatgatgactgtgaaagctaataatgtatgggttaaataattaagaactttcaaatagttaaacaagtagggaaattagttggtaattaatataaaaattagattaattaaaccttagttaatgaatattagctaattgaggttattaaatcttagttattacagtttgttagctagataactttgggttgaccaacacatcttttttcagctaacaagcatttataaaaatataaattgtaatctaagtattgttatagaactagattatacaataattataattgttactgggttgtttgtggaatgcatttatgacaccaaacagaatgaccattaagaaccatttttaacttttagttatttaattacacttaaggtcatcagtctttcaagaaaaagcctatttaagattttttttcacattttctgaagataaattaaaagtagagtgtctacactgtctctcaacatttcctgatcaggaaaacctcccaaattacgtatagcaacatcaatgataaatgatttttaacacagagaaatttcatgtgtattcttatatcacaaaaattcagacgatgataatgagagatttcagtctcagctttggcttactattgattttaacattcagtcatttggcacttggcccaagtgggtaatgggtgcatatctatcagtggctcttcatacatttgtgcagggaggtacacatgcatacgtgtgggtgtttcaaagtctaactggaataggcctctcacatttatctcctattaatttgcagattgtttccatggtcaccatccagaaatttcccagtaatccttgaggaagttagggagtgtgataccattagggagagggaatatgtggcatagagacgtgatgggcattagttgtctgaggttatgaggtcgtggtgaagcctgatcatgtgaccccatctccatactctatgtccagtgctccagatcccatagacctgaatcttagttctggtgctagaactgtccctgatgcacatatagtaagactttaatttccattttccctgtcttatgaaaagaagtgttgataagctcattaattagctttctgctcatagcttttttctgactgctaatgacttcttgaggatgggcaggctttgatgagctgtgtggtcctgggaaagccttggtgtcctcttttacctgcacagtgagggtgacggtcgtgttacctcctgaggccacctttcagctttgccattctgtcatttgacaaagactgaatagagaaaagacaagatttaacgacagttaaagtccaagccagtttgtatttgctgaaagacacaactgagggaaaggaactgacatgtagtttaaacagactggttttttgttgacatgggaagtgtgaataatacttcttcctggtttatgagatatgaaattggttgtctaccttatctgtttctcacttttgttctcagttcatagtttggtcatggaatgcaattttgaagacaacttcaagttgtttttttgctcagtaatcatagtagtatttactgttgttcactgggcacccagtctgtgtacacacatcattcctaatcttagaagaaaaacaacgtgcaagacatgtgttttctttcccactttgcaaataaggaactggggctcaaagagattaaaagacttacttaagttcaattagaaagtggcagagccaggattcaaatgttggtttgcctaactgcaaagcctatatccaccttccacccagtgctgctacagcattaaagcctgtaaattgaattccacacactcctactttcacctgtactattacagtgataagtaaaaccagcgctgagccctactaacaaggtgtccttgatttgtgtgctgatgctcatgacacttctgtgtggcatctgctgacaggcccacggggcccagatgttcccactacaaagagctcatcctggactccccaaccagggaaagagacctgaaaaggaactggtttgtgattagggattattgtgatacttgaagtgaatggtcagtcagttcttcccatttatttgagttcttacttcccttccctttgaacatttcagtcaaacttctaacagtgactttcaacactggctgcgcattaaaatcacttggggaggttttgttttgttttgttttgagacagcgtctccctctgtcatccaggctggaatgcagtggcatgattatggttcactgtagctgcaaccttctaggctcaatcaaccctcctacttcagccttgtgagtagctgggaatacagggacacgccactacgcctggctaattcgtatattttgtagagacagggtttcactatgttgcctaggctggtctcgaactcctgggcacaagtgattctcccaccttggcctcccaaagtgctggaatcatggagctttttgtttgtaagcatgtcagccctcaccttccagagatcttgatttgaatgggctaggttggggttctcgctattagcgcaaaaaaaagtaagtactgcagggattctaagattcgtctagagaagacgatcaccgcattagggggcagaaagtccacttttcattattttgttggtacagtatactttttttctgactctatgaaccctcaatcttatgatgttaccattccattgaagggtgggatttattcactgagaacatttatatttttttgagatgtcttaggctgtggagagggtgttacagggatggacacagatgctgaatttagtggccccagagaagaggaattaaccactttggattggattattgggagcaaccaaaagtcagtgctgtggcttttgctgtcttcccttgtaatctcttcccctcaccagattttcaacacagaaggggtgtattttctagttatggggtattcacaatcacatctaataattttactccagaacatactatggcttgtttatactagcttgaatatttgtagtctctttgatttttgtttgctaatttaatttactattgcatataaaagaatggcttccatggagataatcaccgtggctcccagagtgcatccagagacatttgccttgcttctgtggaaatacacccaaattccccagcatgacattgagtgttcaccccacacctgacaccagtctctcttgctctaattaaggccactctttaccattcttgggcaccagccagatgaactataccctggtgtgggatctgcccgatcctgctgagacattaactctgtcctgaagctgtttgtccttccagcagctagaaataatctttcctttcctagaacttccacactgcattgagcaggaacacttgtagaacttctcacattgtacctcaaggtattcttatttatgcatgtatataatttctccccttctactactgtaagcttctgcagggtggggcagcctcttcttaattttgatatctactgctgtgccaagaatattgtaggcatttcctaaattatttttcccccagtgtatgtgttactttgttcaattcagcagttgtccaaagctaatctcttgagctattggtagctttggtgaacatttggagaggactactgtgatggcgtaaaatccggtgacctagttacagaatatcccctgcaggctcactggtaaggaaggctcatgtttaaactcagtgaaaggagagcctggcttatttatggtggtggttgtttacatgtctttaaatgaccttcttttttttttaatataaaggcaatatattctcatagaaaattcagaaactgtaaacagggttaaagaagaaaataaaaatcaacactatcactttcacctatttattattcttattttatttatttatttatttatttttaaggcagagtctctttctgtcacccaggcagtggcacgatctcggctgactgcaacccctgcctcccaggttcaagcgattctcctgccttagcctcccaagtagctaggattacaggcatgcaccaccaccaagtccggctaatttttgtatttttggtagagacagggtttcaccatgttggccagactggtcttgaactcttgacctcaagtgatccgcctgccttggcctcacaaagtgctgggattagaggcgtgagccactgtgcctggccacttccacctattattaatgaaacctgtcctatttaacaaaaacgataatgtggggtgtcttgtgcttggagcttggagaaaggaatttgcctctgtttttttaatgacttatggcaaggccagtatgaccagtaagtgggctgtttattattattattattattaatcaccattgtcactgatagaaattgtcactattgtcactgatagaaaccaagatagaaattgtcactattgctatagccccaagaaggacctcatggctgcataacgattgagcaccttatatttacacaatgcttggttgttgttttttaaggcaactgtgactcaacaacagctgtttgagaacagctccatcccagatgaaatcagaggaaccgaagtttaaaaagaaagtgtttctgggctgggcgcggtggttcacgcctgtaatcccagcactttgggaggctgaggcgggcagatggtttgaggtcaggagtttgagagcagcctgaccaacttggtgaaaccctgtctctactaaaaatacaaaaaaattagcagggcgtggtggtgcatgcctgtagtcccagctactcaggaggctgagtcaggagaatcccgtagtcccagctactcaggaggctgtcaggagaatcccttgaacccgggaggcggaggttgcagtgagctgagatagtgtcactgcactccagcctgggccacagagcgagactccatgttaaaaaaagaaatgtttctgagcactaaagacaatttgaacaaggcagaaaagtacaaataggaaaacaataatcttactagattgtttgtttttgagacagcatctccctttgtcatccaggctggaatgcagcagcacgattatggctcactgtagctgcgaacttctgggctcaatcaaccctcccacctcagccttctaagtagctgggactattctgtagtgataatccttgttaaagttttggaaaataccttttttagagtctctctttctctctacacagacacacacacacacatacacacatgcaacttttatgtgaatgacggcatttacaatttacgtaaattactgcaggtgctatcatttatttttttcactcagcaatatgccttgaaaaaattttaagtcaatcaacatacagatatttgtcatcttttaaatagctatagattttctctcagacttaaagtctaatttttaaagaagtgactgttatatttaaatcatatatagcttcatgatgaaaaaaggaaaaacaattcttgggaccggacatggtggctcatgcctgtaattccagcagtttgggagaccaaggtaggagaattgcttgaggtcaaaggtttgagaccagcctgggcaacacagtgagaccctgtctctccaaaaaaaaaaaaatatatattagctagatgtggtggcacatatctgtagtcctacccactcaggaggctgaggaggtgggaggatcgcttgaacccaggagtttaaggctgcagtgagctagaacggtgccattgcacttcagcttgggtcacagagtgcaactctgtctataaaacaaagacaaaagcaccacagttcgttagatataactgaatattatcttcatttcctactgtagtggttcttagaaaggttgtttcttaagttagaaactgttgcctaagtatttaggatgtggcaggcactgtgctacatgctggggttgacgaatgcatgggattcggctctctcccaggctggtgggaagaggacacatctagaagccagggtatataccccgaaggggtttgaggcagtgcagagttgatgatgatggtctccagcctgcctttcctttacaaaaatgaggagactgcatctcacattgccaacgagctgcttgactctaccgatattccctaccaagcacgattatgggtagtcttaaaattcttaataataaaatagatattgaaaatagtgtttttttttttaacagtgaaagtaatatgtactcatgtataggttttcaatatacaggaaactataaaatgaaaaggattgtacctgtaatcccaccccttacagctaactactgtgacattttatttgtagaagtccattttgctatcagacctcaagttttaaaatcttaactcaccctctgtaacctagttctcagctctattttatgtaacgtttttaaaggattcaagatttaaaataaacttatctcaccccaaatgcacttgtatatttttgacaccccctcatctctctctctctcttgtctctctctcttctctgtctctcactctatctcagttctctttctcctcttctttctctctctcctctctcctctctctctctttctctctctgtctcacacacacacacggggaaaaaaaatcactcgagttaagaatcagtctctcattttacagataggaaaactgaaatctagaacttgtctgaaatcatgttaaaaaaaaaaaagtggtaatctgtgctcgaacccaggtctcctgaattttcgttcagtgctttttccattctacagtgatgcctccttactaggtcatagaaacagtggcagagggagaaaaggaaaaatacgtcagctccaaagagtgcagtttttttttttctgtgtcctttagctgagctatttttgtgactattcagtacatgtacaatgctgcctcttggagtgttccggctagactaagaggccattcactgctgactgcagccatgccatccctccatggaatcctcggcccggaaatcagatgggaacaaactattccaatatacaaatcaaatttcagagtctgagtgtacacagaaaaattactggatatcctgttggactatgtacataacaatgacacagtgatttatgagggtatgatggggcagagggtagcgggtgatgttggagttgattcatcacttaagcgctaatccattcaccagctccagtcagacttcaacacaaatgccaaattattcatcttccctaaatccaaccctattattttctctctcaaaaccttcagttgcttccttttgcatatggaagagagcgtggactcctccatctggcatttaaggctttctatgatctgtcctcccagacattgataggctgtggagatacagtaaggtagttgttatgagccacaccttgcagccaggctgctccagcaccaagcaacactttccccgggaggttgctgcacctccctgctcctcactttcctcatttgtggaataggaatagggtcattgtgagaattaaataagttaatatttgtaaagggtttaacagtgactagctcataatccgtcacgtagaaagttttttcttagctcatttaataagtacctttctaacccatcactgatagcatttttcttttgcaccagacttctttctagtcattgctgggagcgtcctctcattttcctgcctccctgtagctgtcactctcactcctaaactgttggcgttctcattttggcttgcccaaatcttacgcattcttttaagtccatgttcaagtgaatcctcactgattttgttcttcattcatccccttaacagacttttatggagggtctactgtgtgcaaggtgtattatgtaggaagccttccacagttcccagagctaggtgagctctgtcatgtaggcctgtcttgtacatatcaccttcgacattgctgagcagtttgtgttggacatgtttgatctcctcccctagaatataaacagctggagagtaggatgcttattagtaggtgcttattaagctttctttaaaatgagtaagtgcacatgctaccttttatagatctgttaccttctaatgaaggcaagaacaataggaacaaacattagttttgtgtgtgtgtgtgagagagagagagacagagagggagagagaaagagagagagagattttgaatgggaataattatgaggccacatctgagggcaaataaccacttccaagttgaagaaaggcaaggagaagacaggaatgagaggagagctgtagcagtcaaaggaaacgggatgagaatatgttattctctgaatcataaagcatttgctctgagaaatgtttttccttaagtggtataaaatgtaaaatgaattgggtcttagtttttcttttcctctttaggaggttggagctgatttttaaaatgaggtaggggagggaggtggggtttggagaaagaaagtgaaaattgttttctgaaactctgtttgtcaaataactctctggagagaaagttcagagggtgagggcctgccaaagctgaccagcagcacacaggccaaatcgttctttcgtcattgtcctggtcacttccccacccctgttcgccacccccaaacaccttttttcttctctctctctctctctgtgtgtgtctctctctctttcttttctttccttttttttctttttataacatatgaatattataagtaagtagctggagaaaataaaaaagcaaaacaaaacacaaagtaagcagatgatttcaacctgcaattatttgtcaggtcataaaaatgatgtgtcttagatttatttacctgatctcctcatctgttttccactggaagccttctgctcgcgtcacccttcttcatttagttccccaaacttccacccactttctgactcaaagcaggagagaagcattgaacaaaaccactggatttggagaagagagaaaagcagcttttaagaactgactttagaggtttagcacgaattaaattcctggtcttttctttctgcagatttttcagctattgttgttgtttgttttgttttgttttgttttatgtttcttgagtttatcgctaaagatgcttttccgtggatggcacaaaagttcagctatggccatgtgcttactgaaggcctgtatatggaggcatcacagtggctggccttgaagaaattaagatagtgaaagaggacccctgtctgcgaagaaagagctcatgtttgtgtgtgtgctcatgctttgggtgctacaaggagactggtgtctggggaagggaggaagggtgatggttacaggtataggtaaataagttttccaacagttaacaatacttggagacaagctacagagtgatcaatgctagagttaggaacgctgtgagaaggcaaggtgttctgtttgtgccattggggagggctttgctgtggggattgggggaaggatattgttttaggctttgctagatggctaggactttaacaaataagaaagaaagagctgagtctttaagacagagggaatagcagagacatgaaaatatctagagagattgggagtgggaggctgagtctggaggtgagatatctgtatccaatcagagaagtttcctatgccttcctgtaatgttggaggcttcttttttttttggtaatcagtaaggagctgtcatgggctttgtaaaagggctgtgataggattactctggtgtgtgtgtgtgtgtgtgtgtgtgtgtgtgtgtgtgtatgtgttctgcttttactttatacatttcagagtctttttaggaactcttaggcaaccttaactctggggagtgtgnnnnnnnnnnnnnnnnnnnnttttaaagctctatagtactctggtgtgtgtgtgtgtgtgagcgtgtgtgtgtgtgtatgtgttttgcttttactttatacatttcagagtctttttaggaactcttaggcaaccttaactctggggagtgtgcattgcctgtctttatatgtctttacttctctgttgctgcctggttctgctccttctcatgcttctgtaacaaagtgcggcaatgcaggcttctagaaggtgatgtgagatctctgagcagaccatgtgtgtgttcttcccatccttttttcccctccctttctcttcctcctcctctttctatatcaccaccctcaccagcagcagcagcagcactcccctccctaaaataaataaaccagtcactccaaaggttccaagcacattagtcacatatcccagaagtttaatacagaattattttgacagcgagaacaagaagtgttttctagttgaacgcacagaacttgcttattccaactgggctttctgccgcacagacagatgatacgttttttagatggattggccgcacagcgcaggagactgtcgcttcccttggatacacagcaaactgctcactaccaaaagtggctggggagaagatgtgaaaggagagagagagagcgcgagagagacagaagagaagaggagaggggaggggaggggaggagaggagagacggggaagacagagagagagagagagagagaaaggaaatcaagttcttattatgtacataactttctcattaatggcttccataagtcactgagagatttctttgtgtttatttatttatttggctgctttggagccatgagtccttttttaaacccgggtttatgtctgttctaaaaaatgaggacagatcgagttattgccatgcgggtggctctccaagcattccagttgcatagctcttccagaaatatttcttgacgcacttatttagcactttctattgccgttactgagcagattacagaatcctcccggccctttcaccaaacccgtctagagctggtatggatctacttgtgcctatctggcagatagaaagatagaggaatgggaaggtgaagtccattgttactcatgaaggattttgaccagtaacctcagaagagtcagaagaagagaaaaagcatgtgctctcctctttcctgctttgcttttctgcttccaagtccctcctccaagcaggaagatctttcctgagcagcagcgtacctgggtgtgagaacccagagggagtgtggtggagagacgtgaaggggtcagttcctggaacattctgttccctctagctcccatgatcattgacttcttgcctctcaagtccttctagggatctccaggcttttgagaggctcagctgacctcgctcactgctgtgcatgctctctggagctttcttgtcctcttttggttgtttcttactagcccctcattcccaggactttttctgaggaatctctgttagttcaggtaataactggctgtgaaacctacaatagtaagttctttggatgtcggtgttttcagatgtttcttcttcatggaaactctttataaatccctcacaaaatgggatgtcaaatctcaatatgtaaaataatcaaagtgcagttaaatggtggtgctgttgttaaaaggtggaagatctcataggcttctagccagggccgagttatctccccagaagagctctgtgcctctgtggacccacttagtaagccattgtactggagttgctttaaggctccctacagccctgatgacctgtgctcagcattctttcagctttctgcctctttgtatatctttcaagcttgagaaagatcctctatagatcaggaagatgtgtccagtaagagatttgacctttgctggtttcttgacatgggctttgatgaaacccttttagcatgctcactttagatgattcttctcaagggggatgtcagccccaggaccccccagacctccatccctaaacccgggcttgcgtgtctggcaacccagggccagcacttcgttcttacactcagctgagtggtagtcctgccaccattgctgtggctctgggactatagcctctgccttaggaacacttatgagaggaatcgatggaattccaactatttttaaggattttttttttttttttttttttgctgagtttgcattgcaaaaggaaggtagagcacgggccatctctccctcctccacttatatttattctgcacctacctgcacgtgacactctgctattcttcagagaaggttctgacctttgtgaccacgctttacattttcacattgcaaggcaatttctaaagagcttttcccagctaagatctcatttgagcctcacaacaactctggggcaaaggagactgtaaaacaaacaaaaacaaaaacaaaaaaaacaaaaacacaaaaccaaaacaaaaaacaacccccaaaaaccttagacaaatctaattccacagtttaattaagcaaagaacaattcgtgaattgggcaggccccaaaccagataatctggcactgccatttggttgaagaacatttgtggacagaacaaagaaggtgacggacagaaaacacaagtgaggtacagaaacagctggactggttacagcttggtgttttccttatttgaataggtttgaacagttggctgtctttgattggctgaaactctgtgaatggtacaagagtaggttgcatcctgtttacacatcctgttaggacggaggaggcagctttaggctaaacgtaatttaacaagattcaatgagattatacctgtacgcccaagttcacagttaggtagagaaggattgtggggatttgaagcttaggcttactgacttacgccattgtgccatatcattcattctcctcgtggcaggaataatgaatgaatattctattaacaggtactacctattaaccgcttacatatatttcaaatgttactaggtagatactttttacaggcctatttcatcttctcaacaaccctataaggtagaaattattatgtccagtttgttgatgaatggctagaaatatagagaagataaataacttgctcaaggttatacttcacagaattgatggacctcgaattctaattaagattgctgcctccaggggtctatcagtataggatgtgatctttacccatcctgagtcctaggagatataaaacatgctgttgaaataacaaagctggtttgtgggtgatcatatactatagtaaatacgacatactgttaagggttaataggtggctgttttctgtgtttgttcctggagatcgtaatatctttatgctgttccttctacttcctttttcaattttatgagctccatgttgaaattatgagtccttaaccctattgaactgtgtgccattgggcaagttgtttctatttctggggtattgatttccccgtctcaaaataaatatcttttcctgctccgatcattctttccttttaagtattacctggctggtgaatgtttatattgaattctctttgtacaattcctttcaacaatattgcttggaattataaaaacttaataattgttttaaattgaaatgacaattgcaggttatccttgctttcaaaaagattttgtttctgaaatgtagcttgttaaaagtttggaaataaagcatcacatgaagaaataaagttatatcaagaaagatgcctaacacatgttctgattggctagctggttgtgcctttttttttatgtgtgtgtgtgtgtgtgtgtgtgtgtgtgtgtgtcactctgtctcccaggctggagtgcagtggtgcgatctcggctcactgcaacctccgcctcctgggttcaagcgattttcctgcctcaggcttcccagtagctggtactacaggcgcgtgccaccacgccctaatttttgtatttttagtagagacgaggtttcaccatgttggccaggctggtcttgaattcctgacctcaagtgatccacccaccttggcctcccaaagtgctgggattacaggtgggagccactacacctggccgtgccttgttttttagtatcagttttttcttttcttttcttttcttatcgtttcttttcttttcttttctttagggtatgattctatttatttgaagttccagaaaaagcaaaactaatctgtggtaatagaaaatcagagtatagtggttgttcgcaggaaagaggtggtatgagattgcctgagaataggcaaaagagaacttttcagagtgacaaaagtattctgcatctttgataggagcacggattacttagatgctttcctttttctcaactggcctaagtttctttttctttctaatgcttgtataagaacaaccttcgttcccaaacacacagacgtgtgtgtgtggacacacacacacacacaaacaattcttcagaaagaaagcctcttacgtgtgttaaacttgccacttttttctcaaaatgtgctttgtatttctttgggtgagcaaaagaagaatcttcctcttctcaagttcagagtttgaatcaattcttcctgtcttttgcatttcagtaaatgtttcctagatggattcatcggttttccagtaaagacaaacagctcagaagccagattacattcatacccaaggcctgagttctgtgacccaggcatcagagctcagtgccatatatggcgaaaagaggaacaggagcaggagtggagggagaatgccagacatgcaatgcattcctcagaaatgtgcattcataactggcaaaacaggacccttgctggtttccatcttatgcagaacatgaactgtgaagttttgagaaagaagctaatgttccaagcatctgccacagggaacagtttattttcccttttctttttggtcacatgtcggtttaatttggagtcagtgtttaagtcaatgctggcatggggtgaagactaagaaattgttcttgcagtcagcagacatgggttctcagcccaactccactgccacccagctgcaaaactctccttggcttgtttttaatcaatggcaaagtagcagggttgaatttgatgatcttcgagatttctactatttctgttttctttggttctaattttgcccgagattttccagttcctgtggaattccccagtgaaagcattttctaattcttccaaatactttttgtggcttgaacttaaaaagacaaaaacaaaaatcccagtcttgaatttttctttgtgatttcctgaagtatgttttggatgcattatgaatcttcaattgacagattatttcttgctcggggtagagaagaatgcatttcctgcatcttcatggtcttctttcacttgcccctcttattgttggagaagaaatgtaggtatgttcaacacatagttgcagggacagctgtgcactaagcaaatgcagacttttaatgaccttgatagttgtctgcttctctcatgcattgaagccttttctgtggaagaagtgggagcagcagaaggcagattccacagcttcctcacacctcaagagacggaattagggatgtgagactgaggtgttggtttcccagtcagtaatcggatgagacactttgctgtcacagatgttaagaaggttaacaagaaatagaattgtaaaactctggccctaaggtggactacggtcactttcactttgagataaggcatgattttaaatgctcctattggtctttatgggttctgtagtctattttcaacagactaaaattgtcttgttgcaaaagtttgcaattttctgcttctttgggagagggttcaaaccaaagttgacctcttccctttctcttctgaaaggatgacgttagtttctcagctgaaataaaggaaggaggaagtttccattgggtcttaggaaaatattccagcattgggctttaatggcagctgatgtcccaaacttgtgcacaatggctccgagaaggccatagtggtttaggaggcacccataatagtcccttttattcatgctgagaatgaagaaccaggggcaacactaaagaaacctgcacttggcttttccttgctgcttgtggtccctttcctggaagctgctataacacagccaccaagtcctgggaggaagagaaggaggggattaattcttatgatgcagggggatggctccagagagagtggaagcaaagacatctgtgttctgatgacagctgtgccacgagtttgctctgtgacttggtcaagatgctttgcaatttgaggccttcatttctccgtctggcaagtggacatgctagtggaccttgaaggcctcttctagctcttaaaagcatgaatttaatatatttccagattgtctgtttatgtttcctattgcatgtacttggtatgcccggtgacactgagctcatcaacttgtaaaaagaccgtgccattatcttctttaacggcaaacagaacaaaaacagaatcctctttgtgggtgcctgctcaccgtaatattaggaccaaattcttttgtgtaacattcacctcctttcccagtctagttccacctaacggttctagtttttgggaagcgtttgcttccatgtgtgacattcatctttactttgagctctctgtgagccttttgctactgcagaggtatgtgtctgttgaaagagaggaagctgtacacgatgacacggcagagtcattgggtcaggagtggtgttgagaagaatgaatcaggatgctggggttctgtgatagactctacaaatagtttacaagaagatttagggacagtaagcacaatacatcttttgcttcagtcaaaagcataaattttaatggttacaaatgcctggtgctattatgagaaaaccacaggaaagaccattatataaacagtaataatttgttgactatgactaatcctttggggagtatgatatgtgacataggcgtataagggctttatgtagactaacccctttaacacctattaacttgttagaccctgctaatgggtccacgagggtggcaggctaaggaatgctaccctctatttactaacgagcaaagcgatgctgaaatacagtgaagaagctgtccagtgtcacatggtgaagagatggcataacagagactcgttcagtgcttttatgcctgcgtcgtgttttctgcctttccaggcttcagcctacccagtaaagcaggataaaaacacacaataactgcccccaccacccacagccagaagatggtagaggatgggattgaattagtcatgaatcatgtgaaccatagtatttggtgaatcagtcttggtaattggtggggtgatatgtcagtcagtttactttcacaactgaattatcaactagggcaccacgatggaaaacagaattgaggatttctactttcttattattcatttgtacgtgtgtactttcacttatttaaggcaatgaagaactaataatacctaatatggtgccaggctttgtagtaggtgctgacctgtagaagtgaaccataaaccctaagccaagggctataaaatactttaaaattcatgtagaatcctctctcaatcttacccccctttcatttttcagtgtgttctctgatacttttgtacttttgccaggtgataagtccaccttgacttggctattttatatcttttttttttttttttttttttttgagacggagtttcactcttgttgcccaggctggagttcaatggcacgatctcggcttactgcaacctccacctcctgggttcaagcgattctcgtgcctcagcctccctagtagctggggttacaggtgcacgccaccacacccagttattttttgtatttttagtagagatggggtttcaccatgttggccagactggtctcaaactcttgacctcaggtgatccacctgcctcggcctcccaaagtgctggattacaagtgtgagccaccatgtctggccgtctattttatatcttatagtaaaggatggttgcctcaaaggctgtaaacgtcaatgtttagagatatatatgaaattatttgtaacttccttcaatagtaactttcaaatgccacccttacatggctttatgaaaagtaaacccttctcttaaatgtctgcttttttcttagagtaagtttcttgtgttggctttcttttctctcttctctttatcagtgaattcatttattctaaatttttttctgatgtagtttgggacttcctaacttaacaatggaaattgaaaattggagaagctcattctgtattctttcctttttattccatttttgatactggattatgtctgtataattgctcaaattgtgagtcatgtaggaacatgctctgtgtttctgcacatgatatttaaaacctatttatgctttcttaaccacaaaggggaccataaaagtcctgtcaaatagtcccagactgtaaattccttgaggtcaagagctgtgtcaaatttatttttgtacctctttctgctacagctcccagcccctagcccagtgccaggtagctctggcaaatgagagtgggattgaattggatttctcgttctgaccactctcttggtgcctttatcaacttgtccaccccattgggaggaggggcatggacctgtcaagtgtgatgaattggtagatcatggagttttccatcctccactagaactttagctgtgtttagacttcagaatgctgagtaactaataaaaaacgattccaaagcactctgcagatagaaagtgcttcatgtgtaataaataataatagcctcttaagattaggcacagccacacaaagaagtgccagtcttgcaggccgcaagaattcctgatagaccttatggttagagtggattggttgagactgacccttgtcactgttttgtaataagcagtttcacctccaagttaccacgtattttccattatgggaaaagggtagtttctgaactatctaggaattaatccttccaattatcgttaggagtctgactgaaggaacaccatgaaaattgacagtcaagctttctaggtaagcctaattcagtgcttaaatttagttctaaatcctgtccccttctccaactgttatttctttaaaggaatcagcagtcacctctattttagttctacagcatgtggtggtcttaagaggtggaaactggcaccttttcccaaaggagagactggaatggccagagcccatcctgactttgggtcatcactttcagattaaaacataactgtacagagtacatttcccttgattctctgtttccacagagaggcttttctgctttagggtttcattgatgggatgacttcttttcctttgtcctagagtgcgggtcaatctaattcaagtttggtgaataaatggagccataaactgtgttacccactttatttatttatttatttacaaatgaggtctcccctccctctgttgcccagcctggagtacagtggtgtgatcatagctcatctcagcctggaactcctgggctcaagcaattctgccgtatcagtcccctgagtagctgggacggtgggtgtgcaccactgtgcctggctctccaccttattaaagtgagttaagagaagcataaacagtgttttgctattcttcttggtaactttaaatgatgctttcttctcagcaatgatggtccagtctaactgggcatcattcatttagctattatttattgagcacctgctgtattccaggaacttttttttttctttgaaacctagtctctgttgcccagactggagtgcaatggcaccatctcggctcactgcaacctccacttcccaggttcaagcgattctcctgcctcagcctcctgagtagctgggattacaggcacgtgccaccacacctggctaatttttttgtttttagtagacatggggtttcaccatattgtccaggctgatctcgaactcctgaccccgtgatcctcctgcctcagcctcccaaagtgctgggattacaggcatgaggtaccgcgcccagcctccaggaacttttctaggtgctgctggtcagtgaagaaaacaaagcctgctgtagttaccatttgaaagactgaacagaagtgtgactttaaaaaatgatttggcaaaagtatgctttaaataaataaacacagcaaacaaaaaacacaacagctctttcattctgtcctttcctctattctttctcttgtctcccatttttgtcctgtgtgtaacctgactccacaccttttattctctcactctgcttatcaacacagccatacttgcttctcaggctcttctgtgtctctttgttgtgtctgctgtgcttcatcatgtggcgatgaagtagatgaaggttgttggtggccggaccccaacttcgtattccttcttagctagttccttgattgatctccagacatggagtggcaggtaggtgctcttgttgtaagtcacagaacctggaggaaagagtggttcgtggccctggggcctctgggggctgatgcttggatatttgtttagatatttgtttggatatttgtccccgtccaaatctcatgttgaattctaatcctcagtgctggaggtggagtctggtgggaggtgttggggcggatccctcatgacttggtgatgtctttgtgatagtgaattcttgtgaaatcttgtcatttaaaagtgtgtggcacctcccaccctccaactctgtctctctctctctctctctctctctctctctgtctgtcctcctctcctgctgttgccatgtgaagtgcctcctcccttttgtcttctgccacgttgggaagcttcctgagcctccacagaaggagatgctgctatgtttcctctatagcctgtagaactgtgagccaataattcaacaactcaaccacttcttttcttttttttttttttttttttttttttttggagagacaggtcttactctgatgcccaggctggagtatagtggcatgatcttagctgactgcaacctctgcttcctgggttcaagtgattctcctgcctcaggctcctgagtggctggacttataggcacgtaccaccatgctcagctaatttttgcatttttagtagagatggggttttgcccctttggccaggctggtctcgaactcctgacctcaagtgatccacccgcctccacctcacaacgtgctgggattacaggcatgagccacctcacctggccaacctcttttcttttaaattacccaatctcgggtatttctttatagcagggcaagaatggtttaatacaggggcccatccagcagcactgcattaccaggattctgctgaagaaatggacgtggccccaaaagccatagcctggctgccaggtgccccagagtattgtcaactcagaggaacatctctcaggaaatattccttgattctctcttctctattagttttttaaatgcttctatcccagaggaggtgctcagtaaattttagtttctttccttttccggaaagtctcatgactctttatctgagtttgacttaagagaacttacttaataataattaataataaagaataaaacctgctaataataagatttaatagaactttctgtttaattccatggttattatacctatttcttaatctctctaagagacatggactgtgttaaagtgtgtttatgaactggtggtcgagggtgcatttccctcctaagaaaactcattccttgttttgggataaggttcttggagctacatttaacactcagtcctagacttcagtggctcaaatgccgagacatgacctccatattgaccacacggttgatcatgctgaccacagatttctgctaaagcttgaggtgcctgaccatccctggctattgtcattcgccctaaactagctgtttgggaatggggccagtgatgaccctttagtagagataaggcagagcttgtggaggaaaaatcatttcttctccattcccatgatttagccctctgacttcatgcatttctttttgccctttttcttgtgctggattttaacccccagcctctctttcgatcatgataatttgcatttattacacacgtactatgttccaggcactgggtaaattgctttctattgttcatttcatttaatcctcaaagccagcctatgcagtagatactagtgatccatattggatggatgaggtatggatggattagaaaggtttatgtagcttacccaatgtggcacaacttgtaatggcagggtcagacttagaaactaaatctctccaatactagcttttgattttatttttaccctactcacccctgatattcgtcccctggccttttctgcttacctggcttggagcaagtcctcatctgccaaagactatgtaggtggttggaaggagtgctctgtcctcacctcttcctcccatggcacctgcagccagagacctgctgtgtgtgctatatactcttctgacctctctgattctgaatcgactctcaaggctgaattggctgacatgcatcttctagtggattcattgtttttcatggtttacttggtttatgacaagctagggacagcttgacatttgctttcccgtcagtggtctggggacgtgcacagagctgcttgtttcagatctcctctcggtgtttctctacacttagtgaagactatataaccatggctctattataatacaatacgttataataagatctaggggcattctcgagaacttgggagcaatctaagaaaggagagtgaggttggagagaggcgtgtcctttgcatcttctggtagatgatggtggaggctgtgtaataacatgccaaagcctagcccacttgaaagcatcacgctctccagggaactgcctcagcctggggcacttatattatccatgcttagcatttttgtattactttacatttgtgaactgctttcccatgatttattagctgttcttgtttttaatagcccctggaggtacattgatattcaggcttctgagaatgtaaatgcacagggaacgttcatctcatcagatatttttggatctgggttcaggactctgacctcctgggatgaggccatttggggtcactgcctcccatggattagtaggagatcaagtggacttaacttcagctcctaaagtctccaaggcacagccatggaatgactgcagctatttaaggaaatggcgtagaagccattatccaaagagctggattccagtcctgactctgctgctgaccagcttcactggccttgagtagttgctttgcctacctatgcctcagactcaccctctataaaacaaaggtaacctctcaagtccctttagaccccccattgtattaaatataattctgtgactttggactccttctctggaaccccttgggtagccaatgaattatatgacagggaacatgggtatagatataacccattaggggacttgaattgagaaggtgctcaccttcctttctctaggattcaaggaccaactgacaatgatatgctttcagattcattttaagaagcacacaatcctcattcactataaaagtaagatagcgagtggagctgttagaggaaagtcagactggagccaagaccatcatttctgtatcttctgggtgttgtagaaagtaattagcaggcttgattatctcactggttcaacacacattttagggatgtgatgtaatgtgaggaaacatttagttgtcagattttagggctgtatcaaatttattcttgcaggaaaagtctagttgtcctggcaacctaaaattgatttctttttgctcttgtcagctgaaactggtcccctttgaatcattcctctaatttaatatagagagctgtgtgtctccacctggtgaccgaatcatttttaatgacaggtaactccagcaaatggctcctctttcctacctgagccagaagctatagtttattactaccttcaccctgtgttgttctctttgtgtttatttatttgtctgtggagtgaggtgtgtaagtaaagtggcattcaattaattaagagtttaatcaggcctgtagagcagtgatgtaattggcagccaatcactgcctttcgttttcagtgacctcctagacatgagtgggattcgaatgggctctggaagagggagtccttttgtgtggatgtctagcatttttgtaacctgaagagggtgatgtaatggcccagatgaaaggagaaagcggagctgcatggctgctttctgcctctgtcagtcatctctatcaagggggtgggtcatctatgaagggtggaatcgacatcattaggaagaaattgatgcctatgacaattgaagaggttgtgagagagcaattcgctttccttaaatggttgcaaatttcatggaccacgaatgccgcatctcaggatacagaagagaacttctgatggggaacggctaccagtaattttgaggaaacccagaaatcagcagaaatgccagaaagtgaggagacgaggaaataggtattatcaaaaaagtccagcgcccatcccccaccccgcccccaaacgaaacaggtatccagagtctagaatctgctgatttcattgtgattccagttgtcgacggtcctatgtagacaggtgatttgtgagtctttgaaaggaagtagtgttcaccaagagccagaacagggtcttaaccagttcccgttttgtctgggttaaccaactggtggattaacacgatgacacagacatagtggggagaatgtgggctttggagttggattgtctggatttaaatccagagtccaggtcattgtatacaaatgaccttaggccagttgtttaatttttgtgactcagcttcttcttcatgtcagttctatcctggggctaatgataggacgacaaaggaattttttttttttttttttaagagggaatcttgctgtgttgcccaggctggagtgcaatggtgcaatatctgctcactgcaacctctgcctcctgggctcaagcgattctcctgcctcagcctcccaagtagctgagattacaggcgacaaaggaatttttgaagacaaaatgaaataatgcatgtgaagagcttaaaacaatttgcacatatgaattatttaataaatgtggttcttactactgtttgtaggaagacatttgaatttagtaaagcacataaaagccttttacatatgtatggataagtccgtaaacaaatacacacttattagtgatgcgggtttagaaagagtatatttcttggtggcagaagttccaaagtcaggccaggcatagtggctcacacctgtaatcccagcattttgggaggctgaggcagatggatcacttgaggtcaggagtttgagaacagcctggccaacatagcgaaaccccgtctctactaaaaatacaaaaatattagccaagcatgatggttcgtgcctgtaatcccagctacttgggaggctgaggcaggagaatcgcttgaacccaggaggcggaggtttcagtgaactgagatcaccccactgcactccagtctgggcaacagaggaagactctaccaaaaaaaaaaaaaaaaaaaaagctccaaagtcatattgcaaggatgaggacataggtagggaaggggaaaatttgtgaccatttttgcaactttccaaactcctttctcctcccccatctttctttcttccaagaagttaccgtcattagcaatttgccatgtgtctagtttttgtctcacatttatatacctgtaaatatatgtttattttttgctttaaaaacctcaacagttatttgtataaaatttaaattctttgttctttcatgaaatatcatgactacaaacattgaaatagttactccgaattgcagtcacatgttttacttgtatataatcattcttataggcagagggataactgtaaccttttcccttctccttctcaccttgccctttgggagacgtttcttccctttttttgtgtctttctaccttgtccttctcctcccctcctctcttttcccttcccttatattctgttttcttaccgttcgtctccttttctctctccttccctccctccctcccttgcaatactttcctacctttcatactttctttattatatttttagtctcttgtctttagcttaatatggggctcagtggccaggcgtttacataatattgtgggtccttgaaacatcaggtcttggacacctagtctcagctctgaattgtcaggttcctgctgatatactttctgggtccactgttgctttgtatttaatactggaggttgtgataacattgtccagcttcaggaggccatggtagcgcaggagggatgcatgtgttgtgtagttccttgtctggaatgcagggtgacaggaggttggcttgtgtacacatgttcatctccttgggctactggagagggagtctttattttggtggggtgctcctaagagcagtgagctcagagcctctgtcttgagacttgctgtgtgttttcttggcctcccaatgctcctggcataagtgacatccctgcttaggaccctacactcatgatttcaggcaacctttctgccttccttttggcccctgcctctccaccccatgttcatattcttcatcccaggtgcagtgccaccctgctggctacctctgccaggcagcatccttcatgcttagctcaaattccaccttctcagaaacatctgacttcacatttggtgtcagtctctctcctcctccatttcccatcacacagtttgtactttcagagatactttcatacaccaccttgtattcaatgggtggtatctgtttctgagttctgatcagagggcagacatctctgatcctttggaggctagctcagtagctggcatttataggcactctgtaactgttaaattgaattactgaggaggcctgaggggttggaaggtcaaatgcagttaacccagggaactagaagggcccctgggaacttggttttggagcatggcttttatgagcagctatcagcttttccccaggctccttcttaatcctgtctctctagaggcacaaggagaggtggtgtttgcttaagatgctggtggcattcctagtgaagttaggtcagaatgtgccatctcttctttagctctcaacttcttagagtgtcaaccctcctcatattggaaaagcttagcttttaaaaaggagaaagtggtttacatgatgacctctgaatttttgactttgattattaatcttcttgaagaagactttgcagttgcccctgttacaaggaaagcagacatgccaagttgctgcatttgtgaaattgaatgaaattctggctgcgttttatggctctgacctttgggaacagtccagggtcagactgctcacatgatgtgcttgataaatccgcctcccaacagcactgttgagatcttaactagaattgctacttgcgaaacacctttttctgacttgcagttcagattctgcatgtactgctgactactgcttctagtggctcattcagataagtatgctatatattaggtagaaagaggatgcgtgatactaaggaaagagaaaaagagccagcccaggacacttgggttccagtgctaagtctgcaagagacatgtttgacatggggccttagttttcagatctataaaatggagacactaatcattattaggaagggttgtcaggagttcgagactagcctgaccaacacggtgaaagcccatctctactaaaatacaaaaattagccaggcgtggtggtacatgcctgtaatcccagctactcaggaggctgaggcaggagaatcgcttgaacccaggaggtggaggttgcagtgagccgagattgcgccacggcactccagcctgggtgacagagcgagactccatctcaaaaaaaataataaaaataaattaataaaacaaaaagagctcctcctatgaaagctctggaaacatcctccaccaaactggttgcacttctctaggcacaatatggtttacatccttctaaaatcagcatctcggccggacgcagtggctcacgcctgtaatcccagcactttgagaggccaaggtgggcaaatcacctgacctcaggtgatccgcctgcctcggcctcccaaagttgttgagattataggtgtgagccactgtgtctggccaggaggagctcttacagagctggaagtatttactcagagaaagatggagttagaagggaaggttgagaatgagagacaagttagtgtttattcaaggtggaggtgcacaggcctaatgtaggacaacggcaagtgggttggagaagaggggcttacgggaaggatgggcaggagaaatgggatgggacccaggaggcccaagggggaggtggaggattcaagtcagagcttcagatgctgggtctggagacactttctgaatgcctaggcaggtagctgtggtgttttgcaggataagaaagacagaggctttctgtagctaccatcctgctaggtgaaatgaagggatggtctgggatgtgtgtgtatgtgtgtatgtgtacccacatacgtgcatgtgtgcatgagtgtgtattggtaacagaaccaaggagatcagggacttacccaaggccatacagctgggaaacagctttcatttgattacggtgctaagtttagtaatgactgcgagagacaaaaacgggcagggggagcatgtagggaaagggcctcggccccatttcctgccctctcaggcaggtagtgagtaggagttttaggtttcactgtttgatagcatcacctcctctgctttcccagaaattattcctcgaagtatgactcgaatcattcctctgttgggagatgtatcggttcagagctgactttctgctctggttgtttactgaaaaatggtagcactggcaattcagagggggcataagcaagtgaagaaaaaaaaaatgaacaaacagggcatgtgaggtcaggggccctggttgtgagtcccggccctgcttttagagacccatgtgaattgggcagatcaatcaacttcttagtgcctcagctttttcctctgtaaattagaagatagtgatttctgcttgataaatttattgtgatagtgctttgcaagttgtattgttggtcgtaggataataaagataaaggggtatacagacttggattctgtttctatatatgtgaagcgttagagagaggtggtaaattgtttctctcccgtgggttgtgcacatctctgatattatggtaatccccatatcttctccttttgcagggtggggtgtcttggatagtatggttactgaatgtagaatctactaactcctcttttttatttcctgagactgggtctcactgtgctgtccagggtggagtgcagtggtgtgatcatggctcactgcagtcttgaactcctgggctcaatcctgagtagctgggattacaggtatgtgccatcatgccagctaattagaaaagtttttctttgttgagatggggtctcactatgttgcctaggctggctttgaattcctaagctcaagtggtcagcctgactcgacctcccaaagtgctgggattacaggcatgagccactgtttctggcctcctttttaatattctgccctgtgcaaagcaccagcaccaacagcctccctcccacaacccccaacagctgtgcattaagtatcactttggtttgaggatttcctagcttgctgtttatcctgggagaatttctgagtttcttggtctttgtttctttacccaaaagttggggatagttcagctttgtctgcattgtggacactacctccagaaagcaatgggaagaccctttgtaagctgtaccgaactctttgtatttttggagcacattttgtcttttttctcccttcttctggtggctgaggtacctctttggtcttgaaaagacccacttatatggaggcggaaatgggcttatagagggaagtgactttccaagggccctggaatgaattggattctgagatctgtgcccgtccttgtcacaacgtgtcagattccattatttagtgtgggcctgatttgtccatgcctgggactttcccagaggaagtcatactttctggaaactctctgaggtcttgaaggggtgggagaagtctctgacacaagtgctgctgtggtcatggaggcttccattcctctctccttgtgttgagcagggaattgctccttggatattttaggtttgagtgactcaacatgcttatgacccagaggatgctgtggtgtgtttggcagcatgctggaattagtcagaaggcaaaactgcttgtcctgaccccagaacccacttactctaggtggatgagaaagtcctctcagatcctctatttcctaattcatggcaacttctggagaacagtattttctctgttactgctttatggggtttagtgtggaaattaaagaagagaacttcttattttttgtaaataataatgcaatattcagatactgttagtttctgaaatttaaaatgggcatctcacttctgtgttccctccccaaataaatgtattgatactaaaaaagaaagccagctaactttatgaggatggctggtaaatgagccattctgtttttgcttgctgtccaaggcctctaatattaagcctggaccatttcaagcatatatggaggatatatatttcaaatatacattaggggtatatatttcaaaatcgaggacacattaatagtaagaggagaccatgtaagacaaagcacaggtttatttttatttttgtttacctgtttattttttatatttttgagatgggatttctctcttgttgcccaggctggagtgcgatggtgctgtcttggctcactgcaacctcctcctcccagcttcaagcaattctcctgtctcagcctcccaagtagctgggattacaggcacccatcaccacacctggctaatttttgtatttttcttagagatggggtttcaccatgttggccagcctggtctcaaactcctgacctcaagtgatccccccacctcggcttcccgaagtgctgggattacaggcgtgagccactgcgcctggccaaagcacaagtttaaaaattacaagtttccaccagcctcatatctcccttggcttataatattcaagtgttcatggatactggggcttgccatcccccgccccgtgtgttaatgcagcccatggaggcttctcatagagacataaacagtgggctccagaaggtctctatttaagaaactgaggtctggcaaggtcacacatcgaggaaatggcaaaatcaagactaaaagccagctctttggattctcaattccctgctctttctgacacttcactcttccctcctgtcaggtgaagagagaagccagatggtttgacaaatggttctcgttgctgtcaaatctgccttctttctttgctcagacagacagttcttaccttccctttttcgggggactggcggaggtggggtgaggagagaggtaggaaggtggatgaaggaaaaaaagaagcattttattgcttcattctttatgtagtagtgatggccaataagttctttttttctctggcaagaagctaagtaaaggcaaggagtaatcgtcaccttgaatttagagcacatagaggcctagaaatggcaggctgtattaggagacaacattgatttcatatatattcatctctgaaaaaacatgtttaagatgccatattcataaatactaataaggctgtctgattccaattttcaggtgagattagcattttattgagtattttatctgtcagattcaatgctggatgtaccatcctcccaggcttattagcataattgctgtgcttaagcaacaataaaaaaatcagcagtaaaatagcatttagtgcaggcaatttgttatcaaaagcttttacttaaggacagctccagcctgcatttattagcaagttagggttataatttatttttattttgaaaaacaaaagtgggagaaagatttggcttttttgttttggaaataatagagaaattagaaagcattgcctctttggaaaattgtccacatcccttcttcctttgccgaaagcaggctgtgatgggaatagattccacttgtgagcgacattggctcagacaaaaagttgctctccttggcattggaacaaacgggtagtaacgtccctttatgcttgtacacacatttccaaaacactttcagatctcgtttgttgctcaaacctcacaccagtcccgtgaggtctccattcttagaaatagaaaaccaagttgaaatgacttgttccagatgaggcagttgagtggcaaagcggaggtgtaaaaactagtcttccagcctccagtcctgtctcagcattgctcccccttcacgtcgttgtccagagctcctggtggagccttggccttttccatatgtacacgtgcacacacacacacacacacacacacagatctgtgtatctacacctgtctatacacatacgtgcacacctatgcacacacatctatgcatacatacatactttttcttttcctaaaagttaattatgtactcttgcatttgtttttcatttgatgtccgggttgaaatacttctgccacatgaacttctcttgatgccaaatagcctcttaaaatcaatctctctctnnnnnnnnnnnnnnnnnnnnnnnnnnnnnnacccccaccccccccgcccctctagctagcaactgtatcaggaaagcacttgtgattaccatctgttaaggacctggaacaaaataaatgatgttataagtttttgtagggaagatagagataagattttaaaatatggagattgggaaatcatttttcttccttatttcttaggaaatgtatcagaaataaataacattaaattgatgccttttagtgggttttaggcttcaattatgggtaataattttcaaattgagaataaagttttgagtgaaaatggacaactgaagcttctaagctttgagaggagttattttagcattttagattttcttttctcagtaaattcaaacaaagatcatacaatcattgaatcatagcacgtctaaaatccaaggctctgtgctggccactgtgtgttttacagactagctcagacgtggctatgagccccaagacatgtttaaactattagagaggatactaacgatacattaataatgttcttggttttgacagaatattctagaacaggaactctagtaggatttttgcttatgttacatcattgaaatttaaattcactcaattatttattgactaaatattgagcacttatgtgatgttcactcttgtattttacatacatcatctcatgtaattttttaacaatcatatgaaatatgatctgagataatagtcagtactgttattattgttctcatcattagatgaggaaattgagactaagtaacttgtccaagtcattcagctggtaagtggtagaactgctgtggtctccctgtaaacacatgtttttttcatggtaccacttggcaaaaaacgaataagcaggtacatacgtagacagatagtgctaatgatgattagagaacctcagaactcatgcagaacctggatgtttagagagaaaatggaacttgaaatcagacaggtgttcaaaccctactatgcttcttagtgtttgtaaaatcctcaatttaaggacctcttaggatttcggtgtcttcctgtgaataaaggattataaaatctttctctcaatatcataatgagaataaattacaaaatgtatgtgagtgtctgcaaaggtacctagttcatggtgggagttcaccctatcttggaagtgctcataaacatgcagggttttttttttgagacggagtcttaccctatcgcccaggatggagtgcagtggcgcaaccttggcctcccgggttcaagtgattctccttcctcagcctcccgagtagctgggactataggcgcatgccaccatgcccgactaatttattttgtatttttaatagagacgaggtttcaccatgttggccaagctggtctcgatctcctgacttcaagtggtctgactgccttagcctcccaaagtgctgggattacagacgtgagccaccatgcccggttcaacatgcagttttgtgtactgtttagggacagatgccgaagccacattgcttgggtttggatccatcctaccacataatatcatgtgaccttggacaaacaacttcacttctagtgctgtactttcttcatctataaaatgggcttacatcatagggtccttgtgaggattaacaaagttagaatgcgtagagcatgtagaacaatgcttggcacacagcatgccgtgcttcagtggtagcacttactattccattatactacagccaccgagaaggacaggtacacagtgaatagtttaggactgttcatgttcccggcctcttcactccaagagcatcagcaagtttagtttagaacataggagttgtatttacacagctactaatgaccttggaaaagttcttggcttctctgtccttgacctttgtttatctgaacgagtaaacttcagatgacagagtgtgtggggaatggaatgcatccgcatccttgataagctgccctagtggaatgttgccatgtggctactgagggtcaattcactggtcaaaggtggcctgctggttggtattttttctgtgtcttccgggcaagttctgtctttcctcagtctgcacatgcctgggtctgtcctcagagctctctcccatttccctcttctctagaaagcattgatataatggggccacctcttccttggactgtttctgtagcatcagaaggaggtgggtgggaatttggcataccactttttgaaaggtaatacattctaacatatgtatttcacccaccttcaaagagtaagaatacactgaatgatacttaattttaaagatgtgttgctgaggtgaactctaagacgaacaattcttcagaatcttttactttcttgggcttcttgtcccaaacaacaattatctttataaagcctgtgtgtgtatgtgtgcgtgtgtgtttgtgaaacttcctggaattggtagtgttgattttgagatgtttctttggcttattcaaaatataaacagaaaggctaaagtgtttttcatgtcattaagaatgtctttataagaaaggacattggccgggcgtggtggctctcgcctgtaatcccagcactttggcaggcccaggcgggtggatcacgaggtcaggagatcgagaccatcctggctaacacggggaaaccccatctctactaaaaatagaaagaaaaaaaaattagccgggcatggtggtgggcgcctgtagtcccagctactcgggaggctgaggcaggataatggtgtgaacccaggaggcggagcttgcagtgagctgagatcatgccactgcactccagcctgggcgacagagcgagactctgtctcaaaaaaaaaaaaaaaaaaaagagaaaggacattaagatgataccttaccttgtgtggggggcttgtagctttcaaaacacttaagtacccattttcttatgtgtgctttatgacatctctatgatgtaggcaaggcagggtttatcattatttcccttttagaaatggtggatctgtggttcagagaagtgaaataagttttcttaaagcagttctggatgcaaacccagaacatttgactctagggtgctttctgctccaccaccctgatttgattgtaaggaggtaattcttaccaagtactgtcagattatatagagttgtaatatatcttaaaaatgcccattttaattttctttaaacagatcagttaaaaagttaactgtgatttgataccatcttgtttctccccaagtttaaacagcaatgagtctctaggaccttcggttaaaccagcatgtgtttttcaaaaatcaaatgtcaaagcatttcgtgaaccttgctttaatgaacaagagaagtgaaggtacaattccttttttgcatgaggtaattaggaaacaggatgtgcaaacttgctatatgaatttaaagaggagcacttctactgatgtacaaactggatgggcatattacagagggtttcatgctggtagaaattttaagtgaaataagttctcattaagcatatcaattatttttggactgtgtgaaaacttaatctgtttcatgagttggatctaaggtggtcaatacctctacactccaaaaaacagaagcatgactcaaacatctagttctgattgcagagtgcctttatctggaagactggacatgtcgtcagaatatagagcaagagggatggaatatgctcttaagtttcctgatgacttaagggtctgcactatacttgcttgggaggtgggaaggattgaattctctttggaaaatgcctttgaatctcttacacacatggtacccaataagcctagtgctgtattattagcatcatgtactagagtatggtttacctgacataggttttggaaatctatttcttttatttacactacatggtttcttaggtggcaattctcagtgaattaccagcttcctgatagtgtcttgaaaagcatgctttataaggaggcagaaagtgtttctcttttgacagatgacctccttgaccccttgactttccatttttgatggtttcttttgaggtctacgtcatctggtaattttattggtgtgatttatgcccccagtaaggatcaacttgtatagattctacattctcatggaagtctatgtactgtctctactgtgtaataattagctccaactctacaaacaaggttagaaatgaaatcaccagcattacaagtgagacataacaaatggaagattcccttctctgagtttctctcataccgttaattttatttgagctggcattgactcattctatatgtctcttctgctagattttgaactctggaggactggtctcatatcttattaattataatggtggcgcacagcacattataggtatttattactaagtggttgggtttaatatcttaagaagcagaaaatgtggtttttcttgagagagagatggttttggatgttgttcctctagtatattctaagcctgcccgcctggggctctgtaactatggctcctaacgtggggagcccacaatctagctatatcatgttagcgagagctctttgtatactgaaacaataaacttaccatcttgatgagttttacatgtagaatggcttaggttataaggtactgccacctcattccactgttgagaattgtctaatgcaaagctcactttttaaacatggataattggacagtcatgagtggatcatcgaagggataagcaaaatatatgtcaaactgagaattaatatctatcaaaacacttgctattatttggtagatgggagattattttatttttaagaagtagattggctgaatggaaaagcaaaatgtggcataaaataaaatgggatattgttcagcagtgaaaggaataaagtactgatatggactacaacatggatgaaccttgaaaacattatggcaaagtgaaagaagccagttacaaggccgggcaccatggctcatgcttgtaatctcagcactttgggagaccgaggtgggtgaatcacttgaggtcaggagttcgagaccagtctggacaacatggtgaaacccccgtctctactaaaaatacaaaaatcagttgggcgtagtagtgtgtgcctgtaatcccagctactcaggatggtgaggcaggagaatggcttgaacccgggaggtggaggttgcagtgagccgagatctgccctccagcctgggtgacagagccaaactctgtcaaaaaaaaaaaaaaaaaaaaaaaaaagccagttatgaaagaccacatattatatgattccatttatgtgaaaagcccacaataggcaaatctatagagtctgtagcgatagaaagtagtggttgccggcagggttggggtagaggataggtagtgattgctaataactgtgagtttctttttgggatgctgaaaatgctctttatatggtggtgatgattgcacaacactgtgaaatactaaaaacagaaccgtaaactttaaatgggtgaattgtatgtaaattatatctcaataaacctgttttaaaaagtggatttccctttaatctattctctgaggattgcttcagggattcaaaatagtgcatagtgccaagttttaaactcatattgatttgtttttggtaaataagtcatgcatgcttaacaatggtgaacacacttaaggaaaaagtggtaacacaactagagccaccaaaccgaagcaagtatatttccacctaacttcatgcacgtttttttctcagaagctttaaaaatttatactttctcaaatgttgattaatgagatatctgataagaaataacagggtactgacagtcctgattgtataaataggcattagggattgtgttcatggtttgcttgtcagcacaagagaaatgtgtgattatgttgaatgatagttaattttcttatccacccattttaaaaataaagatgtacagctagaaaacaggtgcccagggaatagaggagacctgcagctttgataatgagccccagaaagaaactagaaggaacaagctcccgcttaggaggtgccgttcgagtcctggccagtgtctgactgtagctgatgggtttagagaactgtggctggcttctcacaaaggattttttcatttactcttgttttgtgtttgagtatagacagcttttcccatcctccatcagggtcattgtcccaccttctctgactcacttattgtgtcaacagaattaaaagagcagccggtggacgtgtgtagaggctgaaggagagctgtgttgctagctttgtatttgaacggttcgtacacaaacagttttctttgattaagtatccggtgaaaccaattcacatgaactccaattaaactttaatgaacaagtgggtgtattaatatcagctgagtaatgcaggcagcacagattccagtaagtgactcacttctctgagcagctcattccccatgcacggttagagttactagaaagcttccagctatatttgagtggatctggtctgggccttgtaattctaacaatcctcagggctcgctattcatctagtgacaaaaccacagtcatccagacctctgttttcagagcaaagattggggatgaagagttttgttcacattgagcaattaggcccttcgttgagcagtgaccatttggacttttattttcctcatcttcccatttttgtttttttgttattttattttttagagacagggtctcactctgtagcccaggctggagtgcagtggtgtgatcacagctcactgcagcctcagcctcttgggctcaagcaatcctcccgcctcagcctcccgagtaacctggaacaacaggcatgcaccactgtgcccacctacaaaatttctgtagagatggggtcttgctatgtcgcccagcttggtgttgaactcctgagctgaagtgagcctcagcctcccaaagcgcttggattatagatatgagccccgtgcccagcctttattttgtttttaagtgagaattatttttttcttaaacccaggggcagtgtaggtgaaggttaaggcagtgaagatagaacagtcagttttgaaatgcacatagccttcctgagcctcactttcaccacatctgccagtctgcctcaagtctttaagtttccctacaccagaggcagcaaggtgtgcctggaatgatgaattcctttgagcacagaccctgttccatctagagactgatgactgtacctatttcctaggaaaggttaagcaagatcgtgaatataatgctcttcgtttcatgccggcacataataagttcccactaaatgtttaacttggtccactgggggaaggatgagaaggaggatttggagataaatgagacttggcccttgacaattcaggagcttggagtcttatagagatttgacttaaaaatgtctgtgtaactccagagtgataaagacaaaaatgcttgaaaaagataagtgaggattcgggggatggaggaatcccagaggttggccccgtctgagaaggctggaggttagggtaggaagaggtaagggtttgggaaggtagttctaggctgactgaagagtgtgagcaaaagcagaggcagggatgtatccaggtatcagatagtgcacatttagtgtggttacagtaggtgataatttaggaggctgattgaaactgaatttagcctctgccttagtcaccaagtcctttcccagctccacttgctgttctctctctcattctctcctacctatattgaaaccagttgaaaataatggagtcacacagaggcagatggcaataatgtccaggttgtggaacattagctcattgggcttgctaatgcagcacccatgaatgaaatttaccctcttcctctcagatagctcctgcactcaataactcccatttagggcacactgtgcataaagctcccaaccatgaagagcagggaggatctgcctctaacagtcaggtaactcacaaagactggaaggaagtgactgggttacacatggccagtttcttctccaaactcaataattgggtaactctctgcctcctcatctgagaacaagggagtgggagggaggcaaacaagaaaagagaagaagcagtggagaaaggagacgttctgcagtgccaggcttcttgccccacactcttcccaaatgtcaacatagttcctttaggggaaaaaagtgggaggctagaatggtaggacagggccacaatatggaagtgaaaaaccaggggcagtttcctgagcagggaatgatgtcattcgatctataattcagtctggttaatctacttatgcaacaccaattgaaggacacacttagataactcagccttgagtcaacaaatcttgtgtaacactgccaaggtccatagtgcaagaatcagcccccacttcggaaataacaaccacccctcagtgccaaattttggacattgcttgtaaatttcagactccttccctccaagatactgttttagagaatgtcgtagggtaaaaaattccaaggggtaaagacataaattccgtaatactacaatagatgggaggctctaatcaagtagataaattctatttttggaattgtgaataaagcagaaaagattcttggaaatcaggaattgaatagattgatggtacaaatgagagactatatgttgcttaaagaaaacaaaagattgcctatcaggttttaaaatgtgagtcagtagtttatatagtgattcaagctgaacagctatcttggttattaactaaaatcttttctttccccttccattttatatatgaagaaactattaatacaaaagtcattatcaaaggacactggggctaggtttcattacccagcttaatccttaatttcatattgagcatttcatattgaagtgaaacaataaggatatgtttctagagactgatgagacaactgaattggacttggttttgacattcaaagggatcaggtagaggtacttagttgagctcactacttcattttggcaaaagacatatgtcatagaaatgtagtagccatgatggattatgtatctttgaattgggagcctatgacaaattttctccaatgggaagtttcttcagagcctatcattgtttcaacaataattaaagtaatttacagagaatgtgctcatctacttttacctactgttatcttttttccaagttaataaactgaatatattgtatagattggttgatagccttcctgaaatgaacatcctttgcaaacctatctctccaaacccaaatcctgcccaaatttcccaattgtggtagcaagcccaatgagctcctgatacgatcctaataggatcctcttctctggaaatcctcgacagatcacacttctcttttcttgggaacagctttctgtttccttgtccagaatggatgccgttctgttatcctggtcactctctgggccccctccctttgtccaccatgagcacaggctactggccactgatcctcctgggggcactagcctggctaccccattgcttattttacctttgcttctcttaaataccattgttggtgattgctccacacagcaattgttctcacctaagtctgtggataagactcacttagggaggttttaccagaattcagctcatctccctaaatgtttgggtctggactagggcacacacttctcgtgaggcgcttctcatgagtaccccttctcaaactttacgggtatcaatttacttatggcctgcagtgcataaagtgaaagctttctgaaaagacatttaatccatcggtatgaggatgaaaaagacacactcagggcatgaaaagagtgagaaggtcacaaaaagggtgtggtctcagctggagaggaagctgaacaatcctataaaggaacaaaagctcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcttattctataggcttcagcctttttatgaagacctagcttctactcttgccccaggccctaagcaggcccagacttttcccatatacacacactctctctctaacttatgtgtcttacatcttaataaggcagcagattgtatcagaatcagttaactctttatcaaaaaacccagagcagacagacgggtgaacttgctcatgggctgagctagaagggaggccacttttccttcacacagcctcggactctccctgggcttttttgtgtgtgctgcgtggagactgtgttctaacatttcagtcatatcttccttattttaaaactacagaattgatcttaccaacttactggggagcacgtcgtcagtaaattctaatggaaaaacctgtctgatcaatgggacaggaaagcgtcacagcaataccggtgagtcattccaagaccaggcacatttgagctgtgttgcttcttcgatgctgactataattctccctcagcattacgtcgtcttaagcagcttttgaatcttcgtctctgattccctttctaggtcagactgtgtctttttttaaaattgtgcctggatatccccttaataggttggacaagtcccattaggataattggctgtatgaatatgcgaaaatagcaacagtgaattttaaagttcttgaatagtctccccgtcccactgtgaggtgaggcatctggggtgggctatctgttttttgattcttggttcttgtttttaaaaaaataggatgttggaccttgggatgagagggaagtaaaacagttttggaacccttttagaaagcaaactaagacaaaactcctttcttgagaaaaatggatggacattgtaaagaagacagtagggcaccaggaagccttgagccaggtctgcctgtgtcacatttcgagttatgagcttcaccgctctgctgtctgtctctggagatcatcatcaaacccctttctctgagttgttgaatggctcagatgagttaatgcctatgaaagtactctgtaaacagaaaaataccttcctatttgtaatctcaacaaagggacttttatcatccctaaaacagaacagacatttctttttcaattatgaaagttacatagactctttttaaaaagttaaatgcacaaaagtatgatgaaaattaaaataaccctaatgagtccatcatccagggacatcattgttctaatttaaacatttgggtaatctgttctctttttttaagaagggttgtgtgtgtttattttttttctttttttgtgtgtgtttgtgtatatctatgtgtatttttattctgttttctttacataacactgtattgtaaacattcccaaaatgtaaattttaatcattgcataatattgcattatctgatatatgcacatgcattttgagattttgtgacgaacgattgtgactattgtttccataattaagggttagctgcttaccaagaaaggaacttactttaaaacatggcaggcacacttggccattttttttttttttttttttttggcagtaaaggaatttgaagtatccagttttttaaataaattaatatgtattgaattggagtttagcagtacttttagttaagatctcagttaaggtaaaaaggtcagacctgtagagttattaatttgtagaaaattctgactacagcaaaacatattagcccaagttctctttattaataaaacattagttacagaaatactaaaaaatagattggttggtctcctgaatgtcctgcgttaggtaagttgccttatgccatctggaagacttttttattttctcttcatagaaggatacaatagatttgttttgctcaaagagttcattttctgttgctgggcacatatataatactgtaaacacatttctggatatgacgacataatgatgaagagagacctttgaatattttcttaaatgaagattgaaggagtagtaagctgtgagaggagatttttctactatttcagtcctaagattgatcttttttgtcatggatttatccctttgtctctatgcatttctatgtgtctgctcagcatcttatcttctacatttgccctagttccatccttccttttttccatgcttgtttttccatacacctgcccatccaccctcctgcctctctatccagtcgtccgtctaaccatttctggcaattcttacctccctgtttcatgtatatctctccatttttacctgtcatttatatttatctatttgcctatccatatctacacctgcttgtctgctcactgtctatctataaagttaatggagatgattttgatgaaaacttatgaatttctttattgcattttacactgtgggttacaggggccaaaggccatggggaccagaaagtggaaataaccagagctcggccatttttgtttcatttcaaaatcaggagggaaggtcagaactaacctgattatcctttctgtgatgctaatcaggatgttcttagtataatgccttttggagactgttattttaaggaatgttttgctaagaatcagttgccaggacatagaatgaagagctattgtatagcttcagagtagttctcttttaagaaggatataataaattaaaaataattttcttgaggtcagactaaggaaaagtcaaagatatacaattgccatctctccaaatttattgattttatttatttattatttattattattattatttgagacagagtctcactttgttacccaggctggagtgcagtggcacgatcataattcactgcagcctcaatgtcctggagtcactgaagcctctcaagtaccttggactacagttgtgtgccacaatgcccagctaattttttttgtactttttttaaagacagtattttgccatgttgcccaggctggtgttgaactcccgggctcaaactatctgcttgccttggcctcccaaagtgctgggattataagtgttagccactgtacccagcccaatttactgacttaaaaaaaaagaaaaaaaaaacaacaacccagaacatattgtaacattcttcagggagtttagagacaacataatgaaggtattttcaaggtttggggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcctttactgaaaaccatttttcttctgattctgagaaagctgctttgcatttactctctcgtttaattctcccatccttccttcaatgtaatttctattatcccaatttataactaagaaacagagactcaaagaggctaaatgatttgcctaagtttacatgattaatgagtgccacagtttttgtggaacagagacttgtttgaatctaaaactgttactctttgcagtaaaccacaatgaaaccttagctatatatcagttctccactttaaattttatggtaactcaacctctgaaaaggatcctgcaaatagcacagttttcagttcttttcttgagagaaggcagggctttcatatggacatgataaagaagacagctcttaggatgtggatataagattgcatttatgaactttactttagtatttgacagaatggggttttcctcacatgctgctgtgtgtttttgtttaacctaatctgagtctcattaggcagcttgatccagaagacagaaaggtctcctccacaagatgcaccttatgaagcaaacaaaccaatgaaatgcagtaactcccttcaaacttttgtaagctctggaaagccagaaaagacagctattgtaatatattttgccaggccagctgttatcatcacaaacaagcctgaaatagcaatgacttttgaaatcacagcacatttatttacttcttaacttttccataggtttgaaagcttgctccctccctttttatcatgctaaactgtagttgctaacaacattctattctgggtgggaattagctttggcataattaagaatggagatgggggtggataaaagaggttctgccaaaggacttgtcttatatgattttattcttacttttaatctgttttattctttaagcatgtattaactgcctactacgtactcaacactgtgctatgtgggaaaaatatactagaacaagggatggtcaactttttctgtaaagggacagatggtacacagcttagatttgtggtccataaggtgtctgttgtagctactcactctgctcttagataatacacgaaacactcaagactccaccataaacaatacataaataattgcgtgtgaatatgttccaataaacttttattcacaaaaacatgcagtaggctggatttggtctgcgtgccacaggttgccagcacctgtactaaaatgtccctgaaaatagagaactttgttttgttcattggctgtgtcaccagtgcctagagtagtacctggcatgggataggtgaccagtaaatatttgttgaatgaatgaacttataaatgaatgaatgactcagactccttctctgatctcttctatacttaaagagagtacaaagaactgtgggaggtaaaaggtactttcctggaagagagagtgtggagggtcatggaatcagttggtatttgagctggaccctgaagaataggtaagtatatgtcaccagcggtggtaggagaagcacactgcaggtaggagaaacatgcaaataggataagaagcagggcacttatggtgaataatgaggagatcagatgttttataacaggagtttcctgacttgcttgatcttcaaaatcacctgttattaaaaataggttcccagtaccctccctggagattctgattttgtaagacagggttggccaatgataatttacaaaataaatatttgaaaaggtgtatggctttggaaagttatactggaaccatttctaatgggaaataaagttctcacttttcttagtaaaaggactagtatcaactagtaattgctggacctataattaccctataccttctgtgccatagaatggaggaagtgccctggcggaaatctaccctacttaactgcctgtcttcatacgtcccctgttgatgttgtaggagtaccccagcctttatgatggaacagtgtgtaatttagtcagtaaattgtagtcatataaattataataaatgtatcaaatttgtagctactagctttgttgcttttgaatttctgggttggcaaacctctcagagggcaaatagatttaaatggcgtaatagaaaatttgcattctcttgctgtacctccaattcagagtgtagtgtaatgcccagatttgtttgtagactaagatcactggaagggctgtatagtttaagcctcttttttaataatggggggaaatctgaagcctaaaaggtgggcagggacttgctcaagttctgtcaccaaattattttggcagaaccaggagtataatgcgaatgttaagttactaaatttagttttcttttcatggtgccatgccacatgtatcaataaagttcctaatttacatactttctctcccctttaaatctcatagctttttgctcatatacctcttgtgtactgcttaccataaagttatatcttaatatcttatcctgaacgagtagcccactgttatcccaaataaaggctgagctctgtttccctggagagcttaacatatttcctggcacttagcatgtgttcagcaaataattgtagacttgaaatatcttgagcatcttttcttttcccatgtgttttgactcaagttcctttgcagttatattgtcagaaaagtcaagctcttccagaattgctgaaatacaaagataatttctcttaagcttccttaaaaaagttgaattccctattatggctgagacctttcttaacagctcttctgatagttaaatgtcagttgcttcaaaaaagaaatgtcattaaattatcagggaaataaattacatatttatttgggctgaaatattttaattgaccacttaaaataaagataatagcaaaagactgatacatttcctagcttgcacatttctctcaattgccaggacttttttgtttatatctcttaggagatttcatttttatttcttctgcattatggttatatatgtgcttttgactctcccagtgggtgataagttctttgaagtcaatgtacttaaaaaaattaatctctatatacccacaaagcctagctctgtaggagctaaatactaaatatatttactttaaaaaaattgttaggaaaaggtcagtgttaccttgatttcagtgttattttgcagccctcaagtcaacaaccattttactgaacatccagctttgtgcctttctgtgagcttaacattggtagcaggtgtggattgggacataaaaaagtaaataaaacatagttaagttgacataacccataagtataatgtgatgtggaaatctgagataggtacaaataacctgtactagaatctggaggcaggttaattctgacaaggtgagtccagagaggctcacaaagtgtcaatatttgagatgagttttactgggtcttggtcttctatttcagttgctggttttgatttttctcaacgcaacacacacacaaacacacagatacacacacacacgcaaagtgatttgttttctttttataatctctttgactatagacttaagagaactgcctttatgtaagattaaaggaaaagaggagcaggttttattgtgttatttgaaggtttttcagagtctgaaacacacagcgaccgaaagtatttgggatggatgatgccagtagtgtcatgaaacaaagtacgttggccagagagagacatatactattgtaaattaacggtgttcttttccaaggattttctcgtttacctgttgttgtcttcaatagtttaattacactaaatattctcgttggtgcggggagcatagtatggtggaggaagtttcaactttgaagtcagacagttctgtttctgtacctaacttttcacttattgtatatgtgactgaaggctgttgcttatcctctctagggttgtttcttcatccttgaaaaatgttgtgttttctttttcttttcttttattttttttgagacgtagtctcactctttcacctaggttggagtgcagtggcgtgatctcggtttactgcaacctgtgcctcctgagttcaagcgattctcctgcctcagcctcccaagtagctgggattgcaggcgtgcaccaccatgtccagctaatttttttttttttttgtatttttagtagagacggggtttcaccatgttggtcaggctgggcttgaactcctgacctcaaatgatccacccaccatgccctcccaaagtgttgggattacaggtgtgagccaccgtgcctggcctgaaaattgtgatcatggaaagtacctcacagaattgtgggatgaatggagctaatgtttgcaaagctcctatttcagtgtccaggatatgttaggccatatgcctacagagtcaggcacattttcttgaaacacaaagccctttatctagcttaacctcttcccactttagagtcgtgggtgcaggaaatattttgttttcctctttaccgtaaggaaagtaacagtgctagtgtgttgttgaaatgccatgctctgggcatgtgtttggggagagagatgcagtgcgtggtggggaatgggaggtgctcaagagggcatcctctctgaaaggggtgacagccgcttggcgctagctaattattgccacgtggagatgcatcattgccagatttttatgtaaactctttggtttttaaaatgttggcagctcattcaagtatttttaaagcactatgagagatacttcctcatggaagaagaaaaatgcaacttacaatcttactcagtagcatcaactttggctcaaaacaacaacaaagcacgttgtaagtccacactgcaaatggcaaacagaacccgtctaaggaccagatttggcctgcagccctcaatttgcatcttctgtgcatatttttaactggtagagataacagtaaatgatggcaaaacttactgagtcctttgcatgtgctagaaactttgctatactttgcatatatcattcaattctcacaataacccaaagaggtgtctattactattattatcccattttacagacgtgagcattgaggctcaaggaaatgaagtatctttcctgaggtcacacagatgaaatgtgacaggtagctttgaaaccaaagcctgttctcttttaaaatcatacataccagtggatctcagtcctggtggtatgttagaatgattggcgtgcccttaaaaacagtgttgtccaaagtccacccccaagctcattaaatcagaatatctgtgggtgggactcagacgtggctgttttttcgaaagcctcaaatcaatgattagaaatagctgtaagatagataaaatttgtgcctccacatctggcactacctatctcctgtactctattttatttttgagtatttattgttctctgaaaattatgtgcatctttacctgtttatgaattttctacttttaccacactgggatgtaagctccgtgagcgccaggatttagtctttttaagttgtttgttgtatccccacctaggtcagtgcctggcacataatagatgctcagtaagtatttacttgaatgaataactggttcttcatcacagggagcttacactctagtgagggagatagataatacattcttagtcctatgagataagctcataactgggatgttcaatatgactttattaacacagggaatacagctgattatctcttagacattgttaggataaattgtttctatacgtattgaatggactgtggggcatttttggtcacctgcactactacactggatccattctgtgctctgggctgtaagtgtgtgtgtgtgtctgtgcgtgtgtgtaatttcgggaacgggtaacacattcgtattacctctgtttggacacgatttttagtgacagagctaggaataacaggtggaaccttctaagttttgttgcttaaatatcaggccccctcagaattcaggactgatggtagaggatttaccagtttacagggaattcagatattctcttctctttctaggaaagccaaattgttggtcattctgcccccaacatttacagaagcagtttctcggttttatttatccaagattcttatgatgaatagtgttaatatcgcagcacactatgggctgtgatatgcctatatcacagagaaggcaagctgtggtgaagtggaataaatgaaaaactgtctataactctgcttctagatgccccacttaagcaagtaaatgggaatgtgagtgacaatatcatagggataaccttgaaagagtgctagtttttaaacaaaaacaaatcatttggaacgttaggatttaaacagttactgataataaattgcttgtgacacatctgaaaattgatggatcatagtgatagtgaaaatatttaacaactgctatggcccaggcaccgaacaatcgaaaccaactccagtgtaaacagtggtgccatcaagtatgcgctggttgtcagccttgctggtggagtcattgtgtcacgatgaagcaactaagagccagtgctgcacaaagtgttgagagaaacaaacaaaatccagggtgctccccttatgcggagtagagagtagatagagccttgtttcagaacgataaaacttcggtcaaggacttgatcttcccacttattgctgggggctccagggcaaatcatttgttctttctgagcctgagttgttgtttcttcttgttcttcttgttcttgttcttgttctcgttctcgttctccttctcctactccttctccttcttcttcgtcttcttcttcttactctcctcctcctcctccttctcccttctcccttctcctttctccttctcctcctaccctctcccttctgcccttctcctttctccttctcctcctccctnnnnnnnnnnnnnnnnnnnntcctttttccttttcctcctccctctcctttttccttttcctttctccttctcctcctccctcctctccttctccttcttctttttcttcttcttcttttttttttttttttttgatatggagtctcactctgttgcccaggctggagtgtagtggtgcaatccctgctcctgcatcctctgcctcccaggttcaagcgattctcctgccttagcctcctcagtatctgggattatagacgtgcatgaccatgctcagctaatttttgtatttttagcagagatggggtttcaccatattggccaggctggtcttgaactcctgacctcaggtgatccacctgccttgccctcccaaagtgctgggattacagtcatgagccaccgcacctgtccagagcctgcgtttcttctaatatacagtggaggagagtaatttttgcattacctactttgcaggctctggagttagattgagcgcacctgaagctaaggttaaagatgatggctatgggcatgatgacagtaattgttcttctctggttggggactgattgatgatccctgatttctctgtttaaacgttgcccaaaacaaaggttgagaggtccttaggggagaggcgagataagcagaggtaggacttgcctttcttctgtgcttctccagaattagttgtgtcctgtggcatccacagacaaaaattgagcaatctccttcatagttgagttgagattgtataattcgataaaataggtttaaatagccttatgcctgtataatattcatgaaaagtgtcatgagtgaggtggcttgcttgttttgaaaatgggctgattttgacaaaggggaaaaatcgggattcatttactgtaagttgaaagtaagaaacaacaaagttgaatattagaagaacttggctatcgcaaaaaccacatactttcacatcagtaaaacatggagttctgatctgagtgaaatgtgaaacttcttgcagaccacagagagtaaaaaggagtacttttgtttcattattaataccattgtccttatttctttaaatgagaattgataatacccataacagaatctttcacacaggccaaaaacaggaaaggataaattaaacaaaacaaacaaacacccaaaacctcaccaccaccaccatgactgccaacaaaacccagtgctgtgaggatgcatcagctttaagatctctttaagtcattgtgttctagagaaaggggttctttatttgtttctatcaggatagagtgagtttttgttaaagttgtctttcttttttttttttttttcttcttctggaagactgacgaagttggccttttgggatattacaagaaagataactttgtcttctaatgtctgcagtgatatgaggcaggtgactgtgtgtattctgtggtgatccatgttcacaaggagagacaggccaaggatgcccggttgatgagtgcgctataggtgcttgggagtgagaaggcaagaaagcaaagtgaacttaaaaaatagctagccagtggaattgagggagaaatgctcattctttgctgacacatgaaataattgttgagggagagttgctcaatctttgcctacacattgaaataattgtgttgaagagtctatgaaaagggggtcaatagatttgagttttcatcactttggccaccacctaattatagatggcctccactgtgaaatatgtgagttgaaatagatttttttaaaattcattttctggactggcatttagaatttgagtttattcaatccttgcttcttgggcagttagggtgtcaatggcaataggaagggtagctgaggccagagtggtgggggtagatgttgggtggaatgtgtgtggttgagcagagcattattattattgctattattattttttaaaagaatccttatagtaaagagagccaacattgattgaatatatgttccttgccagaacttgggctaagtgctttattataagttatcttatttaattttcacagagacctgttgaagtgtaagttttagctttctgtttcacagctgtggaaactgaggtgctgaaaggatgaagaacttccaaaaagtcgaagatattaagcagctgtattagtcttcagatcctgatatctttctcatagttattctgatatgccgtattaagttgcagaattgaggccgggtgcagtggccccaatttttattttttagttattcttattttctaattattttatatgctctctctctctctctctctgtctactgtcaaatcccggcactatgggagtctgcagtgggaggatctcttgatgccaggagtttgagaccagactgggcaacatagtgagaccccatttctacaaaaaaatgaaataaaacaattagttggtcatgatggtgtacacctgtagtcctagctactcaggaggctgaggcaggaacattgcttgagagttcaaggctgcagtgagctatgattgtgctgctatactccagcttggataatggagcgagaccctatctctaaactaaactaaactaaactaaactaaactaaactaaactaaactaaactaaactaaaagtaagataaaataaacttacggagttggaacattgcaggctatctatctggcttccctgccctgaattcatcgttctctttgatgtgctattgtccaacatttctttttttttctgtttttttctgttttctgtcttgctgtcacccaggcttgagtgcagtggcctgatgttggctcactgcaacctccatgtcccgaattcaagcgattctcctgcctcagccttctgagtagctgggattacaggcacccgctgctatgcccggctaatttttgtatttttagtagagacagagtttcaccatattggccaggctggtctcgaactcctgagctcagatgattctcctgcctcgacttcccaaagtgctgggattacaggtgtgagccaccgcaccaggcctttccaacatttctttaaagaaactaaaaattaatttgaataagtaacacaaaaatatagtttaaactatagtataaaattcaaaactatgcaatgacaagtacatctttattttatctctttacttctcccacccagaggaaagtataagttctttatatatccttttagaaataaactgggtataaataagcatgtgtatacacacacacacagaaacacacacacaaacacacacagatatgtatttatattccagtgtatataaatacatttatatacatgccatttatatacacatttgcatttctgttattagcgactctaaacaccatttgaaatgagccgtacccatttgtaattccgttttctgaactgtccttcacttccttttccattggattgctgaatttttgcttattgatttattacagttaagaaaattaacttgtagtctgtgacaggaattgtaatgctttaccattttgcatttcttttttaacttgcagattaaaataaaaagttttatatagttaatccttttttgattttatgtttctttgattttgtgtgatgcctagaaatgccttccccactttgtgatatttaaaaagaaatttccaatttttcttctagttatttcttctgctctttctcaaatctttgaaccattgaaattttattttggtaaaaaatgtgaggttaggatttattttgatatttttctggatctgcatttctaaacactgtttattgaggagtccatctctttcacactgatttgaaaagctacctttattgtatattaaatttcttaatacttaagtatttaatacttaagaacaccgtggaatactatgcagccataataaaggatgagttcatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggaatgctcataatgttccctgttactagtgacattggctttcgatttgagaaatgtattgtgttgaaaagtatccacacttattttgatagtgttgttattgttgttgttttaattgagactggttgttaaaaggttatctagcttttttttttaaagaaactttgaaagtaatcatatattctaaaaaaattttatgtttttctcttttgtcctgtaaatttgctgtaatatatgaataaaattttcaaatatgaaatcttgttagtattcttgctaaaataattatcaacttgttcattgtttctgtattatatatttttagtgttgctagatcctagagatcattaatatattaatgatctgtgcttcaattttcataagtgagattatttgaaaattctgtgtgtgtgtgtgtgtgatcgagaccatcctgaccaaaatagtgaaatctcgtctctaatgaaaatacaaaaattagctgggcatggtgtcatgcgcctgtaatcccagctactcgggaggctgaggcaggaggatcgcttgaacccgggaggcagagtttgcagtgagtgagattgcgcccctgactccagcctggcgacagagagagactccatctcaaaataaacaaacaaacaaacaaggaagcctttcttttttctttattttgaaatagtttgataacatttacatgggttatttctttaaaatatggtagaattcccttgtgaaaataccttcacttattgccttttttggagtgaagaacggagtgaagaaagttatttctttaaaatatggtagaattcccttgtgaaaataccttcacttattgccttttttggagtgaagaatgtgtttgctctttaaaattttttacattttttttctgtagtaattggactaattagcttttatatctattctgtgattacctttgttaaattatagtttttttagggaagtcacctatttcaaattcatttgcatggtgtaaaataatttctcatgattattttcatttcctctgtatttatggttatatttcacattattatttaaagttttatggatttctgctatgtgtatccatctttctggctaaagcatcagagtttaatttattatttatttaaaaaatagcttttgcatttatgtgttggctctaccactttgtaattctttattttctctttaaaatcttcaataataccttctactttttctaggtttattttgttgtttttctcattgtttgaacttggctcttaatttccatatttttatttctgcttttttattcatataaataagatataaattttcctgtaagagatgcttatttgtatgccttaagttttgctaaatagtgtttttaatcttattttttagttatttgactatgcacaggttcttaaaatcccagacccattagaatgtaagctttgtagggacaggaaccttgtctgtttatttattttgggtctaccgttgtgcctgtcatatatttcttaagcacttgctaatgtgcttaagaaatgcttttgtgtgaataaataaatctccagggaattatggaatttgtggctgattcagtcctgtaactctagttcgtttctgcctcatttggatattctctctaggtatctactaatgtgtaggaataagaacatattagacatgcttcaaattacctttttaggtcatgatattaatagatttattttaaaagtctacatagtttttctcaaatcaagtatacctgggtaaaaatgtctttctaaagattagcctgtctgggcgcggtggcttacgcctataatcccagcactttgggaggccgaggcaggcagatcacctgaggtcaggagtttaagaccagcttggccaacatggtgaaacctgatctctactaaaaaaatacaaaaaaaccagccaggcatggtggcaggcacctgtaatcccagctactccggaggctgaggtaggagaatcatttgaactcaggaggcggaggttgcagtgagccaggatcgtgccattgcactccagcctggacgaaaagagtgaaactctgtctcaaaaaaacaaaacaaaacaaaaaaaagattagcccaatctatttctagctacttgggagattgaggcaggaggatcacttgagcctagaagtttgaggttacagtgtgctatgatcatgctacttcactccagcctgggtgactgaccaagaccctactggaagaaaaaaaaaataagaattgctcaagaaaaaatacagttgagtagaattagaatgctagcagtgttgcaatagcagagatcacatgatgcccatgatgtttgtgaccttggacactttaggctaaattttgcacagaagcccaagtccaggatagaaatgataacgatgaacctgctgtagtgcagggaaagatgcagagctgggggggagcccaaacccctactgatggccactttttcttctgacctcttcctatgtctcatttaaaaaccagtagctttacttcgaaaactcaattttcagatgagaatcaaaacaaaaatgcaaagaaggcaaatgattcataaaagttgctgagtgaattagaactataatgtgggacaaacactccgcctttctgtctctgcagctagtggtatttccaggttcccagggaacctcctgtcccttgctccactgtgcatttttagatggacctgatatttggttacctcccttgacaggcccaacaatccttgctaaggcacagacttgtgtatttgctgatccctgaggggaaagctgtgattcaggctctgaagtctaagaattgcagacttagtttcttgtctcccgatgaaactgctaatctgggtgccaatggtgtttctgctacatggacacctgcccacacagcatgattagaaattataatgatgacgacgatgagtcttccaggacacccacgttctttgcaagatatttctgctaatcgtttctaccagaatcagttggaaaacttttttttttaagttttttttttttctctgtatctaagtcaaccaaaaatgctggtctaattcaggtatagattaaaggtttgtcctcaccattaatggtgtgttattattcatgcagggcatcctagaaccttgggcacatagtgtaatggaaagcacgctgggccagggagatgtggattcaggcttgagcagtgccaaaaattttcgttatggccttggtaaaggtgatttcccatctctgtgactttgtgtctccttctgttaaatgggcattcaaatcttttgtacctaacttattagggccctgataatcaaattagccaataagtaagaaaatgttttcttaaccacactgtaaattaagaggattcatattgaaatcacttttccattattgctgtcttagcctgctaaagttatatttagtgtagtgcaactaagcagggttgtgagagctgggaaggtagactgttgtattgggcagggtcagggcagataaaggaccaaaataatgcctgaaatgctgtattaacctgctctaccttgaactgctgtcttgaattggggggaaaaaatgaagctctgaggggatggtgcacagggagaaaagagagaatctcaggaattgaaagtctcaatggagaagaggtgggagaagaataggaggctagagtgagggcatgtgatcgtggagtaccgatctggagacaagagaagaaagtagaaaaatgccagcactgtctttggaccctgtgtatctggagtgtgggaggacaggcagacacaaatagagaggctctagggaaaacagcattctcatagaagatccttctccacaaaaagccctccaaatgtcctccaggagggtagaagctggttttaaagctcctcagggtcaggaagatccttctcttatttttctttgcatcgtgcagtttaatttagcacagtactttgctcacagcacttaaaaaattattctgggccttgctttttaattttaggcccaaatacctgaaaaaatgttcaggaggaattctgataagaaagagctaacttaggcaattccatttctttttttggttcactgtttcctcatctgaaaagtgttgggctccatgacgtggtttctatgacactcagtacctttgttgaagagaaaacatttttctaaaactaggatttccaaaaaaacaacaacaaaaaaaagaaaaacaaaactcatgaatatgtggatatttttgtgatagtgatgaaggtttgggaatggagtagaatgtttcctaaagtccttttcttttagcagaagacttgagtttgtaaactcggctcatataatttcagcttgcctgtctaccttccttccatctacctacctacctacttacataagtacctacttatatatggagaacacggtggaatttaatttttcttattcttttcgactttggttggcttggtgaatcaagtaaactgtgttgaagaaaaactaacttttgagggaaaaaattgaaaaaaaattatgattcttttttttttttttttgagacggagtctcgctctgtcgcccaggctggagtgcagtggcgcgatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccgaagtgctgggattacaggcgtgagccaccgcgcccggccaaaaattatgattctttgaaaaggatttttctcaggttagtttatatagtttcacagatgcttgagataaggattagaaagttcagacactgaatctccacagacccctgtgaatgtgttggctaagcaccttgtcttctcaggaacacacactggaacagactttctttcagtaaaacagggccagaatagtctttgaaacatccaacggtggtttgggaagaggattctctatataatgcctgtccaaatacagaataaaaattttcaacaattagcaaaaatgtggatttttcagttaccaattccttatttggcacagttggtctttctcatcttattcattcattcatttatttcattttatttatttacttttaaaatacttgtttaattcacctttcttgctcccattgagccttttaactaatcaaatgcatttgaaatgctattaatttatgataacagtaagacccaagacatcactttatgtaatatcttgtattgtagttcattgttgtcagctctttttctgatggggttttgatttagctggaggcagtttaagggtgttcattccccaataatgtttgtctgttgaagctggtgagctagactaacagtacaaagagttcctgtgtacccttcacccagctttccctgatgttaacatcttatataaccaaagtatgtttaagcaaagaaattatcattggtgtaacatgactaaagaagtgattatatcttttattggcagttttccagtttttccactaatgcctttcgtttttttcctagatctagtttaggatgctgctgtgcatttagtcatcctgtcttctttgtctcctcctgactgtggctatttctcagcctttccctgtttttaggaccttgacacttttttagtgtaacggtcaggtattttgaagaatgagtgtcttgcaacttgagtctgactgatgctttctcatgattaaattggggttttagatttctgggaagaccaccacagaggtgaagtacgcttctcattgcttcatatcacagcgtacatgatgttaatgtgagttattactggtgatgttaattgtgatagtggccagttttgttttattttattttttaatagaagaccagttgtctgggactatacacactccaacacatttgcaaattggtggcaatgattattgactagtcctcaaactactaacttcatgataatggaaagccgaaactcccaaatcacatggacctcaaagttcaattagaaaatttggttaggacctgacgacaatgttgcgatttgctacagcctgccctgcagtctcaactctggggtcccctcagtggtgagctcagtcacagtgctgcttctgtgtatacttacccagtaaacaacccaggcattggggcctgtctcagaaaccacatctccaatagaaaggagaacacttgggaaagcaggaaggagtaagaaacggaactcgcccattcctgacaactaatccttttcctttctaagtatggcttagtggatgtcagccattcactgttcaggacaggatagggatgaggagagaattctttttcatttgacaaggacattgaattttccttatccatggatcaagactagaaggtatggagaggaaaagggcttctcatctctttctttcagtagcttcatgcactgatgcatcgtacttactgaatgttttaccttctctgtgctcttctcagaggatgcacagaggattgggaagaggaagtattggtgacttgatctagaaaaaagagattgtttcaagccacaaaaagtttgagggtaaaatctcaagtcctgtgtgtgatgaatcagtagaaaaggtatcccagtggccagtgtgagtaagctgtcatattttcggtagtaatccttggtcctgtttgattttcctcatcctcacatataagatggagccatttctccctctggcgtttgccatcacagcgtcctgcagtctcttggtcttgagatagaaggttgagagaaacactttgcagtattgggagaactgggtctgcctgtgggagtacttgtatctcaatcaatattacagaacttggctccttgtttccaacaaatgttttgctctgttctcatcctgggagttgaaggttgaggcgaggtgggagatgtgctgtataatatggcagccactaaccacatgtggctgttgagcacttgaaaggtggctagtgccacatgttgaaaaataatattttggatatatttgtaaaataatttttttcaatgagccttttgaaatgtggctactagaaaattttaaatggtgtatgtggctcctatgataattctattggatggtgctggcttagagcctgggaagaacatggatcagagtcaattgaccttgtgttctcccctgagttctaataatattgtcattaaaaggagaagcttcaacagccataattttcattttaaaaagtctaattcagaagaattggctcattttatattattgcttggactggagaaaaatctgacatttggtattttcataattgagaacataacttgctgacttaaaaaaaaaatcacaacattttgtgcttggccttaggtaccagcctttgagctctttgaaaatagggattgggtctttttctctttctaccatcctttttcccccaaaaccacacactaacacgtagaagatggttaactggcatttgttgaaaaccaaaataactttaaatagagaaaactttgtgaagctaccttgtatttatggttggaagagtgaaatacctttataaggcatcccattttcttaagatagccagcaaaaatgaagaacattgatccaagtgtttatttacttattgatttaattaccattctcatcaggtgtccctgtcatctcagcttatgataaggaatcttttcaagatgcttcacctcatcactctctaggtaaagggggacagaaaaggatgctgcttacatatacgaatccccatctttgctcagatattatgtctaagggcctaaggactggataatcttattttttctgtggcttgatcctttccaacatttaatctatggaggttgtgaggataacaatgaaaaggcaagtttaagcttggactgtagatacttttcactgggtggttttattttattatgcttcattgtgaaccagagcctctgtgaacatatgacttataggccctcaggcttccactgtgtccctttccctgattcgtccttcttcactgcatgccctggtgttgggtgagggagcaggctttatgtgatgtcattttctcagagccctgagctgggaaattcaagagtctccatgattcctagttagccatggaagagaccctaactggtccctcaggaacatgtttggttggtcagaggtaactcttatagaatctatgatggcttagtcgttcactcttcctagaaaagacctctttaaaaaggccttttggttatatacggcctgagttttaagtaatatttgcaatgttgattctctggtagaagagaatgaaaagttgtgagtgctcttggaagagtgccggacagctgtagtgatgggaaaagtattggccttggagtcagacctgtgtttacttcctggctctgctattttctagttgtatgactctatgcaagtaacttctcatctctgagcattaatttcttcacctgttcgacatagacaatgtctgcctcacaaagttgtgatatgttaatgtatgtgggatacctatctcaggacccaatacttagtctttataaaacactaaatgaattggttttctcatgtatgtcttatggttttgctggtgatggaccaataatcatcttccatcttcactttagaggtgggggaaaagggcattagagtgattgtgtggtaaaatccactctaattctagctgtgagaaaaagagcagtgaaaatgtggtaagcaagtgcttctaaaaagcttggactaaaagcgcttgatggatttgtgctggcttcccggtagactcatctctgtactgcccgcacagcacaattaattgttgttactagagaaggaacaaataaagaaaagagagagagcagacataaaaacatcctttcatctttctgaagacagtcccctttgtcagatcagtggagctgtacctgtgaatcaccttgggaaagcacagtgtgggtaactagaaggaaggtcttgtggctcattttgtacccacttcctgggctggggaaatatctaaactaacctttcttacttgtcaatatctactaccgttcaccatgcatcttcacagatgagggcctctttctcacatcttcactccaaacacattactgtgtagacagccacttattttctgggaagaaaactttgcaaagcagtagcagaataaagtcgagggtaaacagaggccatggaaaagcactagagtttgagtgcagagacatgagtctgagcatgagcagtgaatagctcatgaaacactcaagttgcattctccttatgtggaaataaaataagtcatggttgttctatgcacgtggcacctgaccttgggtccttattgctatgctgctagagtctatgaatcaagatttgccagttgtgatcttgaaatttagtcagattaaaagggaactctgactttgagggtgaatgccccaagtgggcatcttattctcctatggattcagcttgttaggcagaatggaagtggaggtcatagattttagggttttctcctgggattgaatccagctgaagcaggaatgattctgggtgagctatataacgtctctgagcattagtttgtcattttcttacataggaatagagttattgccagatttggagatagtacatgttgcaatgtggttgacacagaataagctttcaataaatgattggtattgttgttgttgtcgttattatctataactacaataatttccctagccttattttatagggataggttgtggcaacatgaaatgtgacttggaaaactgatttgcactagatagatagaaaccatgtttttctatctatataatgaacaatgtcatttaagaaagcttagaggcaattccaccagcaccatcttcttttttatttccactcctagattatttgccctcaagtctttggtaatttctttttgccacatctcttgaatgtttcttctttactatattccatctattattaccataagtccaacgttcatcacctcctgctccactgttgttcctgtctcctggctctcctagagccttggttctcaaagtgtcattcacagagcagcagcagcacccgaaatgcgtcatctcaagatctaccaagacctcctgaagcatgaggcatgttcacccccgtgttgtaggacctccatataactcatttaactacttctcctgctcagagtacatgcttggccagtgcgtgtttgttctgcctccagaatgttttctgactctgattgctatcattacttcttttgaatctacctaaattcaagttaccatccattgccatgactatggcaatagtctctgaaattgtcttctacttttatggtttccccttgtggcctttttccacaccatctggagagatctaaaattgttggtcagatcatatcacacccctccccttaagccatacggtggctgctgtagtatctgcagaaggtccctgacttatgatggtttgacttacaatttgtccacttcacactgagtttatctgggtgtaaccaaccccatagaaatcaaggagcatctgtagaaatgtttgaaagaccctttcatggcctgcaaagccctgtgagatgactctatgttctctcctttttttttctttctttattttttttgagatggagtctcgctcttgtctcccaggctggagtgcgatggtgcgatctcggctcactgcagcctccaccttctgggttcaagcaattctcctgcctcagcctcccgagtagctgggattacaggcaccagccatcacgctcggctaatttttgtatttttagtagagatgggttttcaccatgttggccaggctggtctcgaactcctgacctcaggtgatccacccgcctcggcctcccaaagtgctggaattacaggtgtgagccactgcgcctggcctctctgcttttttcataccactcatcactttacacagtaatctgtagacacactgaccttcctttagccctctgtataagccaagctttttcccacttgatctttctctgattctgtgcaaaactggcttggaagtatctttcaaggcttagctcaaatgttatagccttacctagctcttccccattctttagctaaagtagcacacatacccccctccccatcattcttctgtcattatcttgctttatagtctacaaagcatgtatggttctctaaaagagtgattaccatgcttttgttttctttatgtacattgcaaactgttttggtgagaaatattttagtaataataataatggtgaagatttagtgagtgtttgctataggctaggcacactgtatggtaaattaaataatttaatagatcatttatttggattatttcattctatttagctgattatatatttatattttttgtgttcctcttgttttaggatatcagcttcttgagagcagggtccatgtttgttgcatctgtatctccgcctgtagaagattctctggcatagggatttttgtgcaggaagtgtttattcaggaactgaatggatctcagaagattatcatttgggaatagatctacatgacaagaaagaacaaagagtctctctcattctttttcccagatatatcccgggagaaaataccctcgactttttcttatctttaatctgagaaggaagcagttgttggaatctgatttaggattggctctagtggccctgtgtgcagacacagatcttgggattcatctgaccatttggggagagaggttcttgaggggcaccttgatgataacgagtctttctaaagctttaagtttggcgtttgaggtggttggaaataccaggtcttccgacttttacgttctttgtgcgcacgctggtgatgtgcgtatgtgaacctttattattatggactcagccagcagtaaccatggtgagtagacctatcacacagcatttttctgagtcagtttaaaatgctgacaattaaatataccgtactcttttaagcaatccatcagtctctcttgttgtcatggtgaccggagtatatttagaaatgtgacaagtacactgagttcaattgcacttttgccaaaacatagttttgcagctaaaattgaatttcctgattgaagatccaagtgctgttaagggggcatgatcgtttctatacattattctggaagtataacttaacgttattctgttaaatccacagttacgagtcttatcaggtattgatagttaaagtggttgtacttaaagttgatgaaataaagtgaaataaaagtgacatgatgctttttctattgaaaatgaaactgggccttactaatataactagtttaatgattagtttctttatatatttataaagacattgtaggtatgtacctgtctgttcttcagaattatatttctaatttaaaattatatatcatggagatcctcccctgtttcctgcttgtattctattcttagtattgtgagggcattcttttttctttgggtctgacctctgtttgataagcattcttatttttcctcaatctcaattcttctggattttaaatgaagtaaagagacacaatgaacgtgactttttgcccaaacaaaggaaaaacgaaactcttctctttattcaagaatgtagattaaattcttactttcttatcatcctctgtcctgtcaacatagtgctgagaatgatgttgtgtatcaactcatttgaccacataaagtttaggaattaatgtagtggctgggtcatgattacaacactgatttcattcctggccaaagactgattcttctgctcttgaggtgagaaaagccagtactcctggatactttcgcttctctatttttatctgactgaatgagtctgcaactgggatagtttatgagcctctaataatatacggttagactaccattatctctttcgtgaacattgccaaaagtgtttttttggtaagagatatcttagttataataacagtttgtaggatttatggagtgtttactacatgctaggcactgtatatagtaagctccttaatggatccttatattggatctacacagaaatcttatgaggtagttcccattgtattcttattttacgttaaagaaacaggtttggagagatactgtcttttgaagaagcatataagtggagcagtagtggagtctgaattctgatacaggtcctagtaaccactgcctgttccatggaaggcacacagtgagtattttttttactgaccagtggcctcttgtatggtgacatcatacagatgtttcagtgtttccagaggctcaagaaagtagcagctatataaagatagacaggtagcagcgtctgaaagtagagatgagctactctttatctttcctagtggtttagagccaaagtagattagtgctagggagagagggaacataagtcctgtctagttcagtggtttcatctctgaactcctttatgttcttaaaaatgagcttttgtttgcatgcattatgtataatgatatttaccatattcaaaaaagtaagaaatgaaactacaattttaatgaaaaatatttgtataaaaaataaatatatttgtgaaaaaatagtgacaaaagtgggagctggattctgcatttaatttgttgtgaaatattgttttgattgatgtttatgaagaaaatccagcctctcacagctatgtatttgaaaaaggaaggataaaaagtaattgtggattttcttctttgatactataccaaaacttgacagttttcacattacctaaagttagtagtttcttataggttagtttcaatgtggaatgtgaaatcatattaatggactttttataccctattatattaaaatccattggtcaaattttcactttgattgagtctcctatgattttgtaaaatcatgcattggtcatttagaaagtcgttggtcactcacttattcagttcttgcaaacactgatcatttcattctataatataaaaagtcatcttcattaatatcactgctcattcatcaaaaaagcatttgaaatattagaaaggtgtcaagtgcacagtagtagatgtaaggttttcaaaattctgatttttacttgaaaacatgaattttatttttggctacaaatactgttgttttccttgaaacgataagctctcttgctttatttttgagaaaatctccggcaaaacccacatttaaagaaccatagttcgtcagtcattgtttcaaataaaaatgatgttccatgaaaaaagcgattggttagcagctgtcaatttaaacagttacacaaagtgcatttcttagagacaatcatcgtagtttgatcttcagcaggtgtttcatggtacttcccagaggtcacacagaatgtaaaaaagatgtgtactcaagaatattaaaaatatgtctactttttgattatgctaacattttatgtgatcaggtttctttagtaaaacctagtcagacagtactcaaggactgagatttaataagattgatacgtttcaatgcattaaagagagtcttaagtgaaactggctccctgtcccgcttattgtatgtgtcttacagtgaaatcactcccttgattcactttaagactgcaacagtttttttacccactgttatttttgtagcattaatgtaaatttcaacacagggaaacggcttcttagtatgattatgaaaataattttgaacttgtggactcttgaaaggtctaagggactcctacacatgtatgggtcacacattaacagccactcattgagtccagtcccttcatttgacaggagaggagagtggtggaaagatgtgtctaagatggcagcacaagttagtggcggagctgggacaagaacctattgttacttaactcttctttcttttcttttgatttcctgctccactttcaggaatttaaaggtaactcaaggaattccaaacttctttgtcagagatggtgatgacaaatatatatagtttgtatatcttttatctgaaatgcttgggatcaaaagtgtttcagacatcagatttttcctaattttggaatattttcattaaacttactggtttacattcctgatcaaaaaacatgaaacccaaaatgccccagtgagctttcagcgtcctgtctgtccttgaaacttctggattttggagcattttgaatttcagattttgggttagggatacaaaacctgtataattattgaactttttgggaataattccgttttttaaaaaatgttaaaccttttgcatattttccctactctccgctcaccactactatctcttctgcttttcaatggtaaccactcatgcctttttaaacaaaacatgtgttgtatttgccaagacacaggggaagcgaagttaaaggtacagttgactgttcattttctgaataagatggaattctagctttgtggggaaggaagaatcagtgagttttcgttgaaggacccatgccattctttacctaaattaaagttgttaaaagtcacaggaaagaaaattgtgcaagcaattatcatcctttatatcactataacccatcttactaggcaaactgtgccctttgctccccaattattctctattaaagtttcttgctctccctccccatccttctctttctctctccctgtctcctcccctttccttctagaaagaggttgcccaataaaacttgctcttaactttgcttttggttatgttgatattttatgtgacttgttttcttcactaaacagtagtcagtctatgagactgtattgaagaatgctgagaaagtcaatagaagtggacttagaatactacatgttcttttaaatatgtctcttatgttatagagtaactttttggggagctaaggtttgcagacaatgctgcgtgtgaacatatgtgagtaaatctgataagctgtggaaggaggcttgcaaactttcaaatgtattgtgctttcattttcaacttaattggatgttcttttgcaaggtcttgtttttttcctagttctcattcaccgttcagttgccttcccccacctgtgagctttttgagtcaaactttgtttattagcttttttcctgattcttctttcatgtctttctttcctatcccaaagtatgatttgattagacctcaggttacccttctgaatgagctcttcctcaatcctaggcctggccaggcatggtgcctcatgcttataatcccagcaacatggtaaaaccttgtctctacaaaaaacacaaaaatgagctgggcatggtggcccatgcctgtagccccaactactcaggaggctgaggtgggaatatcacttgagcctgagaggcagagattgcagtgagccgagatcgtgctattacattacagcctgggcaacagagggagatactgcctcagaataagtcagtcagtcagtcagtaagtaagtaagtaagtaagtaaataaataaataaataaataaataaatacgtaagaatcctaggccttggtgacttactctttttaattttttttcccacaaaactgatgtgttttgcccttactttcaccagaagaccatttagtcttcttattttttcttcctgagacttctacatttgtttttttctagccatttatattaggctcacaaattgcatagtgatagctgattgaccccttcaaaatgcctgttttctgcctccttgtctcagcttcttgaggatggtgctatctcatgcttggtgtatcataggagccccatggatatgttgaatagattttgctcaggggtctcctctttagagagcgttcttcacatttttatctggagatctgagcttttatgtatctcccactattgggctgctaaatctcccaaacccagaattgcaatgtccatcttttaatgcagactcccagccactgccaggatatcacatgtcttctctgacagatggctatgtagcctccacttgaacttttgcagctctttgcaaggcaatttgttctactgctggacagcttcatgtttaatgtttttccttgtattacactaaaactgattttcccattattttaatccccatatttctagcattgcatagtttgaaaaagtataatattgcttacacatgacatgtccccagatactcaaagatagctctaattcccccatctgcctcctttcctcctttagaccttctcttgctacttacatcccatagaaggctttggatgctcatcctcttggtgctttccccatttctacatcactttctagattttggtcctgatgtccaactctaagggactccctcaaggccacattttatctctgatggtactaggagcagtatgagtaaatggtatgtgtatgagtctgaaagctgagatatgaattctggtgcttattagatgtgtgaacttgattaggttacttaatctttctaaacctcagtttcccaagatgcaaaatgaatataatattaaattccaagactatttttaaggattaaagatataaaatgcttagcttagttactaaaatatattatgtttagcttgatcaattatttcatcttttatctatccaacaactccttttctttttcacacatgtgcacttggttttaaaaattatttcaagagttcttccctcctcctttccttctctcttttcttctctctttaaattttataacgtatatactcttataaaagttaccatcatgtttagatttccttctaaacttttatatctagaatttaacatgattttcttgacaaatatgttttcttctatgtgaattttcgcagctgctgcctacatttctgctcatgtgtttagcctctgttaatcttcctgtgaaaattgtgacttcatcctgccaatgggttaatgatgactggctcattgcatgtcacttaactcctcgctaaatgcttcacttgatcactcagtaactttacaatcatttagttgtacaatacatttaaaaaaattaaaagttcaattaatttcaatttcacaaacacttactaatcccatcttatatcacatgcattaaactaggtgtgtgttatagtagttgcatagaacattttgttcatttgctcattcattcattcattgaatgttcttttgagtacatactaaagaccagatgctggatagactttgggttcggattcaagaagctgtgttagacaaagagcctctattcaagatgcatgatcaactaaaagtgataaaacaatatggtaattttagtgatccagatataaaactaggcattatggtagttttaagaaaggctgcttcatcgaacatttttgcattaagaagcttcttatcggggagacactaaatgttgagtagggcctcagactctactagaaaggtaagacccatattagggcttggttttgtttgattataaagccattttgtgagaatcaacctccaggctccatgtgttatctttggctcctcaccttcacccccaccctcccaccccagttgcatgcatgccatatttttccttcttcttttcaataaggaagcatcagaatcaacagaataacataaagataggtgtggtgacattataggctcacttctggggcgtcattattacattaatttttctatatttccaagtaagaataacaatgtaagtacataaaaataatctcatgatagtagaacatattgcatagtatttctctattcatcattccctttacttcttgtagaaaagcttagtgcttgtggatttccttaaataagtgtcttaagcactgtatctgatctgatagatattagcacaacaattggcactgagtaattatatttggagaatttggaaggaattttttctctattgcaaagtggtcatgctgtgttgtctgcttttatttatatcacaagaccagatctgccgttaactagatgtctaggaaagagttcctttactactctgtgccttagctttgtcacttgtcaaacgagaatatactaggaacagtatcagttttgcctcactgagctgcagtgaagaataaaatcatttatctgtgtgaaaggacaatgcatacagatggtaacaattataaatattaaactaagcttttgagtgaccggattggctacttctcttaaagtgagttctgcttaattagttaattcttacttattgccccaaactttctgagatagcttcatgtttttttcctctctaccctgaagtgcctgcttgcaagcactatatgctcaatgagcatttgttgaatgaattttttaaaagtatttaccttttttgcttttattattattttaaattaacacataattgtacatgtttacggggtacagtgtgatattttgatacatgtatacaatgtgtaaagatcaaatgaaggtatttagcatattcatcacctcaaacgtttattatttctttgtgtttggaacattcaaaagccactcttctagctacttgaaaatatacaataaattgttggtaattatagtgattctatagtgctgtagaacactagaactgactcctcctttgtacttttgtatccatttaccaacctttggctatcctccccctcctgctacttttctccacctctggtgatcagtattttactctctatgtgatcgatttctttcagcttccacatatgagaaaggacatgtgacaaataactttctgcttctggcttatttcacttaacatgatgtcctccaggcttatccatgttactgtgaatgacaagatttcattcatttttttatggctgaatagtattacattgtaaatatataacacattttctttgcctgtttatctgttgatggatacttagattgattccttatcttggctgttataattagtgctgcaataaacatgggaatgcagatatcttattgaaaatgtttttttttttttcctttggatatatgaccagcagtgggattgctggatcttacgatatttctttctttttttttttttttttttttgagacggagttttgctgtgtcaccaggctggagtgcagtggtgctatctggctcactgcaagctccgcctcctggcctcctgggttcaagcgattctcctgcctcagcctcccgagtagctgggactacagacgcgcgctaccacgcccggctaatttttgtgtttttagtacagacggggtttcatcatattggccaggatggtctccttctcttgacctcgtgatccgcccaccttggcctcccaaagtgctgggattataggcctgagccaccatgcccagccaatatttctaattttagtgttttgaagaacctctatactattttctataatggctgtactaacttacattcccaccaacagtgtatgaattcccttttctttgcatctttgccagcgtttcttattttttttgtctctgataatagctattctaacttgggttagatgatatctcatggtggctccattttctgtatatggatgtccagttttcccagcaccatttattaaagagattcttcttgtttcctttgttgaaaatcagttggctgtaaatacgtggatttatttttgggttctctgttctgtcccattggtgtatacgcctgttcaagaactatcttgaataaaagtggtaaaagtgagcatctttgtcttgttccagagcttaaaagaaacctttcaatttgaacgtgtccagtatgttgatgactgtgggtttatcatgtgaagtgtttattatgctgaggtaaggtatgtttcttttatacctgacttgagatattatatcatgaaggaatgttgaactttatgaagtgctttttctgcatctaatgagataatcatggtttttgtactttgttttgttgaggtaatgtatcacgtttattggtttacctgtgttaaactatccttgtatccctcggataaataccacttgatcatagtaaatgctcctttaaatgtattggtggattcagtttgctagtattttgttgaggatttttgcatctatgttcatcagagatcctggcctataattttctttttacatgtttgtccttgtctggttttggtatgagggtaagaatgcattcatgaaattctttatttttgagatttattcttttttattatgtctatctttgttgaatttcttcttcatattgtgaattattttcttgatttagtaaaattgtctatctgtattttcttgtatctcactgaggttccttaagatcattattttgaattccttttctggcattttattgatttcttttttactggagtctgaaactaaagagctacattcctttggtggtgtcatattttattgctttttcatatttcttgtgtcagtgagttgatgtctttgcatccggtggaacaattacctcttctatacaaactttctggagtgattttcataaaaaaagacttccgcttgcaattagggttggtgttacagttgggaggggtgtgatgactttgtttctgaatagatgcagtgatagggtctccatgcagcttctaaagctacgttcaatgtcagcaataactgtgggcacctcagtagcttaagttgtagaaatttgtggcagtggtggtggtggcatagattattaatgtcctcagtgtcaagggcttttgaggtcctcctattcttatttttttcataatggggagatttagccaaggggactgctcttcatgtcagatatcacatgacctacaagcaagtgcagtggtgctgagttctaggtgcaggtgcttgaagtggctgtgggactagagtcttatgcccaggatcttgccaacctattgtgacacctgggtcttgggttacaggttcactctctgtgctagggttggatgtaggcttcccacagagccaggatttgtgactctgagacattactctacaaactcagtcccagctgtgagtggctcaactccaggaaagaaggagtgcagggaagtttggacccagagagcaggatatgccctgatttggcaacatgagccagtagggttcagtggcaacttggatctcaggggatgaggcaccatgtagtagtgattcttgacccctggatgttgggactcagcagtaccttagactctgtaagaccacatgcggtagcagtaccccagaatggcaacatacagctgttacttgtgccctgagtgggggcagagtacagcacagtggtggctgtatgccacagggagaggggtatcttagcagctctgacactaagcaggtagaccagctccagggaaacagcgtattagagttgttttccctttaggctggagtgtctcagatcagcccagccactgctcagttttccaaggatgtgggttatcacatcagctcagctttgggatttacagctgctcagctgagcgatggcaccaattcaccaagggacaatatgccacttcagctcaggcctgggggacatgacttttctaggcagcccaggtaccatttccctgggatgaagggtgctacttcagattaagtactggggtgcgtgaccgctctgagtggccaatgtactgttttcccaggaggcagggtactgcttcagcactggcctgaaggggagggtgaaaggtagattaagtgactctaccttcacctgggcccatggggaagagtggaacagttgctggcagctcggcttggggatgtcgggccactgggttcgggtggttcaacggtagcttagccttagtgatggagtgtcatagctatgcactcccagagcaagagacactccagccaaagctccatttccaagacggcatagcgcagtagctgcgcaggccacagagggcaggtcacactggttgctctttttcttggggaagcacggctatgtggacttcaggcaggtccctcagctgggacttggctcctgtgaggactacatgagactccatgggtgaggtctgtagctgttcaaggtgttgatggggcttgctgggatccttttgtgtaccattctaccctagagagaagttcctccctgtttccagcagatcccaagtgggtgatgggtggtaaagaccaggtgttttgtttctattctctatgtggtcattctgagtttcttgctatccagggtttctgttacttctctgatgcagtctggtacactgccttagttattattttttcttcttctgtttttagttcatctttttgtttttttctatatagcaatggggtttccctatgttgcccaggctgctctcaaactccagagctcaacagatccactcaccttggcctcccagagtgccgggactacaggcacgaaccatcgtgcctggcccagttatttttgttaaagtttagttgttgattgttgttgtggctgtctttgtgaaagagacgagagctaggggcttctggttggccatgctactgatgtcactcttaaagtacttatctttaaaagtccagtgctggagatttgtaagctacttatatttctgctcagaattcctaaagtctctcattttatttctagattatacattccattgatagagcccttataaatataacattaagaagttgagcattacctttaggccaaagcaatttacttttaaaaaatctgattaatttcaacacaatcaaccagatgtcagaagatttcagtgcctctgatagatgctgacaggtgtggaaattaaaatcagagagggaagcaattaaatcctggcaaacattactttaatgagacaaccaaatcataagctatggaataccttgtattcttgataagtatcttagggtggcatgagagtgcactttaaattgtatgtggtatttgatgactggaatgcagggcagtccatatttgtcatctaattcctttggcctgatttaacatttcagttgcttctggggacagacttctatgtttaaaacattgttttattttaataaatgttaggttaagtaatccttttactactacctctgttgccacatgaaacttatgaaaatgaccaaattattattggccttttcgcagtggttttgggataactgtgaaaagagaaacacagaatgtgtattttatgcaacttctaatcaaaagatttgataattacagcactaaaaccagaacccagttcctccatccccatttcattattcttttcaatatgattccccctattcggaatgaatatcttggacaccagggtgaaagaggtaccagtttattgacttagtgggagtttttataagatactcttatattgcttattgaggtactaaagcacttacaaaatatcaagtattttgagttagctttacactggttcaataacacttagaatttttgttcataatactaagataatcatcttagggatggttacattttgttgtgaggtgtggtggaaaattcaaaggacaccatggtttgtgaaaaacccattgcagctgatctctgcacttttcatttccatgtcattccattttcttctgctttttctttaccccctgttattttcttgcttctctctctttattatcttaccttcatttactccatcctgtttttctccaaaatatagttgcttctgtaaaattgcttctgagggtgagcatatttttgaggggagagaggatggatggtttgacaaaggatgcagacatgtcaggttctgggtcagcagttagttataaaatacacagaggcagccaaggataactggcttcattaccaaaaggctagagtgggatttgtcagttgtcccagatgtctgtatggaattatggaaaactccattgcattatgaaacactcaggagctactcaggacacatgccactcaatccacgtgaagagggctggtgaacttcttagctagaaagacttcagctttcctattgcttaaaatgagactgattggtgaaggatttgtattagtccgttctcacgctgctataaagaactgccagagaccacgtaatttataaagaaagaggtttaattgactcacagttccacattgctggggaggcctcaggaaacttataatcatggtgaaaggcaaaggaggaacaggcaccttcttcacagggcggcaggaaagagtgactgccagcaggagaaatgccagatgcttataaaactatcagatctcgtgagactcactcactatcatgagaacagcatgggggaaattgcccccatgatcggattacttctacctggtatcacccttgactcatggggtttacaattcaagatgacattttcggtgtggacacagtcaaactgtatcacactcttcacaaaacttcactggtacagacttgcgtatatggcttgtgcttcgacactttgcccagggatgttgcatcttgaaactttcctggtgagatctgagaaagtgtttatggtaacactgcatcaaacactccttttgccttagcttagtaatgtgtcaccttctggttagaccacagatgtgaagtctactctttctcctttcacttgctaataaagcagaacttagaactaagtgtgtgttagtgcttcgacaattgaattttctgtgctatacactcggtttccctttcctgaagttgtttagttaccctcttcaaatagcaattgggaggctacgtcatgtagtaggagggtgcttactgattttggtatcaagatacagtgttacatttttatctgctccatgttaaccatgtgatctttgaagtttggtttttgtatttgtaaaatttgggtaataaggtctcattggagttataaaggggatggtttgagacataatggtcattgtgatttttcaagctataaaataaagcatgatgttaaaagatgattaatgttttcatttggtggtagatgacaagtttcttgcagggcatctgatcaatcatgctctttttttttttttttttttgaaacttttattttaagttcaggggtatagttgcaggatccatgttcttttcttaacctgttttgagtcctttatgtaaacgggacattttatcaaaacttcctagaagtcttatatttctcaataaatccatccattctattaaaacaaatttgctttgttcttagagtctggtggaaactccaactctctgaacctagggcatgattatgggcacaaagttgaaaatgatgtgtgattcatcagcaggtctttcaactaaagcagtatctgttttgctttttaggggtcaaggaaacttttgattttaaaatcttaaaagtttttgggctgtctcttgttagatgaggtcatgtgagagtgacatagattaatatttcggtgttttaaaactaggaaacataagtcaaagagatattctcttgcctaatgtgcttataatgttatcttttgatcatataaatgtggatttatgggaagaaatgttatcactgctctctataaccatatacatggaataatggagagaaatcttatttaaaaagtttaactaagggcaactttggctatggagtatatatcataatcttcacatacatatgaagaaattgacactcatggagtttaaataacttgcctaaggccattgattaaaggaaatctgactggctcgaaatcctatgtacttttcccatttcctcatttcaatcaaatagctggttttattttattttctctctccaccaagccttgtgaattaagacaatgagttgctgtttgtctttgtctttccctagcctaataacctaggaaaaactgaagtagaaaggaaggattactggactagcaggcacaaactttggctccaaattcatgccctgccagatactaaactgtgtaatcttgggcaaattactttccttttgtgaacttcagtttctacttctgtaaaatgtggacaataatattcattttatatggtttctgtaaagttaatcatgaggatggtgttagttcctttctcatcctttctgtccctctttgagcttctgtttcctcacctatgaagccagtagaatcatctcttcctgcttcttcatcgggttcctgtggggtgcaatgaatgtgaaaatgttttgtaaaacaagaaaccattatgtagatataagaggttatgactattaatgaataaatatgggtttggtgtctggaagtaatttttacttatttcatttgtagacactagcattgcagttggctgaaccttgtgtcaaccatccattccaggagccagctatctgaggtaagagaggaggcgtgtcttcttgtttatgaaatactaataggcatctgagccagtaatgttgattttagaagaaatacaaagaatagaagaaatacaaagtactttatgaggaaaagaactgaaaaatggccaagacagtgagctgacctctctttttatttttgtttttttgatttatttttttcccttttaattcatagcccttaaggtttaataccaaaaccaaaaatctgggccacacagacgattcagatttaatgtgtatgtatttaagtgtccataaaatgcaatggagtagaatgtgcttaaccattattttattgtatcctcaactagtatgtggcaggagggctttttacctggtttcctaacccttgattgagcgcatttttgactacactatactgccagtgttacctggctctgaaggggccaaatatttatggctgggtcagtcactctctcttagctgccaaacaaaatcatctcaaaaagctagaatccaaagccacaacagaaaaatcctaagaacacagaaaattgagttagtcttttgaaaccttgcatccattgtatctgaatgccactctcctgggggactgttgggaatgacaccaatccttggcagaagaatacatttgtcttgagtttgccaagaaaatggaggccaatggagaaaaaacatttaaaggaagcatcatagttgtaaaatttaccagatgcgatttttctcctaaagtcaacctgctgaatctgtaccttctaatgagctctactgtgttttatgtaatgtaacttaaccaaaaagaggtgaagtagtcaatatgtagaatagtaactttgtagaagatttgatatcattatttagagtactatacacatgtattctgctgaatattttgttaattcctttggtatgttatatctatgacctcgaactgcaaccatgacttcagttgcacagacctttgagaagaataaaattggttggtattgccccaaatttgtaggacttagaaaatttagaattgagaggaaattaaggtgtcaggtttacatgattttcaaagctaatatcatatatatataataagaacacgtgcagacaaggtaggttatgtatggactatgaaatttctgtaattaaaccagacataacagccacttaagttatttagattttcttctcattcctacaaaaaaagaacattgtttttatttttattattatttatttatttttcaagtggaatataagctagtttacccaggaagttttttatttatttatttacttattattttactttaagttcttggatacatgtgcagaacatgcaggatttttacgtaggtatacatgtgccatggtggttgctgcaccctatccacccatcatccaggttttaagcaccgcatgcattaggtatttgtccttgccttgccctccacccatcaacgggccccgatgtgtgatgttcccctccctgtgtccatgtgttctcgttcaactcccacttctgagtgagaacatgcggtgtttggaagccatcattctcagcaaactaacacagaaaaagagaacattgtttttaaaaaaggtagtagcaaaaaatgtaagaatggctcctgtccaccttttatttcttttctagtccacaaaataaccctgcaaaaacttatttctaatgttttatttttacggataaatatatcagaaaagaatgtactgtagatacctactatcatagtttttgacagctctgtgaggcagagatctaacttgttcatttagaaactgcagttatcacactaaccttccctccgatgccaattgttaaatattaatagaataagctttgaaaagtaattaactgtatcccctgtccccacagaaacccatcttgaaactatcaagaggagttttaagcaagccctgaaaggttacaaaaattactctcaagaaagaggaattttctctctttctcttttcgttatattttggaggtggggaatggtagagagggaatgatagaaacctctcaagtaacctttgggaggtggagaagtaaatagtctgggagcatgctgtagaaatttaaaataatcctgtggcaataattggtatcagtggcagtaatgaagaaagaataacagtttcaataaataattagacttgacagtaaatgtgtcaacaggtacctacttaatgagtgtaatcattgtttttctctgctctcaacgttgatccactgactgcggtgtgttctctgtcccatttccaaaccaaatctatttaaagctgcactccacggaatctgcaacagtataccctgtttactatttagagctgatacctaatgttctttaataggcaagatctgtacttgaacgagaacaggcttctggcctcttgtagacggttgattatccctgttttccacagggtgattcattagcaaggatgaataatacccaattaaatctcatggacttgtctatattgccagagtgaattgtttattataatttggtggaaacagtcctggtctgctttaaataaaattaatcagttaccgttttttgaagtggaggtagaggcagtagttataagtgaaattacctctgtaataacctgaatagaatcacattgtttttgggagcaaagcagtatgttgtatgttatgtgcaccagaagccatgagaatccttttctaatcccagctgtaatgtcacctggctgtgtcacctaggcaagtcaccttccctctatgaggtctgtttcatcatctaatgacaaagttggaccagttgatcatggcattacttccggttaaatgttctcttatatatgattttatttcctagctagtcccttctctctcctggtgccatgtttccaaaatcataggacagtcctatgactctactgcacagccactgtggaaaattagttatttttctgcttagcttttgcttcttttacataccagacatgcagttaatgacttttattatatatactgtaagaatgggcatttatacaccggtagcggtagtcccttaccccagcaacttgcaattccttgttaggaaagaaaagctgttttcctccacatttctttactctgtgacattgttccctgatctgggtcttatgagaggatctggtaaacttcccccctattaagaccgttaggaagaggtggatgcttcttccattatttgatttttccagagcaaatcactggatctgtaaaggagatcagaatgtcaaagccagaggggacttcacgaagtaatctaaacaaattatttcatgtcacagatggagattttagtgtctgggagggaatctgatttgtctaaagtgtttttgactgatcttggactagaattcttctgactacatagttgtatctttaagtagagaaatctttttctataaactatcctttcacttcctagttcttaaaaggccattatcttccaggcaaaaccaatttcattttcagcatggggatgtgagatgtccttaaacataaatggactccaggtatcttcattaatttcatgaagacatggcacagagggttccggctaccttctgctttccgtgtttattaaaagactgtggattcccttgcagttcttcctgtaagaggttgtttgacgctgacatcatcactctcctccacccgcctcctgcccttttctgaatcagtgaattataggaatctgagaatgagctcctgtttcctgcacattgttggggaacattaaaaaaaagaagacagatgagggatttataagcaagaggacagaagaataatagccaacacaatgaagtctagttcaaggcctgcgattcccaattgctgggctacacagcattaatagcagtgtctctcaccctttcagacccttctctcttatttcagacccttctgccttattcttgtggggatgggctgggactgagaaacagctagtataatcattgccaaaatgaaactcacatgtacatgggggcttccaggtctggagaagagtgtagtaattgttacccatccgatagaaggtgcttagagaccactggacctaagcacttacctggaacctcacagtacagaggttcaaagagtagaaatcagttgactgagtctgaggttcaaatcctggctctaattaatttgctatgagtttagtgaatgcctaactttcctctgagctgcactttctccatctgtgagatgggaggaggagggtggcatagatgatgtcaaaggaaccctctgattttcatgagtctcagatttgcccaaggacctgcagcgaatgtgcagccaagccagatcttgaattcagagcccctttttctggtttgagatggtcatcattataagttccactacccatactttccaaacagtatgtttgcagctttcagccttgttttattaaatctactttttctcttttatttgacagtccctttctgtccagggacctgcctaaagtagcaaatcttttttttttttttttttttttttttgagacggagtctcgctctgtcacccaggctggagtgcagtggcacgatcttggtttactgcagcctccgcctcccaggttcaagcaattctcctgtctcagcctcccaagtagctgggactacaggtgcacacccccacgcccagctaatttttttttttttttttaagtagagatggggtttcaccatgttggtcaggctgctctcaaactcctgacctcaggagtccacccgcctcggcctaccaaagtgctgggattacaggtgtgagccaccgtgcctggcctaaagtagtagttcttaatatacgtgtgtgtatgtgcgtgcacacgtgcatacacatgatcctgtgtttggggcagatgtgaggattatggaattttcagaaactcagatgaatttatgaaatagttggaaaatgcagaactccagaaaatgctatcaacaagtttaggaggtttgtagatgctctgaaggccatccatgagttaagcaaaagttttcattctatgtgggaagtatgagatgacatttgagtggcatacatttccttttgctgttggattttccccgtagtcacctattgttatactctgagtgttaggctcgttttgtagcatgacttttggcatgtatgtatctcaaactattgagtgatattttaatattgaaactcttattctacttcattcattcactcatgcattcaaattcaattttaattcagaatttgctaaatgctagacatctcaatacattattgtatataatcctataaaatagaaaattgctaggtgctcagagaggttgagtaatttgcccaaagttttacagctaataaatataaaatctggatttaaatccggatttactccaaaatatgtgaatacctccagagataacattgaagacaaatagagacaatgatgcaagttcataaaccatggaaatttctggtagaaaatggtagatgggccccagaggaatacagagaatgtgtactatgggattttaggaagggacaagatcatacattatgaattacttcatatcataattcgttaactacgtgtttatctggctccttaagaaagaataaaaaaagctagataatcatatgaaacacattatgcataactcagtttttttcttgttcttcaaacttctgtcaggttagtgctctcaatatcttcatttggtaagtgagatgaggagatgaagagtagttagggtcatagtgccctgatcatactgagttttcacctaaataggaatttcagtgctttgggtcatctattttgttcccctcctcccggcctacccccccattatattgagcttgagacttttaacagagataacttctgaccatgcacagatcagcacaaatgcagatgtgagcagctagaatttggatgctgccaaattgtgatgactgccacatgtgtgaagctaaagcttagcacctgatgacccactgtgagtgtgtgggggggccagaagagtgaaaggcaggtcagagatggaagacgcctcggagtttgtcaatggcagtaccttcaccttgcagatgcagaaatggaggtggttagaaggggtaagacttactaaaattcacacagcaggttaatggctctctgagaataatggcaaaacaagaacaaggctttataccagcaatctacagtagtatctacttttatttcctacctttccgttggcatatactcacactgataggcttgacaggcagataaacctgtatttgaaggtcagcaggattagttgtgtggccttggataagttacttgatttacttgggtctcaggtttgttgtctgtaatagaaaccataccctttttcttttctttctttcttttttttttgagatggagttttgctcttattgctcaggctggagtgcaccggcatgaccttggctcactgcaacctctgcctcctgggttcaagcgattctcctgcttcagcctctgtagtagctgggattacaggcatgagccaccacgcccagctaattttttgtatttttagtagagacaaggtttcaccatgttggccaggctggtctcaaactcctgacctcaggtgatccacctgcctcagcctcccaaattgctgggattacaggcatgagccaccgtgcgtggctgaaaccatacccttttaacaggactataccagtgtactgttcaatatacagaaatactatcacccatctgattaataatccttatcacagcccaatgagacaggcacagatgttctgcttttcaagattctatttcctaacttcatcttgacagttgtaagtctcttgcttctcaaagtttggtctgaggaccggaagcatcagcattacatgggagcttgttagaaatgcaaatctcagatcatactctagaacttctgaatgagaatctctactttaacaagagccccaggtagttcatatgctcattagtgtttgagaaacattcacttcggccctcgccctatttcaaggctattgctgtggtgtgctgacaatgcctggcatgctgccagcattcttggggcatgctgtaccatgccttgagatagcggggtccggggggcggggatgctgtgaagtcactccttgggaataatggaagactgggttgaagggatccagcaggctttatctttttaacacccttcatttccttagaagttactattcagaaggggtcaaactgggattggattctaagtctttctgatccaaagtccatgttcttttcattaaaccacgatgtctcagtcaagaggaatgctgggttgtgggtgataactgttcattccctgtagtgtgaatatttccacactggctgctttaccctattactcaattcctagaggggaagaatttttttaaaaaaatttaaaaagcctgagttgaaagccaggatcctgcagcttaatcagttatttttgctttttaatgagggtgactattgtgaaataagtaattattaattactcaaaactaatgaaatattttagtttccttgctcaaaaagcatatggatgctaaaagaaagcatatgggtgctttctgggaagcatattggtgaatggacaaattacagtggtgccaatatgcctttgctgtctggctggggccatcaaaacgtgtgctggcatctgagtcctcgtgtgtttaaagggattttttaaaattcccatttgataagtgcctggggttgcctctggagttacacagcgctgtctcatcaatctttctgccatgctttcactcagacattactggctgagtataaactcggtataaacctttgctgtaagtagcttctgtggctctttctttccagatgcctcctatcctctgcaataggttcagtgggcctgccccatggatggcacgtatggagactttgtctatacaacattttaccacagtggtaaaagcagtagccgaaaaggtggcagcactgagacctgtttgctccatcagggactctgtctgaggccctcggccagctgttgaattgctgcactgcaaatttcttacttgtaaaactggaatgataataccagtgctcctgagctcacaagcatgctgttcatccaatttgcagtccatgccctttgctcttcctctcctttccttcatgcctcttctcctttgctgcatgttcagctggtctagtaaaaagcttgatggatttggaggtggctgaaaccattttgcttgctctggggattgcacacttctgagcttgtcagaggcaggcaacatggcatgttttagaagatacttggctgagtgtccacgaactgtggctctcagaccaacgtgacttagtaatcatttactcaacacctacaagcaaggtagcttgctaagaaattgaaggagggagctggcgggtctgtggaggtgagtttgattcagggccagtcaagacttggtgtgatgtgtgagctcagtaattatactttgagagagacagaatttggagaactctttcctattggaggtttcttatagaactagggacaagagctggctttgaaagattattaattggactttgataagatattacaaggatttgaagagtaagtctctgtcaggcaaaaaccagcttgcagtgggactcggaagcaggcaaatatcaggcatggctgaagaactgggcatcaatcacagacatgtgtagctgagagaaatcacttccttttggtgaaccctagactctatctgcaaaatatgagctttgaacaagatagttctcaggaagcctcaagaactctagctgaaattctacaaagtctcttatcacacagccaggttatccacttagcaaaatcctggcactagaatagcagcaatggagcaaggcctgggacccaggtgtcctgcctctattttatattcttcttactgtccacagagcattatgatgaagataggtggggtggacattattattctagtttttaatgtatgaaacataggatgttaagggaatctaagacataaaacgaataagagatttaactatcccagatattgatcacccttccaccacagagggccagctcttataaaatacaccccttgccattttgcctgtgtgggccttgctttcctgcctgaggaaccagcacgtaccccttctcccacgaaagtcatccctgtctgctctttggctctggaattcagtcttagcaatggactttgttttataattaaactttattttgtattgccatctttccatgtttccacccccatctcatccctcatacatattttaaaggctttgaatttaaggattactttctgcttctctgagttccctgtagctcctggcacagggccccagacatagtgctcagtagagaagcaaatgactatgttctgcaatagtttttctctctgcctattgcttgtttctgagatggatatgagacttataggcttaaagaatttcggaactggaaaggaagttaaaacctatctagtccagctcccccaccccagggaagaaatgacttacttaaatttgcctgcatagttagtggcagttctgcaaatcgtgcccacatctcaccaagcattggagagatggttggcacttgagtctcttcttaggactctacaggctctgtctggagtccttgtttctatgaagaccactaagaataaaggtaatacaggtgctgctgctgctgtattaaacagatggaaagaagtagacattcattgtatgtctgttatgtgataggccttgtgacaggtgttttcacatagtttagcttggtcagtcatcaaaagctagaattcccattcctccatgagggagacagattgtttctaaataggacatttagcagaagctctttcctgtaagctctgaaaggcactcggtagtggatagatgcttccctcctagaacacgggtgtagggctctgcagagtagcatgcatggctcttctaagggatatggattgtagagactgtgaaaataagcagaagttgtgatcaaaattggcgttgggggacttgtggtcacccgagtgtaccagaagactgagctcttctactctcctttccacacatacatctgagtctttggagagctgcaacctgagtgcctcgttcttgagtgtctgtagcattggcttttacttgcacttactacattttactcctgcctcttccctagctagcctcgacctcaacgtgtattatttcctccccccttgtcatttttcttctattacttttgcttcttccccttcctccttctcctgacttaaccttgggtggccgcaggtcttaaggctctgtgatggcagagtcttctgtattggactgtgaagattctggcagggaagacaatacacaaatctgttaaatacacaataaaaatagcttatgatctatgggacttggtattaagcaagatgatattaacgaggtttgattgctgttctgaaatgtggcagctgcgcacacgtattggctgctttttctccccacctttggcagcttgtgagcggtgttgccatgacactccttgggctctgtttagatcagctattttctgaaggagtcgctgaccttccccacgatagaagctgttgatgtggtcacgtcagtgcctcttcgggagctgtgtgactggcgagccctcagttgccacttggaaacggttggaaactgtagatcaggcacagacattgaatgtttaggagcaagaagggcttgtgaatatcccgtactctcatttgatgtgtgaggacagtgaggcgcattatgcggaggtgacttgctcaaggccacagagtgcatagagagaaggctgggagaggaggtcaggtcttgtttccctgcttgttgatgttccagctgcacggcactgagccctgcctgagtgcgcacttcagtcctgaaagctgcagagggatgggctggtgacactgccgtgcctaggagtgggcagagaaggtgaagacacggagagtaactcagtgcagaggcagcgacgggaaagtgaaggagagtaagaagcccagagtaaatggccaaggtgccactaacatgtccatccacagaaacttttctgggggagaatgtttcttatcagattccgcagatgggttccttgagaagtgagtgcttaaaggggctgggatagataatcataatgccatgttctcactgctctgaacccttttctgacctcacgtaagacctcacctaaaacttccacaagagccgttcattgtcagtaccatgctttttttggagtactgtataatgtcaagtatttttccaatagtttatatgtgaaatgtggtctccgccacaagattacagggtcctcgggagcagaaattgtgacttaaatgggcctttctcccttccactttttattcttgccctaccttttaatcaggcacctggaagagatctaaacacaggatgagcatccagtaagtttttgttgagttgaacttagttggattcggatgacctctaaaaaatgtttactaattgctggtgaaaattggcaaatgattattttgtggaaaaatgttctcaccgaattagattttgttaagaattcttatgtgtgattatttttcataaacccaatacactgtctattattatccttattttacaatgaagaaaaaaaattcaattgactgctcaaatttacctctaggaacaggtgatggagatttgatttgcatttagatcttttgtctccaaatattgtaatgttacttctgctttcccccactacataccgaagaggtcttacttcattgacagtggttcagccttctgctgaggagtcttcagtctttttatgttgtaatctgcctccttatgagtttgggaaaagaattatggggcctcaggtttaaatgctgttatgctttgggtaacactttagctgatttgttttcagtaaagccagaaggaaaatactgcatttctgtcttctttaatttccttaatttgaaataagccttgaactagtttgtaagactcctttaacttttaacaaatttaggcacatatgtaatataaagaaaaaggcactctgccctaaatgaattgactaattaagctgagaacaaaactagaccacttttttttttttggtttcaaaaaaaggatgcaggaatttttaaatgctacagctaaaacccagattttgtctgatattgatgttctgtaggttttctcaatatttgccatattcattagatgacattcattatactttcctaacttttataggatttagatgaggtttgttgataacattctatattctttctgaaaagaaaaacacacacacacaaatgtcgagcagtcttctttttttaatgtatattctcaggaaaaacaccattgactaatttaaatttcagtacggaggcaaagctgatctgtagtgaatgtaacatcttgttaaatacaggtttcatgcttcttttttgtacctttccaggcttttaaggaggagaataatttgaataataatggcataatgtccagagggaaagttgaatacgtaagacagagatgcatgtgggcctatttctgtactttgtgtgcgtgtctctgtgtggtggctttatggtttttaaaataaagttttctgtattttcaatgtatataataactttggaatcaccaaagaaaagttgatattgagacttgggtttttagtggggaggaatggatgttttttttcttttacagttttaggcaaagtgaaactttagaaaattatattatttgaagttagatggaaaccaaacactatctttatagtttctttcagaagaaactttgtcttaggaatctgggcactcttgtaaactttctaaatttcttcagccctcattgatacccacactttgcttaattcagttgaatcagtttacagtgaataacgtccctgggaacattaatcaatgaacacacacacgcgcgtgcgcgcacacacacacacagacacacacacacacacacacacagggaggacaaaaaggaaataaaagcatcactttgtaccttcctcaattcaaacctgtctgctttcttcagaatttcggatgtatgtgtctgtttcttccagtagattgggagcaccctgaagacagaagagacatatgtatatatatatatttttgtttgttttttcttttttgtttttagacagagtctcgctctgtcactaggctagagtgcagtggcgtgatctcagctcactgcaatctccacctcctgggttcaagcgattctcctgcctcagcctcccgagtagctgggactacaggcgcccgccaccacacctggctaatttttgtatttttagtagagacagggtttcaccatattggccatgctggtctcgaactcctgaccttgtgttctacccgcctcggcctcccaaagtgctgggattacaggcgtgagccaccgcgcctggctagaaagaagagacattttatgtatgatcgtcataatgattttgtgaactcaggtgtagtaaggtaaaacgccctggtaaaatcacttactgggacttttcagaatctgtttagaagtcattccattactcttgaaatccctctgctttatagactttctgagaaataaggaaagtccatctgcctacttgtcatagaaatgggtacttcagcagtaaaatagcctgtttacatactggctcaaactgtcaatgtaggaaaaggtttcgtgtattataaaatgttacagagctagaaaaaatatatacaagtaatatatagagtgcatatatatgtacatatatatgatctgttccttgtcacaatatttaacccaaagtgctatttacagtaatgaatcaaaatgtcagtcttaaaaatatgaagtgtcaaagtgttcccacgttgtagaaaagtttgatgtgacagtttgttaatcatatgactattctatcaatgtgtctcataatgtcttttgctcaacactctcgtaggctcctcacacttttttcatgaattcctagcttaagttactaacccaaggagcacatttgagttgcgtgtctcccacacctcacacaaaggcggctatgttttgctgtacttaaaactgaatggatttcacattattttagagtggtttgattttgtgcctgacgcatttatggatagtagcttaaaaaatttctgtaattttgctgttttcactacagaatcatcaaatgaaactttaacttatagcgcggatgttttttgtttctccaaagtttcccaagatatcagatgtccttatttgctagtgcccattcgttgaacttggacacatttttgaatttttctcagcacattgatgatcccaacttctttttcctactaaaagggcagagtcttagaacataaatattatatatgtggaaaagggcaacatagtttctttcgggaggatttttggccatgctactcactagttcgtggatcacacttaatctctgtgcctccgtgtcttctggagaaaatttaagggtgaaattagattagatcagtgaatttttaaacttatgctctagaagccctaggattctgggtagaaatgaagctccaatgattgagtgtggggtgggcagtggggactctgggcccttcaaaccaagcagctctgctattcgcttgttaaaatttagagttttataaactgtttcacttaaagaaaggttctactgcttaacctgcctacctgttggcatcactgtcttaagtgatctagagtcagtggcttatttcccacaaggattcagtgggcaactgtgacaatagttcttggctaacctggtcactatggaagttctttccgtggaaaaagattctccatccttcaatttgagataagatttactaattgagacctcatttgtttctgattttaatctttgcatcattttagttttaataaactaactttccaacttaccagattttcgggttgacaaagaccattatttagagaaacacaggcaaaggaaagtctaaaagctttggctggaatttcaactgcttctggtcaagaatatgaattttactttgtacggccaaagcgtttcaaccattctggggaggtgggtgaatgcccacaacttgaacttttcattccattgctttccatcctcaagtctctcccttcttctccatacacatgcaactaccaccaccaccatggttctcttcgcatggcctatgtatgtccccagacatggtggagcagaaaagtaaaaagttgtgatttacaaaccaaggtagagactataagaagaacaaaaatgattaaggggcatgagttagtgacactaacaaaaagccttcatgtatcaacataaaaaaatcaaattgaagaaaatatttttcatggacagaaaacctaccctaaagacaggaaagaaggtgaacggctatttcactagatgctgaaacatcatctccaaagttcctcaggaatcaaactatgggattagattcaactcttttaatagctgaaatctagaagggagagagtggttacgtctatagttttatgaatgatgctgaactctttctcacaataaaatgctcttctactaacaaatttaaagacttgagcacccagaaacagcagttgcatgccaagtcaggaatattctttttttaagtcacatgtcagccactggggatgcacccgggtttaggctggaggttggagagggttcatccaaaatccatgcacaagatatttatccaaaattctggagtggttccttgttcattctctgaagaaattggtgagataaggcaagcatcctaaacaaatgttgagctctaaaaatacagtttaaataaaacagaaagcattctgagtatagttttggccaaaatagaatagtataataaatcatttggctggagggtatgacatgagaataaacaaaaaaacagcatgtttgctatcttttctgtttattttacttatgcatcaacccccttctgcctccttttactccttgctagagtgtggaaggatcttgaattcagggccttgtctgtcttgtttttcagctggctggagtcacacttggcttatttatgagctcaataaacattatgaatggatgagcaattttgaaagattgacatattgaaggaaaaaaatgacgtgaatctgaaaaattctgacatggccacttctaaactctctgggacttgtactaaatgcttatagatttaggtagcattctgagcattacctcacttattcctttcaaccagcctctgaggaaggtactgttattatcaccatttcacagaggaagaattgagatccagagatgttacataatttgcccaaggttacataataataatataatagctaaagccaggatatgaactcaggtagtctggcttcagcagcttctctcttaactacgaagctatattgtttccacatggtgattataattataactgcctgttctactttcctgtacgttgtgaggctgagtttaggtgtgaaaggattagggaagaagtatatcaactagtgaaggcgagacaacacacaaacaactataacttaaagtagatagaaacttgcagagaaagttcagagaagaaaaaagaactattatttccaccagggtgaagggcaggagtcaaagaaggcttcctgtgggaagtgacttagtttggccttgaatgagtagaattatagtaaagggagatgctttccaagtaaacagaataaacagtggaagagatgccagtctaatgctgttgagtttagcagattctttccgaaagagtgtgcgctgagaagtggggagtggagagggtttgtggtggaaggaggtggaagccctgagaagggatctgagtgggaagatgcaagcgttccaaaagcatattcgcaatctctctggaggtcaatcctgggcaaaatgttgcttttgtcatgctttaactcattattttttgatgcattgtccgcaaagactagtccaaggaggtaccactccagaaagagtggccacacgagtctggaaaatgctgcaccctctggtgctctattaggtgctgacagtgcgtgttaacatgcccagtcttcaaggaagtcccgtgagacagcaatcaccttgctttctttgactgtagacctggtttgttgttttactttgagcaaacccctgttaacatccctcagaagacacacttcaggagccctcttccagccaaccagctggactaatttgtgtaaactttccaacaagttgtgtgcttctgctgaacacaggtcatctcagagtaaaacttgctccattctcaggacagccaacagtccccttttgaaagaagttagagcacgtttgcctatagaaattgttatgtgtcagttagaaagcaagctgcatccgaggtaacaaacttgaggagctgcagcccctctgacgaagtaaaagtgagaagcaggaagtgaaggagtctcagctcttgaaataaaatgtgcatacgggtgagagttgccaaccacaagaactctagctggctgccctgagaacatattaggagaaaacatggttaaagtcggcacctgacctattagctgcaggggcagctcattatcttttttattctttcaccctgcattggcccgaaaggggaagagaggcagtaagtggactgtaaagagtgcttattccacgctgggcaggtcattagaattgtcatgtcaaattcccttccttaatcccctcaactacccagtggagtcaggattattaatctcttcctctatacgtgaggacagtgaatccagagtggcttgctggtgctgaatagatcatgttgtcttacaacttgagcttttcccttgttcctttccctatttgtctgctgaactcatctgtctccaggttgtaaatgagattctcctctgaagagcctctgagccccctgtaactctattcttgtattgcatgacgatactcttgttctttaggtttatacctctttctccccttaagacctaaaactcgatctgggttactctagagcccacaggtttatattgcactgctctgcccacattccagccttctccactttaacatatgacttgatgatagcttttcagacccagtccctcacaagatacctctttttcaacccattattttagaccttctttacttgacatattttgagttttctggattctaggcttccttatcgttagtgtcactttccccccttctgttacatgtctgttaccttcttgctatttgcttaggtcctaccttaactttgaaggaacgcttttcaaacccggcctgcatcggaattaggaatcccaccctcagaagttatggtttagtaaacctgagagagtgtgggagaatttgtattgcactcccagatgatcctgaaactgtcattctgtgggcttatgtttattagcacttctttaaagcatagttcaagacctctgttttccaggatatttaactatcttagtccaaagtctttcctttcttccttgcctccttctctctctcctctttgtcttttcttcttctcttcctcccttctttctcccaccctcctctctctttcttctcatgaagtccatatgatatcctgtctgaattacataactttttttttctttttgtggagatggggtctcactatgctgcccaggctggtcttgaattcctaggctcaagcgatcctcccattgaagccttccaaagtgctgggattacagtcatgagccaccacatctggcctgaattagacaacttcttatttatgtggatctcagaagctccatcatccacttcttaagcctggtaaacacttttattagataagagagacagttttgcataaatgaacaaaaatctagatgaaaagttctcgaatcctgaatcacatcttgccataacctcttactagccgtgtgttcttggacatcttatggactggagtttccttgtctctaaaataattattccatttccttgtactgcagaagctcatgaaaaaggtcaaatgagatagcgggtgtataaagtgctacacaaatgcaatgatgctaatagtaaattattgttgatgttttctttgtttctgtacagttgactcatttgctttatcattaatgatgaggcatgaaagaaatgctgcttgtttttaatgaactatggaagactaggtggagctgacgggatgttgggatttcaggaaagctcttttaggtttctggaaatgatactcataccaatagttgtgagcttaggttgaagagcaatgttgtatttatactataatttttcttcaaataaactgtgataaagattttgaatattactttcatattctgaacttctcatgtacacttgaaaagagtcatgaaatagtagtagcggttgccatttataggggtcgtagggtgttgttatggttaaatttataaatccttaaaattatgatttctatcacaaaaatgcctaaaagggtgcattctctaggttttttccttctttcattcccttccttccctcccctccctccctccttcccctccctcccttccttccttccctctcctttcctttcttctcctttccttttccttttccctctcctctcctctcctctcctctcctctcctctcctcccctctcctctcctctcctctcctctcctttcatttttcctttcctttctctcgctctgttgctcaggctacagtgcagtggcacaatctcggctcactgcaacctccacctcccgggtccaagcgattctcatgcctcagcctcccaagtagctgggattacaggcgccctgccaccacaccaggataatttttgtatttttagtagagatggggttttgccatgttggccaggctggtctcgaactcctgacctcaaatgatttgcccattttggcttcccaaagtgttgggattacgggcgtgagccactgtgcctagcccctctaggttttcttaagaaaacctatctattcctcaagtgcttactctgcaaagcctaggtctgccaccaaggaataaaaatatggctaaatgtacttcctttcctcccagagttcactgttcaataggggacacaaacacataaataactagctcttgcaccaagcgaaatgtacagtgcgacaaaggagaggtacagatagtaggctgtgggcccgaaggagggtttccgtgggcgtgagtatgaaggaggggtttcctgaaggagggggtatttgaacaacccttttgaagactaaaaggatgtccgcaaatgaaatttagggtagaaacatgccagaaaaaggcacagtgttttcaatacgctaggcatttcttaaactatttatagctgaggttatgggaaaagagatagtagaaatatgagaatatcttctccaaagattctatgctaatatcctgatccatctgactatgcttatttgactgctttttgtgtttgtcttcttctttactggatatcctttttgccgcttcctttctggaattttctttcctggccattagcctctctctcctacaccgttgcctcactctcactgccatactcctttggacatcctccttctcttgtttcctaatacttttacatccccttccatcctttactccttagcttttgtttttatttgcagtgttaaagatagcctctttttatttccctgtagtgattagatcgacgtgtttacaatatgaacacacaggttttctcttcttcaggctctgagtcatcgagttcacaatgccatgtctagtcagtacttctatgtgtgtatagtgcccattgtggccgagtagagataaggtcactggggaagaaaataaatcgctaaaatctgttagaatacgtcagcttccaggtttgtctgaggatgcagtggaaaccacgttctgtggccagcatgtcagtagcttttgatgatcagagccttccattttgatactttaaaataatgtaatctaagttcacatcaactgaatccagacagtttcaccatccaccacattattaattccagatgggaaaattcattagggctcaaattttgtttgagacccaactgttttttaaattattattacaattattatctatttattttatttatttttttttttacaactgatgggaagggaaatttaacagctgtgtgattagcagggcatgaaattaaaaacgttttgcacagaatcaagaggttgtttactacagaatttgtcatctgagaattaagtgtcattaagactgcccacaggatgatctctttcaccattcaagctttgatttccacgcccggttttttgctaaaaggcctttaaccttttctggaaggaaaatgcatgtggatttatcacgaaggtaccatcagcatttcaaatgctaagtcaaggtaaaaacgacactcttgtctgtcacaaaataacagtacaactagatgttcagcctcactgctctcagcaaagagtgagttccaatttgaggaaatcaggtaaattagaaaaggctgcagctggattagtggcttcactctttccctctaaaactgtaggagtttcatatttccatcaaggcagctcaggtccctagagcatgatgtttacccttacattttcctgggtgtatgggctctttacgtctttggtctctttgcaaacgccctccttcgactgagctctagaaagtactctgtcctgggctgagcgcagtggctcaagcctgtaatcccagcactttgggaggccaaggcgggcagatcacgaggtcaggagttcaagaccagcctggccaacatggtgaaaccccgtctctactaaaaatacaaaaattagccaggcatgatggcgggctcctgtaatcccaactactagggaggctgaggcagaagaatcccttgatcctgggaggtagaggttgcagtgagttgagatggtgccactgcactccagcctggacgaaagagtgaaaactccctcccaaaaaaaaaaaaaaaaaaaaaaaatactatgtacttgttcctttgggcaagatgttggcagttttctgcagaagcgtggtcaagcacattagctggactgtcttggtcgaggtttgaaggcaatgccatttgcttgggcaagttacatggactctctgcagttcatttgcctcatcatcctccaacttaatgaaggtaatgacagtatctacctcaaggattactttggggattcagagttattaccaaaaatgtttaaggccctgcccgactcattgtttatgctcagttaatgttagctatctccatgcttttcagtcaatatattgcattgtgtttggaagtcttcatatctagtttcatacctgacacagacttgcttaacttctgccctggaatctttttgctatccctgtcttactgtctttaatagagcctttcttatttgatacttatttatatacttgccttcgttcgttttttagacaaattttattttcatatttgttgaattaaaccagacacagcttctacacttatggggtttcctttctgggagaatggggctggtgacaattaatgcagaaaacttttattggagatagacatgcaaaaacactcagagatagagttgaggaatttgtagtcattagaggagagagatgttagttttggctgggattggagttaaatggagagaaaataaaggaagactttctggaggaggagggttttgatctggaacctgcacgctcattagaatttgaattcgacctggcagaaaggggaaaagacttcccaggctgagtgaagttttggagctgcacattttattttatttttcatatttgtttcctgctgccctctggccaccattcagaccgtttggaggcctgttattgtaggtgggacctaagttccagcaccagtagatgtgtgagtgaggcttttatagtattgatgtcttgtatttaaaatgaacagaggaggaagccctggagtccattctaataaatgtatttcaaagggggctttcttcttttgtctgagtgagaggcaggaataggaatgacagaggcagcaagtgttggatgtctgtagaagaatcatagagttctctttagagcactaaacagagggctaataaagggctattgagtcctccttatgtttttttcctctctcagatgagttttaagggtaatagaagcgctttttttttttttctggtgacctcttaatcttacttttctctctttatctcttccttttcctagaagctaatattaaaaccactcttgtcctctgccattaaaaataaatctgggtaggtttcagcaagagagtatttcctagaatgcattatattctgggcagtagaagtgtatgtttaaatacttttcctgtagaaggtcattatgacaacagaggatgccaccagcaaccctgcagtatgtggtgaatgtgtttccacgctgtgtctgtctcgcctctgctctctgccatgtcaagctgattttaagtttaccgtcacttttagtatgtgacttgatgaggcaccataatgtgtgtgttgctggccaaacattacatgtcatgactgtagaatcatgagactggagttttagcctagaccttagaacacgtacctgcaagaggtagttattcgagcagcagtctttgtgagactggaattcaggcacagggaacacttgttcctaagttgctgccccgttgctcaaaacatcttggtaatgtctttctttctttcttttcttcttcttttttttttttttactctgttgaatgttatcttttattttgtttttattaaaaaatcaatttccagctttatcaggatataattgacgaaacaaaagttatgtatagttaaggtatacaacatattttgaggtacattgcattgtgaaatgattaccctagtcaagctaattaacataggcatcacctcacagttacctttctgtgtatgtggtgagaacgtttaagatttactctattagcaaatttcaagtgtacaatacagtattaactacagccaccgcactgtgtattaaatctccagaattattcatttggtatcactggatctccctttgaccaagaaccaagatctcctcattcccctggtcccggtagccatcattttgctctgcttctatgtgtttgacttttttaatttgcacatatcagtgaggtcacgcagtgtttgtttttctgtgcctggcttagttccttaagcaacatttcctccagattcatccatcttctcgtaaatgacaggatttccttctttgttaaggctgaataacattccacgtggtaatacaccgcattttctttattcactcttcaaatgatggacatttagatcgattccacatcctggctattgtgaataacgcagcagtgaacatgggagtgcaggtgtctccttgagacactgattttgccttagaggggattctggggctgggctccgtggtgaagggcactctctttccctcacctggaggttatgtcagcggtgtgctgggggttgtacaggtcatgttaagctgtccttcctgccttcctcaatgcgtcatttcttatttctatgttccacccaggtgctgcactctcgcctgaattccttaacgtgtgtgaggtattttggtgtgtggctagttgtttagaagtttctgagagggaatgagtgctggaaactctattttgtcatttgccaatgtaaccccacattggaattgtcttcagagataatgaagagccactgctaaaatcacagactcatgagatgtgaaagcggggaatctgtttagctcacatgcgtgtgagaaagctgagaccctgagacaaatattggcctgtgctgcaggctttcagttagacagggacagcatcagttctcattcccttgttagctctatgcctgatgtcttctcactgttttgctgcattataaagaattgattttttttttttttgagacagagtctcgctctgtcgcccaggctggagtgcagtggtgcgatctcgcctcactgcaagctccgcctcctgggttcaagtcattctcctgcctcagcctcccgaataggtgggactacaggcacccgccaccatgcccggctaattttttgtatttttagtagagacggggtttcaccatgttagccaggatggtctcgatctcctgacctcatgatccacccaccttggcctcccaaagtgctgggattacaggcgtgagccactgcacctggccagaaagttgattcttagttaagcctatgaatagttagaaaaaaaaaagagaagagagaaagttccccttagcatggcctattatcacagggtatgtttgtagcagagggagaacccagtccttatagagtgggttatggcttcttctacattccaagaaaatctcaagaagtagaaatcactctgagtgtcaaatattttagttgcctattgtcacatctattataaaatagatctggtatagataaaaatagagttaaacatactagttaatagatatatctggtgtggataaaaatagaatttagcatactagttaatatataaatatgatgtcgataaaaatagagttaaatgtacaagttcctaattggattgtagaacttaacattcaggagtaaggatgctgtcaagtctaaagctatgcccttatcctagtcagttgttatattcatggcagccttttctaaaatgtgctccatgaaatactagattcataaatggtcaaatcactgtgggactcttgctattatttccacccattgtggagattcttgatgcatccccaacaagtttaactctgagaagtcgaacaggcaaaagcaataagcacaactttcttttctcttatgttagattcaggttttgtccaatttattttataatggaaccattttgtggatgatttcccagacttgtgttctgtggaacattctttggatagcatgactttattgttaaaattcttaaggttcacatctgtcatcttataataatcttgtgtgaaatataaagtcatttgggctaaactgtagacctccatctgccctcccttccccacaggagaaattacaggtttatttaaggatcaaacagttttgaaatgaaatgttgttaggagggggaaataaaaacctttcagagcttaataattgtagaaagaagacagtgttataccggccaaaccaattttgtgaattagcactttaactcagagagttgttcctgaaaatagcttgtttttaagcaaaactttgttggcttctggtggtacactttttcaccatcaaaggcacaaatatgggtgattttaaactgtggcatactttttttgcattcaaaaccagggcttgtggaagaaacaacacccttttttaacttttcagaaacagttggcttgaccatcatggcttttttttttcccctatgtctttaggatattagcttttcgttaagctggaagggtcctcagagatcttgtccaagcccacccttgacagatgaagaaatagagggccagaaggctttagtaatctttccaagtctttttattagttactgacaaaatcagaactaaagtcaaggtctcttacttacctgtcatttacctgttcaatgcctcttttgtttgtacactctgttaaaaagaaagaggttaactgtttcttttggttataactgttatactacaaacacacacacactccacacacacacacacacacacacacacacacacacacagagagagagagagagagagagagagagaacagatgaaagccatgattaggaacattttatgctcaaggtgagaagaccctctataggacctcgaatgtcttcttttctaaagaacttcatctacctcgggtcagtcctttgatactattcactttgaaaactggtttacctgaaaggaagaggtgtgtgtgaaagagagggtcacccgccacattttatctctctgtcttatttcaggcagacagattcactacatcaagatggtgtttacagttatcgccatgagatgaactagctcatctccaagtgcttaagggatattgcctggttataaatcatcatgtgattctctctcctcccacccccatttacagcttctttcttctttctccactgcccatgtctaaacctggggaactatctcactgcatagacagaaaaggaaggtcagatccaaggtagatctttctttctgctaggtttaacctagtgatagcaacaaaaacagttcttatgcctctgagtttcttgttttaggcagaagcatttgataggttggggatcacaggaaagtttttttttttttaaattctccattaagaagatgctaatgtacttgtgaaggcaagtacattaagcttagtaatggaagatatgggttctaagctgcacctctctgccaactagtagtgagatcctggggaaatcaaacaatcgtttggaaccacatgtggcctagtcttttcattatgacttcaggagtcataattcttgtcttgtcaacctcctggggttgttgtgaggattaagtgagataatagatatgaaaaggcttgtaaactacaaagcatctcatacatatgtgtaaggcattgttattatcaataataatagcaaccacacactgctgcctttgagctaggtactgttttaagtgctttccgtcgataagctcacttaattctgacagcaactctagtgtaccaatgaccagtgctgggcgctgtgaatcagcaggactggcagctcaccctgattagctggtgatttcctgtgttcttgggcatgtcctttcccttccctaggcctgaattttactctttgtaaaagaatcacagactcaggttggatggaaggattcttctgttctgtcatttgtgattttgtcaggcagtcattggccccacaggctaagtcactgattatttctatttatttatttatctgagacagagtctctctctgttgcccaggctggagtgcagtggcaggatctcggctcactgcaacctccaccttccggattcaagcagttctctgcctcagcctcccgagtagctgggattacaggtgcctaccaccacacccagctaatttttgtatttttagtagagacggggttttaccgtcttggtatgactggtcttgaactcctgacctcttgattcacctgcctcggcctcccaaagtgttgggattacaggcgtgagtcaccacacctggccagtcactaattattaatcacagcccacatttaactgagtacagtcattagtttcattctacagctatacagagagctcatgtaaattcctgaaggctgcaccgcctacaagtggtggggctggagttcgcacgttgctcttgtgccctggagtgatggcagcaagatagatgtgggtaactctctagcgatcccaggtgtgttatgttgtcagcatcctcatctaatcaacatgatgattatcattgagccttttaggttttcagttgttgttatcatttaactcctcaattagattccgagcatctcgatggtaggttttctgtactgcaatgtgtattgccagtgttttatgcaagatatgatgcaggctagtgtctcacagtttacgcaatttgttttccgtccatcctttcgatcctttgagcctctcaaggaagcctgggttggcatctgcccaactgtgttgggcagaatggtttttttctcgttgcccgacatggggctgggaaagccatttgaggaggtcgctgtggcatgaatctggacaagtctttctataggggaaacctgtttcaagctgtggctctttcactttctacatggcatatggaccctgatttttctcacgcctgcgtaactctactggtgtctcttggctgtcgcagctttgttttgctttgccattgttttattttattttttctgaagacttggttttcttgggctctgcttatatacaacacaaaatttgtagaccatttgcttatgggaaagagtcacacccacggaaattgggagaaaattaactcttggagcccaaagaaactgacataaatcttataccacgaacatcttcaatttccgactttgccttccttctctgtatggtgctgtaccaagatctcttattgggaccaggtttcatggagggttactggtaactattaacccactcaatgtacttattttaccattaacctatcatgaatagcctgtccaatccccattaaatgacccactatgggggtcattaattcatttatttatatatgaattatctacattcatttatatatgaattattagatattatctacactgaaccaggcaaaattggggataccaaaatgaattagacacagttcctgctttcaaaaacctcatactctgaagagggggagatttgttaattctgtcaagtcatctttgatgcctaccatgaccaggtatcagacatgccactggaactgtggacatctggcaggtacaagcctattcatcacagggtttcaggtctagggaagaaaaacatcatattaataattttacaaataattatgtagttatagttgtgataggtgccacagaggaaagactgagtggtgggaaaatatatatatatatatatatatatattttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagttcattgtagattctggatattagccctttgtcagatgaagtaggttgcaaaaattttctcccattctgtaggttgcctgttcactctgaatggtagtttcttttgctgtgcagaagctctttagtttatttagatcccatttgtcaattatggcttttgttgccattgcttttggtgttttagacatgaagtccttgcccatgcctatgtcctgaatggtattgcctaggttttcttctagggtttttatggttttaggtctaacgtttaagtctttaatccatcttgaattaatttttgtataaggtgtaaggaagggatccaatttcagctttctatatatggctggccagttttcccagcaccatttattaaatagggaatcctttccccattatttgtttttgtcaggtttgtcaaagatcagatagttgtagatatgcggcattatttctgagggctctgttctgttccattggcctatatctctgttttggtacccgtaccatgctgctttggttactgtaaccttgtagtatagtttgaagtcaggtagcgtgatgcctctggctttgttcttttggcttaggattgacttggcgatgcaggctgttttttggttccagatgaactttaaagtagttttttccaattctgtgaagaaagtcattggtagcttgatggggatggcattgaatctataaattacctttggcagtatggccattttcatgatattgattcttcctacccgtgagcatggaatgttcttccatttgtttgtatcctcttttatttcattgagcagtggtttgtagttctccttgaagaggtccttcacatcccttgtaagttggattcctaggtattttattctctttgaagcaattgtgaacgggagttcactcatgatttggctctctgtttgtctgttattggtgtataagaatgcttgtgatttttgtacaatgattttgtatcctgagactgctgaagttgcttatcagcttgaggagattttgggctgagatgatggggttttctagatatacaatcatgtcatctgcaaacagggccaatttgacttccttttttcctaatttaataccctttatttccttctcctgcctgattgccctggccagaacttccaacactacgttgaataggagtggggagagagggcatccctgtcttgtgcccattttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgtgtatgttgaaccagccttgcatcccagggatgaaacccacttgatcatggtggataagcttcttgacgtgctgctggattcggtttgccagtattttattgaggatttttgcatcaatgttcatcaaggatattggtctaaaattctcttttttggttgtgtctctgccaggctttggtatcaggatgatgctggcctcataaaatgagttagggaggattccctctatttctgttgattgcaatagtttcagaaggaatggtaccagctcctctttgcacctctggtagaattcggctgtgaatccatctggtcctgaactttttttggtcagtaagctattgattattgcctcaatttcagagcctgttattggtctgttcagagattcagcttcttccttgtttaggcttgggaggatgtatgtgtcgaggaatttatccatttattctagattttctagtttattttagaagaggtgtttgtagtactctcctgatggtagtttgtatttctgtgggattggtggtgatatcccctttatcattttttattgcgtctatttgattcttctcttttcttctttattagtcttgctagtggtctatcggttttgtttatcttttaaaaaaaccagctcctggattcattaattttttgaagggtttttttgtgtctctatttccttcattctgctctgatcttagttatttcttgccttctgctagcttttgaatgtgtttgctcttgcttttctagttcttttaattgtgatgttagggtgtcaattttagatctttcctgcttctcttgtgggcatttagtgctataaatttccctctacacactgctttgaatgtgtcccagagattctggtatgttgtgtctttgttctcgttcgtttcaaagaacatctttatttctgccttcatttcattatttacccagtagtcattcaggagcaggttgttcagttttcacgtagttgagctgttttgagtgagtttcttaatcctgaattctagtttgattgcactgtggtctgagagacagtttgttataatttctgttcttttacatttgctgaggagtgctttacttccaactatgtggtcaatgttggagtaggtgtggtgtggtcctgaaaaaaatgtgtattctgtcgatttggggtggagagttctgtagatgtctattaggtccgcttggtgcagagctgagttcaattcctgggtatccttgttaactttctgtctcgttgatctgtctaatgttgacagtggggtgttaaagtctcccattattattgtgtgggagtctaagtctctttgtaggtcactaaggacttgctttatgaatctgggtgctcctatattgggtgcatatatatttaggatagttagctcttcttgttgaattgatccctttacaattatgtaatggccttctttgtctcttttgatcgttgttggtttaaagtctgttttatcagagactaggattgcaacccctgccttttgttgttttccatttgcttgatagatcttcctccatgcctttattttgagcctatgtgtgtctctgcacgtgagatgggtttcctgaatacagcacactgatgggtcttgactctttatccaatttgccagtctgtgtcttttagttggagcatttagtccatttacatttaagtttaatattgttatgtgtgaattcgatcctgtcattatgatgttagctggttattttgctcgctagttgatgcagtttcttcctagccttgatggtctttacaatttggcatgtttttgcagtggctggtactggttgttcctttccaggtttagtgctttcttcaggagctcttgtaaggcaggcctggtagtgacaaaatctctcagcatttgcttgtctgtaaagtattttatttctccttcacttatgaagcttagtttggctggatatgaaattctgggttgaaaattcttttctttaagaatgttgaatattggtccccgctctcttctggcttgtagagtttctgccgtgagatctgctgttagtctgatgtgcttccctttgtgggtaacctgacctttctctctggctgcccttaacattttttccttcatttcaactttggtgaatctgacaaatatatgtcttggagttgctcttctcgaggagtatctttgtggcattctctgtatttcctgaatttgaatgttggcctgccttgctagattggggaagttcttctggataatatcctgccgagtgttttccaacttggtttcattctccccgtcactttcaggtacaccaatcagacgtagatttggtcctttcacatagtcccatatttcttggaggctttgttcatttctttttattcctttttctctgaacttctcttctcacttcatttcattcattttgtcgtccatcacttataccctttcttccagttgatcgcatcagctactgaggcttctgcattcgtcacgtagctcttgtgccttggttttcagctccatcaggtcctttaaggacttctctgcattggttattctagttatccattcgtctaattttttttcaaagcttttaacttctttgccattggtttgaatttcctcctgtagcttggagtagtttgatcatctgaagccttcttctctcaacttgtcaaagtcattctccgtccagctttattccattgctggtgaggagctgtgttcctttggaggaggagtggcgctctgatttttagagtttccagtttttctgctctgtttttttcccatctttgtggttttatgtacctttggtctttgatgatggtgacatacaggtgggtttttggtgtggatgtcctgtctgtttgttagttttccttctaacagacaggaccctcagctgcaggtctgttggagtttgctagaggtacactccagtccctgtttgtctaagtatcagcagcggtggctgcagaacagcggatattggtgaaccgcaaatgctgctgcccgatcgttcctctggaagttttgtctcagaggagtacccggccgtgtgaggtgtccgtctgcccctactggggggtgcctcccagttaggctacttgcgggtcagggacccacttgaggaggcagtctgcccattctcagatctcaagctgcatgctgggagaacctctactctcttcaaagctgtcagagagggacatgtaagtctgcagaggttactgctgtctttttgtttgtctgtgccctgcccccagaggtggagcctacagaggcaggcaggcctccttgagctgtggtgggctccaccgagttcgagcttcctggccgctttgtttacctaatcaaacaactaactgggcaatggcaggcgcccctcccccagcctcactgccgccttgttgtttgatctcggaccgctgtgctagcaatgagtgagactccatgggcttaggaccctccgagccaggtgggggatataatctcctgatgtgccatttttaaagcccattggaaaagctcagtattagggtgggagtgacctgattttccaggtgccgtctgtcatccctttctttgactaggaaagggaattccctgaccccttgcaattcctgggtgaggtgatgcctcaccctgcttcggctcgtgcacggtgcactgcacccactctgctgcacctactctctggcactccccagtgagatgaacccggtacctcagttggaaatgcagaaatcacccatcttctgcgtcgctccctctgggagctgtagactggaggtgttcctattcggccatcttggctcctcctccctatgttccagacatatcattttcattccacatgtatttctttgtttattgagtgccttccatgtgttaattactttattggattcctgggggtgagaaggggaagggtgtgggcagggccactgcttacagctgctcaagttgtgccttgcttgagggcaggagcgcaagtggggctgaagtcctgccctccccactagccaggccaagataaggaccattttctttctttttttttttcttcctaatttgcacaaaagatactaatgattaacagagatcctggtatggaaacataagacacaagtttggttttgtctgaaagcactggtagtttagttggtgaggcagccacaaaactaaccaaaagtaattatattgccagccacaatgaaatatattaaccagagatacaaatgacattctgagggggcttggtggaagtagtttaaccctgatagggtggggagaatcaattcttacaactttcgaagagactagttggatgggcaagttttcttaatagctttattgagacataatttaattaattaactcaaagagtagaattcagtaatttttaatatattcatagagttacacagccgtcaccaagatcaattttagaatatgtccctcaccaaaaaacaaacaaacaaaaccaaaacaacaacaacaacaaaaacacatagtggtcgtttcttatttctcccaaatctcttgcatccggtactaagcaaccacgaatctactttataatctgtgaagttgcccattctggacattttatataaatgtccatacatttatataaacatcatacaacatcatacaatatgtagtcttttgttactttgtttctttcagttaggttttcaagattcatctatgttgcagcatgataagtaggcttttgattggtgaagaatagaagcaagtttaccccaaaatgatgcattagggagagctaagagattaacctttgtaagaaaccacggtctgtgtttgaaaggttgaaagtagactattgggtctgctgactagggcctgtagggaatgttacaggaattgaagttagaaatataagttgggagcagatcatggagattatgaatgcttggactttttctgagatgcagatgtttttgagaggggaatgatatgactagagatgtgtatttttctcccccataatgagaaaaattgatgaagctgtaaggtcccccaggttggtagtggagaaccaggtgtgaaatcatgaacaactccctcccaagtacttttccctcatattccactgcctcttactttttatgtttgttagctggagcaagtagaaaaagcacagatgatttgttttctgttataattattttttaaactactagaggcatggtggaaaattaaactcgatagattatagttataaatgttgttctttgggcacttgccatgaggcagcattttcatggcaaaccctactttgtatatttttgtcatattatgagaaagaggccctcttctgggtcacatgtttgcctctgcaggactctgacctgtcattttagatattgagtctatccttgttttgatttcctttggactcatggccttgagtatgtcccttatgttcatttgacagattcctgccaatcaaatggaagacaaagctatcccgagggtagttggcctgtgtttgcatctcttgtagccaagagaaatccctcattgcttgtttctgagctactcatgtcacagacttttgcaagaggaaggatttttgagattacatggttcaaatgttattaaattaaggtttagtggtccatgaacctcctgaaattgtttgcaaaattatctttaattgtgtggaggtgtatttttctcccccataaaattctcagatggattgcatccctgtaagggggaagaatcatttatccaccaacaatattgaacttttattgagtatttacactatgccttgtagaagacttgtgttatctcattcagtctttacagcccattctcatggattaggaaactgaatcatacagtagttaagttgacttgcccaaggtcacagagctagtaggtgacagaacctagattcagaccctggactctaaccccagagcctatgtcttcatccttctgcattttcaaccttcatgcctgctttgcactattctagtttaccttttataggctctggagttgatggagtctcctttaataaatgggtagtggaggcccagagagaagtgaaacatgtctaagatggtcctgtgattaaagacacatagctgttaacgtgtgacacgaatgcaaacaccaaagtcagattatgaggctttaacacataatttctaaatttaatttaaaatgctcctttttgacctttacttctgctattgattttcatcttttctcttttctccttcttaccccttctcttctttcctcttctgctctcctttcttcctgcttttcctttctttcttcagcaaccattactgagcatttaccttattggaattattggattaggtggaattattggtaattgtgtgttttcatgttactaaaatggactgtccagctcttctgtggccaacatctctttactctagaaggttctcaaaggagttaccacacatgaaagaaggttggggaaagcaaagtacccgaagccagtgctttacactggtacacaggagtaggtacccactttccgattcgggggactggattgtgtcattcattgaaatatgaaatagtgaaggaagcttcacttttatatcggttgggggtagcgtgagagttgtttgagcttttcacttttgagagcttttcaaatgaatcgccttatagttaaagctggagattagaagaaagatcaagactaggaaactctttatttaaatgtcaatatttaattgacaattaactgttgttgatttaaattaaatatatatatatgtatagagtcttgctctattgcccatgttccagactcaagctatcctctcacctcagcctccagagtagctctgactacaggtgtgacccgatacacccagctatttttttttttttagattttgtagagacaggggtcttgctatgttgctcaggctggtctccaattcctgagctcaagtgatcctcctgcctcagcctcccagtgtggtgggattacaggcataagccatcatgttcagccagggaatgtttgaagatagagaaaaaagccctgctttctccattccttctacggtttggcacccagttcatatcccatttgcccagatgctcccttttaatctttcctaatgcaggccatagacattggtctcagaattcttgtaagtctacttttgtcactcaattgtgtgaattgtgtgtttgtacaggtctcctgcatttactaaatatagtggaaatcatatttgcctagagatcagtagacctgtgcattgaatctaggctttgttatttgctatttgtgtgattcattgattgattttctttcagcatcaaattctaagttaataaaatgagattaataataatgtctaccctgtctctctcacagaattggtggtcactttttaactgtgaataatggatgtgatggctctttaaaaagagccttttaaaacaaaatgaatacttttttctacatttacatgtgtaattatgatgtttgtttgttttttcccactctctgggttaactctaaactcctttggattttaaacgcctttggacacttttctttttaaccctccttcatacctaagacagtgctatgtatattgacatttaaatgtacagggctaattatggtttcgtttcttcacttttttgttgttgttgttgttccttttgttacacatttattttgaagattttgttttcctggaaattagtgggatgttaacgtctccttaaagaactcattctttgtctttcctggttccccctcttatcctctgtaacctgtgacctcctcccaccatctgaggtggatgtctcctgaagttcttactctgtcccagcaatgatgaccttagtgtgtctactgactcttaaaacccgtagggacataggatccaactgcctcatagaaaagtaaggccgagagagggttactcctatatttggttcaagtcaatctgggtgctggtttataaacaatgcctattcagtgctctgcactaaggcatactggtgttatgcttctatttttgcctttattatttttaaagttttttggatgaaattactgacgttgatcacatattaaaaatttatgaggattctatttttgggttccattctatttaattctagctgaaatttgcttctcttttttatcctgttatggtacatttgttcctagacataatcaggaatgacaccagacacagactatattttggtgtgtattagtgagaaaatttagtatgtttcttttgtcatgttgaatgtagacactatggacaatgtttaattaattttaattgatttttgttgttgttattatctttctcaatttcctctgctttcttcttacttccttagcatggtatgccacagatagggacacatttcatctgaaagatgtatactatatatggatgtctttgcagtttcttcagtccttttaattacataaaaatcttaataatattaaaacaacaattatgtaaattttcaaaagaatttcaaaagcaatgaagaagaccactgttcagaacctcaatttctgaacctctccttacttttccttcttccttttcagccagtccttgctcaactctgaatatattttgacaatgtttcaattataatatatgcagaataatttacttctttcacttaacattatttttaaatgtcaatgttgctacatattccaaattactttggaattcattatatattattattcttttatttccactagatttatacttaagacagaatctcaagagtgggatatttgggtcaagtagcatttacattttggctcttgaaataactaccagcatgtcatttccaaagagacgttaatcattgacaccaccagcagcaaatgttctcattcatcagaccacatttgttttacacgttcctctccttagaaagagataagtatggtttcttttctttagttcttgctaataggatacccaacatattcaaaatggtactccattgttttaattctcatcctctctgaccattagaaatattttgctccatgtgtctttgacgaagtttatgtattgttttatgaagtgtaaattcttgcccttgcccatttgatctattgagtttatgccttctttctttatttgggatccaaaatatttattaactctctgcctgacctatttgttccaaacattttttccaagtctgtttgcctttttagttatggtattgtatgtttgtgcatgtgtgtgtgtgtgtgtgtgtgtgtgtgtgtgtatagatctacatacatgtgtacacaccatatatatatggcttataatggggacagaatcacttagcagatgggcaaccctgatgatccaggtatttacgaagggactcaaaccatcttcagttgtctaggtattcagaagaaaaaaattcagaaggctgggcgcagtggctcacgcctgtaatcccagcactttgggaggctgaggcgggcagatcatgaggtcaggagattgagagcatcctggccaacatggtgaaaccccgcctctactaaaaaatcaaaaatcagccaggcatggtggcacatgcctgtaatcccagttacttgggaggctgaggcaggagaatcgcttgaaccacgaagtcggaggttgcagtgagctgagattgcgtcactgcactccagcctggtgacagagcgagactttgtctaaaaaaatttcagaagtcccggagtcctttccatgatgcatttgaagggccagagagatagaggcatgccctatgtagtacatcttgctgctgtccctcgtgtgtttactctatgggtcaaatgagatggtgttggagcaatcaaaggatacagaccagtacccagcctttcttgtcaagactttgcctctccttgggatgttcacacacacctacccctattttctttagggatctagttgcttacttattttagacagtacatcctttatggccttgctgaaatgtaactccttgatggaatctcctctggtttctttctatctgtccacctcaattgagaactgatttccttcccctgaacccctcaccttcccatagtgctttagctgtagcttctttattcaatgtttcactttttactttggaccagagatatttatgaactttacaaaatctcttttaaggcagatatttcagttctctttgcattaacacaggacttgttggatgattgagtaagcgtgtgggggggtgtgaagagagggttcatttgttccttcctcgtgacagagctgagaggggaagggcccttgctggtggtggatgggccctgagggttaattgggctgagtgtggccacaaagcagaaagacttgctgtgctttctgaacttacgtaagttacaaacactattaaaatgtcacaaacaaataagagaatgaggactgtacttaggttccatacttgtggtatggaaagctatctaaaataaaattagctacatatctctgcagatttctctgattcactctacaaagaagcaagtgtttaatctaattctgcaaatatttgagactctttaccaggcgttgtggaacatgctttatgactggaaaagatgataaaggcatagtttctgccctaaggagctgtttgtgcatctgttggaggatatagatattttaacaggaagattctaacactaggtaggctgggtcctttgtgataaagtctgcattagaaatatgtgagaagaaaagattaacctgagtgcggtctctcatgaagttgctagtatactcttctttctttatgcatttaaccccaaaattatctctactgagatgattcttcttttgtatgtcaaattttacttggcttctccctcaccctgactcctagtcccaccattttaattttatcatgatttgaataatatcacaagggaatgaagaatttattctttttttcaataggtgaacaaaaaaaagtatgagaaatgattgatgtgtatttcaacattgagaaaacccaaggaattaggaagaaagttctctggcatatcaggaaataggaaatgatctcaccaattgctagaagtggttgctcagtctcttggaaagtgcaccttcagtagatagcacttaagtcatagcatgcacgcacacacacacacacacacacacacacacacacacacacacataatctctctgccttattagccatttattctctactgtctttcagtagatgatttcttttaccttgttcctttctaaatattacctccactgggacctaattacaacccctcaaaattcacattacattggaatagatgtgagctcccaatgttatctttaggcattacagaatattagaaactgactgtggttatccattgtgtatgcaggtatataaacctcttttgcccaaatcgttgtcagactgcagtgagaaaagtcaaggaaatatttcttactagcttctgaatgttgtatgaattttccccgaagaatgataataatgcaagctgagactttttatattctaaagtaaacatccaaagccagttttccccttctattaaatgaacctttaactgagctctgaaattgtgaggaaggacatactttgatgcccattattctgttcaatagccatattcagaagagaagtttaattcaaactccagcccatcaaagcattttgcagggttttcaaagcagttattgtaatagagagtaattaaatattactgttttcaactgcttatttataatgtacgaagacattataatgaccccaaagttggtttgcctttagaaaaataaggatacaaaatgctgtgtagaaaagaatatgctatcttaagtctagagagctgggttctagtcccatttctgcttgtgacttagtctgtggccttaggaaaaggcttttcttatcgttgagtctcattttcctgcctttaatgacaaagaaattacaaaccttatatctgtaaggcacttaataatttgtcccctcttcttaaacttgtacaagtgaagttacaacattctatcaagttcagaacatgtagactgtaaaattttacacctacagaacatgtaggtgtaaaatagagtcacccataaatctattacccagatacaggtacaatctatcatgatcatatttatgtattcctttcaagtctttagctattagcataaattacccatcatgctgtgtatctcttgacatcatacattaagcattttccatatcactgcatattcttgaatgattacaattttaataactttaatatttcattgagtgattgtgccatatcttaattgtttcattatttgaaaattttgcgatgattaacatttatgcataaatgtagcttacttcttcaataatcttatatatgatgtctgagggttgagacacacgggtcagaggttaattttttttttttttttgaggcagagtctcaccctgtcgcccatgctggagtgcagtggcatgatctcagctcactgcaacctccgcctcctgggttcaagcaattttcttgtgccagcctcccgagtagctgggattacaggtgtgcgccaccacacccggctaatttttgtatttttattagagacagggtttcatcatgttgataaggctggtcttgaactcctgatctggtaattcacctgccttggcctcccaaagtgctgggattacaggcatgagccaccctgcccggcccagaggtgaatatttttatggttatttctatctattgatgacttgttttgtgaaagggattttttttttttttagctttagtaggaatgtgtgagtgagtcagcatctcccctatcatgctagtattaaatatgttgtttttttggtattagcatttctctggttatttgtaaatttagatatgtttccacatgcctcatttccagttatttttttttattgcctttgaagatgagtactttccaatctttaggatcccattcacagcaaatcaaagaggaaacattttagtgagaattgtgcaattgtgcatgtcttataaaaggttctagaacattttttactcacatgaaggactgtttgaataagttgagacatgccttattcctaaatggaaacatagaggttgttaagtagttgttttccctacatttcgtgcaatcacagttagtacaactctcaggtcaattattcttgaattttaaccaaaaaattctaaattgtcttgacaataaacaggcaaaataggtaaaagaaatctgcaaaataagtgtaatgagcaactgggaccatcctagccagatgctgaggtgcatttataaggcaactctgattgaaggaggaggtggtgctggaatagatgggaggtcaaagcagtaacagaacccacccagacataaggcaactgcacgtggaattaattggcaataaaagaaccaccttgctacattccgaaaaggaaggattattctcatggcattgggataattggtcagcgttaatgaaaaacttacatcatgagtatgtttcacaataaaccctgatataaattagtggtcatgttaaaaaataaaacttgcaaaagtcttcaggcaaagaagaaatttgttatatctgtagtaactgaaagcagtaacttttaagtttacacctgaggtcctcaaactttttctgtaaagggccaagtagtaaatattttaggctttgtaggccagatggtctctgtcacaggtcctcaactctttgtgctgcaaaagcatcaatagacaatatgtaatatgtctcatatataaacaaatagagaatatgtaggtttataggaagagtcataatattgtgaatgttaatttcctgacaaatcgtgtcccatggtgaattttatgaatctttcatttttttggcaaactgtttgaaaaagcatttcatggctattttaatttatatttccctgattattatttaagttgtgtgtgtgtatgtatgtgtgtgcgtatgtgtgtgtgtgtgtttggtatatttgtgtgccactgatgtctctttttatgtgaattataggtagagttaatttatctcacttatttcacctctctgtcacctgatgtcccaataccctggagagctttgtgatatctacaccccagtacagactaataggtcactggtttgcttcagaactagaacttctcctgtgcctttgtgcccaagggcctgggacttgacttttggctcagttctacttgtctgctaacctgaccgcttgacagtggattgaggatggagggcactgagcagttttggctgtgcttgacctcctgcttagtttccctccatggtctcttagaaatctgagactgggcgtggtggctcacgtctgtaatcccagcactttgggaggccaaggtgggtggatcacctgaggtcaggagttcgagaccagcctggccaatgtggcgaaacgccatctgtactaaaaatactaaagttagccaggtgtggtggcaggagcctataatcctggctactcaggaggctgaggcaggagaatcacttgaacccgggaggcagaggttgcagtgagccaagattgtgccactgtactctagtctgggcaacagagtgggactccgtctcaaaaaaaaaaaaaaaaaaaaaatgggactccgtctcaaaaaaaaaaagaaaagaaaaaaagaaagaaatctgggtgagttgttgcctgaatcttgtctgaacctgcctatcccctctgggtcctgaaatctaactgtgggtgagatctgcctttgcatttctgttcatccaggtgagcaaacctggagtttggcctcactctgtccaattgtgttccttccaagagataaaactgagaaagtggtaaagtcacttgcataagccactttcagatccatagaggacccacagcatgagattctgactgttattattacagaggtagaagcgtcattttcttggagctgtgtctccgtgtctttggtgtgccacagtcacaggcctgctcctgcccctccctgcaatctttccattgttgtgtgtggtacaggaactgagacaattatgacagagccgagctggtttctcttctcttttggacatcattgtttgtcacaattctgatcaccatttcttcctctagatcacaaaattgtaaaatcactgctatatttacattttcttttgctgcctgggctttaaaaagtactatttatagctttcctttgaaattcctttattaatagtcttccttcacatgtatatcactctgctatttacaaaatgctcttacgtttagtatttcacttgatcagcataaacacccatgggataagctaggcaggattgttgtctccattttacaggtgaggaaattaaggctcagtgaggcctggaaggccctggcctgcagccactgctggaccgggtgccagaactgggtttagacgtcttactagatctctcttgctgtttttctttccgtctacaaaaactccttctcatttatgagtttcaaagattttcttgtctgacacataaggaaattagtggcttttcttgagagatctaagcattactgcatttgcctaatatttcttttactatacctattggtctgagtactttaagagaaaccagtgtctgtaaataatcttccttcttgtcagacatggaggcagaaattttccaagaagagagagaccctgaagacactgtttgttctctgctgttcttaacaagtactgcaaccacaattttggatttttctcctcgaggctttctagttgtaggctgccacagaatacttcggggtcacagattcctattcccttttaaactgtatcgggcatgtgtgttatgtgacctttgtgttctgaccttcagatttagggaactgaagatttaggaagtcttgttaggacttaaatccaagtaaattccctcatgagtacaaagactcatctgtggaggtgtggaatgttggagagaaagggactttcattcatctagccccctgggttagaaaacagggctggtgagtgatagagctgaggctagcatgcggagatcagactagattcggctttctgctggcttcctccatatcactcagtacttctggagttgtagcatgcctcttccccctggactgggagctttgagagggacggcactgggtgtgctctgtgcacggctcttctagaggtgatccaagtgctttgcataggcactcaggatttatttgcttgatgaatttgaacctgtctgttgttgataaaatatcattattgcccataaggatcttgagggagtttgtaaggatcttgagggagtttcagtcaggattcactataggaaacaaaccactttagatattttaagtggaaggtacttaatacagggtgtttcacagaagtaattagatggactgcatggagcagaatcgaggctgtctccagaaatgaatcacaaaactgcacaaaattattccattttctacaatcaagcaagacaaaaatggtgaagccaccatgggaattactgagttcagtgatacatcacaaaacttgtgaaacagagatcaaaagccatagtcagaatgatggtagctggacactgagacatgagtccagctacttactctttttgtcacggctgctttttgacagccaccaagctgaagactcaatatgagaacacagatgctgaaaaaccccatgtctgtgtcaccattcttctaacagaaaacagggcaaacagcagaaacatgtcttccatcttacttttgcctttcaaatatcaagccaattacatatattttggtagaatttcttttgcaatcaaaccttacctgcaagacagcctgtgcaatatgggaagtttgagtgtcgatctaccatatccaccacattaagggtgatggttttcatatttcgggcatgtcttccataaggctttgtgtgtagtagatattaagttggaaccagagtaacaattacgttctattacatctctacttgtcagtgtagttaattatataacagaatggactgcaacagttttactttagggaatccctaagggggaattcctatttatcagaaaaatgctgtaaggagggaagaccctgaggtgggagagtattctaaactgttttggtttcaaacatcttggaaagtactacatggagacatgcgatattataacatatcagtgcttaccatgtctggggggagttctgtcttaaaaaagcttgcctaccttctatgctgttgctccctcgctgcactgttttgaccccactttcctcctcaccagccaaatacaagttttgcaatgagaattaatgtaaaatggtttctttataacaaactaaataggcttattcttaaaaggaaacatagaggttgttaaaccgttgttttccctacatttcatgcaatcacagtacaactcacaggtcagttattcttgaattttaaccaaaaatttctaaattgtcttgacaataaacaggcaaaataggtaaaagaaatttccaaaacaagcagaatgagcaactgggaccatcctggccagatactgaggtgcatttataaggcaaccttgattgaaaaaggaggtggtcctggaatagatgggaggccactgcagtaacaaaacccacccagacacaaggcaactgcacgtggaattaataggccataaaagaaccaccttgaaacattccgaaatgttgagccttcactgaattcttctgacttttccctcaactctgtgtaaccccaatttagaaatgtgaaatagttgttagtaatcccttccacctttacattgtaccctagtgagtgcatttggatgtattttagacacattttttttttcctgctccaaattaagaatcaggcaacatattgtccttctagtacttgtaaccaagtatatattataaaatcactgataatctcgtatgtgtggggtcaggtgttaaagatataattgaagtaaacactcttgatttatttttatttttattttaagaaaaagtgacatttttgcttcaggagaaagaggctgagtgaataggttagttgataatagtttctgctaggtttctgctatatcttgcttttctcccgaagattcattttagtaccttctttccttcttaagagcacatgctcctaaagcagggaagcccccaaagcctcctctacttcccgttgctaattgctgtggcctcttatccacgccagtaatgaaccaaaagtatgggagggctttagccatatggaacttctgggagaggacttgactgtattcaggattcacttggactaaacgaccaaaacctcattaacacagtgttttcagtaggtgattatatgagttatcgtcaaaactgggacacttttgcaaaggggcactgttaataattacaccagaacagcaggtataaattggagatgtatggtcatcctaattatacagagccttcaagaacagtgtttgaaatgtgaattaaaacgattcgaaaccagagcttaagttctctagtatttttcatgggtttaagtttaccttctcttttatataacaatcacttgctgagatctgatgatgggatatactgtgtattaggtcctaggaatatatagataaagtagataccaattttgtttttttcttcactcacagtattgtaatattttagaccagtgggtttccagtctggcttatagcatactggagatactagggcaataatgcattttatgcttcccccaaattaaagtatgttttgccaaagtgtgatgatttaaatgcccctgtaatggttttattaatttttctatttatacttggggtttttgtttatgatttggcatgaagaaaccatttattttgctaaggaaaagtttgaaagctactggtttgagacttaaaaatttatctttaatatttggttataaagtcgtaaggctactttttaaagaggggaagaactagactgattaaagctgaaacacataaagatgtaaactgagtgggaaacaaataaattacctgaaatatataaaggtctgctatgtattagaggttttgtgattctagagggcacaggtaggaccaataggtggtacttatgggaatacaggcttcagctgcagaaaactttctagcagtcataacttttctgccatggaaggggctgtcttgtaaggtaatgagttccttgtcattggacatgtacaaatgaactcacagatggtgggtaagcttcatcttgagctccacattagataaaatgtcttcattaacaatttcacacttcaaggatgttaaacttctgtattggtgaatgttgggtcctttgctacttctttaaaaatatctaaagtgtgtgtgtgtgtgtgtgtgtgtgtgtgtgtgtgtgtgtatgtatttgtgttttatttccccagaacattagctgagtatatttttcatgtattttattttatatttttacacagtggtcaataattgataaaaatacagaagctactacaacagttctctcatcaagggaaacttaaaagggataatgtccatagatgtgattctgaaactgatttgaaaaagcctggttcatttttactgtgttgccattggttaatgcttaaccagattttgtctctgtttcaaaatcttgaaataaaagtggaacaacttccaacatgacttaagaaaaaaggtccccagttgaaaatgcttccaatcgttttgctattaaatgtgaaattgcaaaactagcctctcttacaaaaactagtgagaagcttgcctgtttttcataccatttcaaatactgagaaataatttctctaggctcttggaattagagttaaataaaaattatatttcagagtatataatgcatgaagttggatttctttgttttctaaaactgtatctcatggtccttgaaggttgataatttatatctctggtaccactttatttttctattatttgtggattaaaaattttaaatttagcaatatacttatattttgctttagaataaagttgatttttaaaaacttatttagagacagggtctcattctattgcccaggctggagtgcagtggcatgatcgtggctcactgtaaccttgaacccctggtctcaagtgatccttccacctcagcctcccgagtagctgggattagagaggcgagccaccattcccagctaatgttttttagaaattattattattttttttttccagagacacatcttgttgtgttgcgcaggctgatctcgaactccaggcctcaagcaatccagggtctcctcccaaagtgctaggattatatgtgtgagccactgctcccagctgagctttttcttaatagatatttaagatgatatgtaattagagaatcggagattaaactggaaactttaatttacaataacaataaaatattaattcaataatagtaatttaaattacaggccaggtgtgatgactttaatctcagcagtttgggaggccagggtgagagcaccgcttgagcccaggagttcgagactagtgagaccctgtctttacaaaaaaaattaaaaaatttgccagacattgtggcacacctatagtcccgactactttggagaggctgaggtgggagaaatacttgagtctaggagttgcaggcttcagtgagccatgatggtaccactgcactacagcttgggcaacagagtgagaccttgtctctaaataataataatgataataataataaaaataaacaaataaataaattataatgtccaaactcaattcaaaagctctaagctaatttatagtagttctgatgtaggatacaaacaacacagttgacagttttgtgaacaatatgatgttcaaaaggctgaagtataatctctaactccccatcttgttgctatgattactcttagcagattatgtggcctgaatcaacattggttcacagtcacaagcagtgttatcagatgtaaatatgtcttaacgttcatcaatagtagactcatattcattgaaggaaaaattaagaatttctactttttcaagttataactaaaattgcttttaaaatcttccttattttattgagatatcaaaataaatattcaaaaacagaaaaatacaaacagaatcattaaaaaattaagataattagaacatcctaaagtggtagcaaaatctcatggcctgactaatggtcatgacacacttgtaaatggatatctaaaatggagtgtttacatgttttaatacaagtttgaacaagctgtcagggaaacacagctaagtgagctgcagttaacttgcagacttacacagttattggtaggtttagaaatagaagatgctagataaccattaaagagattgctaggtctcattagagatcatattggtgatttttcctatcgtcactttttcctgggtgaggggcaaaatctttatgaattaggcacttagcgtctcacctttacaaatccagatttccacctttagaagcagatttactgaactcaaagaggtgcaggctattgttgcctgttttctcttggccttgaacagaaaagcagtctataagaatcaaggacttataagaaacctgctaaggagcccgtttttttgccagcactgcacactccacagactagccataacattgtggatcataagaagttgtgggaggagattttgaaggtcatcattagttgcttattattttaaatctgcagaaactgaggtccagagagaattcacattttcttggttactttgccacgtggaacaattgttatcaaatgtgacctggaatgcaaggttggggccatttatcttctgtgctaattttcagtgccatggttgcgaactttcttggcagagaaattgtttacttctgtgccctattccattgccttttacctaccccatctagttataatctagcaatagagttataagcttgtgtaatcaaactttcccactgcagatgctctttggagacagaatatttgggtttaaacccagcctctgatatgttctagctgctctattacattggataagtttctttagcttctctaaatctcggtatttgaatactcaaattagaagacgtaaattatttcctaagatttctcctagctggggctctctatgaccttttagctcttaagtagtctgtcctggctattgtcaaccatgtctttttttccttgactgatagaaactgtggcaaacaaaaggccacttagtcagtatttgttccgtccttaaccttctctcctgagagtcctgatctttcagtgctgttgtttccctgtcagggttgattgtttccttttcgagtgccgttctgaatctgaagtgaaagtgcagcgtggaggcatgtcactgttgtgtctcacttctttttcttttttttttttgagatggagtttcaccctgtctcccaggctggagtgcagtggcgcgatctcggctcactgcaacctctgcctcctgggttcaagtgattctcctgccttagcctcccaagtagctgggactacaggtgtgcacctctgtgctcggctaatttttgtatttgtagttgagaaggggtttcaacatgttggccatgctgatcttgaactcctgacctcaaacgatctgccttcctcggcctcccaaagtgctgggattacaggtctgagccactgggcccggccgtgtctcacttctttatctgagacaatgtttactggtctagacctgatgcttctctcccttgctgcttcgtagtttatttggatcctgaaatgccgctgagtttttcttgtcacctgcagcattgccaagaacaaggagtgcaccattagtgttaatttattttttctggtactctgtgcaaggcagatgggcatttaatgtgctgattccaaccctaccttccctcatctacactccctggtctcataggagttaaaacatagttttgtaagaaaccttagctccttgaacttgtggacttgtgggagaatcatggaaacatgagagttagagggaatggtagtggatatctaatctttagtgtacagataggaagggtcactgaggttcaaagaggttaagaacgaaagtcatagacccaattagtgactgagctagatagaaagtacgcccaagtcctctgcatctaagtctagtgccttttccagtttttccaaatgtctctcagatagcctatataaaggtttggcatttctgtagcgttgttctctcgttacctcttctgagcaatgccagctgtccatgcagagagtggggcacttagccagtgctgggccaaagctgtctgtaagaagaagttgagtgaatacattgacattttcagcccatggtagatcctgctttgcccttccggctctatgtgacctgatgcttcagaggaagagtgaatacatttgctgttcaactaacaattgtgtgtaattttcagcctgccttattcttcaatgctgtcttcccacgcctccaccacatgccacagcatatctgcttcgcaattacgctggtagggacttaccccgtttggaaaaggtttgcctaaatacttatttacttgtgcatgatacatcttgattgataccttgttaatctctgagatcaacccaagaatccttccttcaagggggaggatagaagagtcagggaaacgggtgacagaaaaagagaaaaagaggactgtgcttcctcactgatgagcaaagaggagaattacagatgatatcaaaacaatgaggagaatcacaggtgatatcgaatctgctttacttggcgttggctacttgtaaagtcaagatctttcatagactcataaaagcttgtgagcagagttgtcatttgtaccatctaattccatcactacatttttcgagaaggacacaagatttcagagataacggaagttacacagtgggctcatggcggagctaagactagaagctgggtctgaattctgaagatcaggcatctttccactaaatactgagatgtgaacaataatggagagccgtatagcccagaggggaaaccacattataccactttagtggatgattaggaaagcagttttgaaattccaggaaggtactgacttttgtataaagagaatgttttaaaaaaaaaaaccttcaaagttataggagagtgttatttaaattgtaacagcttgtttaaatgaagaaaatgttgctaagggacatgaatgctaaacgttagtctgccatcagctacttctgatgtttaagtcaaatagtccctcagttctgtggtgttaatctacgtcccttttctaatatcattcatttattcagtgcacactgaccaagagctaggccttgagttagttgccaggaagatatagggactaatacaatgtcatttaaagattaatagaaatgctctaagtcaattattctcaacccttgaatcagagtatatacataaagatccccatatgaggttagtgtgcagactgttttgataaacactactctaagtttattgcactggatgttggataatatgatgtaacggttgtttgtttttcagttttggtgatctatataaatctttttagaagagtagcatattgatttggacgaaaaaaaggaaaatatgaccaaacactacttctttctgtttttgtgggtgacagtgacttgacattcacatggtatcctgagagaggcttagtagctttgttagtattaattgtcagtttgcctatggcactaagttttcccacctatgtggggcgggtcctggtcatcacatagccttttgtagttatttgctttctgttgtgccttgattttttttttctgttgactattggcttcatcactttgtggtcctgtggcttattatgattagatttgagggtacagaatagagaaaacattatggcaagtagaattcaagagctggaatggaaataataagagcaaaaactactgttaagtgctgatttcctttgaattgtggtgttttcctttcttctccaaatagggaggtagtacagagtgaagaccggagatttggagttaaagatctgtgtcccagcttcagctttgctatttgttagctgtatatccttgagcaagttattcaacctcttacagtcttactttcttgatttgctagatgtgggtaatgatagtgctacctcatatggcagtcaggatgacagtgtggccattgaaaatttgctagacatataataaaccttcaataaacacttgtttattgtcagtctctagtcttcttaggaccgctgggggaacagacagaagagcagcagaggagttgataagtgaaacctcttaggttcttcttaattgcttgcatgtgacaatttctgaaagagcaatgctgaggaagcagcagctccccagctcccttcagcagtaggcatcttgcttagaggagggccactgctcttgctttcctgtctgctgatggtggttgtgtattctcagagcctctctggaaatcttccctttcacttcttgctttcatgatgattatgaacttcaagtgaaacctagctagaatgaggggaagtaagagcagtgtaaatcttggtccagcaacaccagttctcaccactgcttatttttgtgtttacatgggtctctcttagaagccaagagccccaatgatatgtgctagttcatctgttcattaaacttgtgaagtttcatcaaacccatttatcaaaatgaagggctgtaatgaagattttagagaaagaaagcactctaaaatattagagctgattgggactttacaggtattcattttgcaaatgagtgtcatctcttgttaaaggtcacacttatatagctgagactagaactggggccacagggactctatgtctatactattggatttatcactttccttggatccatcctacatgattcaatttttaatacctggagttttcactcttgttatcttcctattcaaggataaaagctctagcttcttatctttatataaaacctttaaaaggcagaactcatgttatcttttaaaactttcccctaactgttctccctgaatccctcattttggtgccgctggtctgatccctgtcctacagaaatgccttgcttcatacccaagctcacagtattatttctaatctttgccctggttactccagttttcttttatttactcagcattcaaagtcctggttaagggctacctctgccaagcttatgctagcttttctgacatcccccaagatttttcatgtgctttctgtgttgctctctttctcttttcacatttataaatatttcttcctcaaatagtctttgagctctttgagtaaagaataagaatctgattcatctatagctccagtgccaggcaaataaattcattcattcattaaattaacagacatttttattgagtacctatcatgtggtagcccctggaattataaaatgataaatatttccactctcaaggatttgcgagtttagtttggggaacaggaaagcagatgggcagagcaccatgtgacgaatatgtgacaacagtatgtagatgctgtgggattgtactataaggatgtataacttgaactgtagaatatagtgcaagatttgccttcaaggactagtagaaagtaatgcttatgatctaaattgatgcatagtatgttggaagtcatttttagacaagaagtagcttgtttcagagggagcagagatcaaacctaggaaaaaaatgtgaatttctatcagaaaagtactgcaaaatgacctcagaataaatagaaaactactactattatcatagaagttactggcaatatgattaatgtctgttaaaagaagatgtatttagatgactttatgctgaatttggataacctttaaaaaaccagataattccagtgtagttattaaatatcctagacagtagaggaggttggagaaaactcccctatcaaaacctaatcatgataagtaaaacaagcagaaaaaaatgctataaaatgatctttattatgattatatgtacacaaattatagataaaatagcctagttaattcattaatatatcaaaacacaagtgtaacaaaggatttattctaggcatgcaaagatggttcaatatgtagactttatcaacatatttcattacatcatcaaattaagggagggaaaaagagttgaatgtatcagtggttgctaaagagggcactgcagctgtaactagataggattttattccacaaatgccaagatagttcaatatctggaaatctatcagcatgcttcattacatcaccaaattaagggaagataaaagagatgattgtatcagtgaatgctatagcaattctagaaagatatgagtaactaagaaagagtaacgttcattcattctcccatttctatgtaacatacttgtttaaggggcttcctgcctaggcattgtgccggtatagtgagactagttggagtttccaacttgttgggacatgtaggcaggtaaataaatggctttcttgtggattgttataagtatgccgaaagtactaaagagcctagaaaaaggaattaggctactcttctttggagaagttagggaaatgttcacagagttagagacatttgagctgagacaatataaaaatatagggcttggtagaacgtgaagagagggaaacgacattgttgatggtgaacacagcatgagcaagggttcagaatcttgaaaacttattataaatcctgggaatggggtcactgggtcactgctgacatgcagaagaatggtaagagaagatactgaggaggacatctgcaaacaaatgattggtcagaagatgggcctctcaggaggagcagctggaggtgcttcttcatggagggcagcatgcgggtaatttatgatgctggggataactgaaatgactgtggagccaatgatttgcatattgatacttacattttatttatactctcccagaaattgcctgtttctttatatctgtgctatatccgaaaagccaagatgatacagtcagtcagtaacttgggattactatgaaaaatgtgaatctttgcttaagaaaatactgcatcctatattaaccaatttttcaaccttttattataaaatgactttagatttatagagaccttccaaggatagtattaagccattttaaaaattataattaacatttatactaccaatgtgcataatgcattaaaagttttaaacctttacttgatcccttttatttcacacttatattcactttagtcatactgaaagcaaaccagtcacttttatcccaatttagtagaagaccaagcctcaattaaaagcaaaagcaaaaccaaaattggcatttctcagccatgtgagatgggtttggttttggtatttagaaaaaaaaaatcatctgaagttattccaaatgaacagctaaatttaaaaaccacgagtaaaacagacattcattggtagtttttctatattggttttgtgctaggccttaatggtagtttataaatgtgtaaaatatggtccctacccttttaaggaactcaagtttagcaagtatgtatgtgtctttgtgtgtgtgtatatatatacatgtatgtatgtgtgtgtatatatgaatatgtaaaaggtacgggggaaagaaaaagaaaagaaaggccctgtaaccagagtgaaaagccagtaccatcactggcttcaatagcatgtgtcctgattaccagtttagagtctttgtcattgattcatgttatcctcgtcttttaagaaaactatacatcaagctgttcttccaagcaagatggtcataaaattgccattgactttctacaagaatagaggcttctttttttctcactttgcatagcactctatactataaaaagtactttaatatcatctcattggttgccataaaaattctgagagttaaggaagacagaggtttatatgtttgtttgttttttgagagaaggtctccctctgttgcccaagctggagtacagtggtgcaatcacagcttaccgcagcctcaatctcccaggctcaagtgatcctccaacctcagcctcttgagtagctggaacaacaggtgtgcgccattatatcctgctaattttttaattttttgtagagaccgagtctcattctattgcccaggctggtctcaaactcctggcctcaagtgatccttctgccttggcctccaaagtgctcggattagaggcgtgagccattgtgcttggctgagtcctctgagacagtgaaactatctgaggctctagaggcgatgccgttcaaagtcatgccacttgttggtggtgtggactgatgtgaatatccaggcaacactgtttcccagctctcccctccaccctgtctctctattactatgccatgtactgaggcctttgatttctgtgttctgatgctctttgtctttacagacatctggaggtaattgtgtagccctcttaattaattcagttcaattaataaattagtaggtggcttttgggctgggggcgcttacagggtgccttccgggcgtccctgtgctggagagctcttgcaatcaggcttggagagccctcctcggcagcagcctctgagtctcatccccagcaggcaggctgactggagaggtgattggcttaccctgacagaggagacatttcctctcttcaaatattatatgcaatctgatcagagcagcatctgggctgggctgattgttcccctcctagtttaagcaagcttttcatgaaggtccaacatggtatcagctcaacatacaagttgatgggcatttctttgttgtgcggggctgacctttgcattacatgtgttgaatattctatcctctggtcctaaattctaataattgtcccagacgttggggcaaccaatatgcccctcttccccttttccacataccccttggtggggaccagagctgctcctgcagatggatcatttaaaagtgtcctgccaggtatctgttaaaaccctgtttccaaaataaactttcagtggttccttaatgcctgaagaataaatttaaactcaactgtggctgctgagctgtctgtgctttggtttcaacccaccttttagttcttttgcttgctactttctgttattcgccctccaagcacactaaacgtaaatgctgtgtacttttctgcctgtataattttgccaacatttttcaggttcaaccctacttagcactcaaacccagtctgtatatcacctcatcaataaaatcttgttaattctgcccccaccaagaagtgagcctatctttttctgcatctcagcaacacttgttcttaacctcacttaggtaacttagcacttcatttaggcataaccatttaattggtgagataattaatttaatagattattaataaaattcaagctcttttccatcctcctaccataaaatctccttcaagttaggaaccatttcttattcatatctatttcccaagagtggctaggcactaaaataggtaactattggaagggagatattcaagtttgaggcagtgttctcttcctgctcctcctctttctctttctttctttctttctccttttcctctccttcctccttttcctcctcctctttctattcatgattcctctgcctcttcatttttctttcttccattttctttcacccttctttccagagaactttatcaggatgcatttagtatggattaaggtgaaatagcaatgaaatgaggagtattgtcttcgttttcatgcttccataaaaacagtgtttctttttcattgcagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtaagtgctgggatttcagagttggttacttggagtaggaaaattcagttatataggtgatttgtagtacaaagttgtgtcagaaaaacgtagtttgtgaattcacagcgtgggtgtcataggctactaaaagtaaaggagcccccggaaatagtctagaccaaccccgtcttttaggaaaaagactttttatgggttatatggctatggttacataatgaaatagggttagagctcaaactagaaacctggactctttagtcacagctcaatgcctttctactgcgttatcttccacctccagctcattctcttgtagggttttagctaccagacagtcatccctccctcttgccgttggacaaatgtccacaaatgctgccaagcagtagtccaatcagaaacttatacaaagtgaacctaataaagtgcatggaattgtttacctcctctggctgtttttcttcccttaggctgctgaaggataagttgtctagagtgttctgtgagatctgcatttgttgaatctcccagacaaatatgagtgaagcctagttccaggggttttaataacaatgcattcagtttacatcaagtagagtttgaaggtctacgtgagctccagctctcatgtgtatgtatacactcacacacgaagcctcagaggcagtataaatggtaccatactctttggttgaaaaggttccatatttttaccagtgaatgttagcagcttattcaaactcaagaaaaaataacttaaaataaaaaaaaaaaaaactgaagaatattagacttctaggagctgagagagaagaggcagtgaaaggagatttaactccctttgttttctgtccctgtcccaccattaaaaaaattattaatatcttaccctcttcatgatgtttccagttgcttcttggatgacattaatgtttgttttgtcaatattgcacgcaagtgtttcacactctgtgatatagtccagtcctcctcttttctttcctgtcctctcctgcgcccaggaaacactttactagtctgttagtattttgggtctgatgccagaagcctagttcagatgtctagcttgtgtaaggtgaacacctaggttgggtggtagagaggatcaggcttcagcatgcatggctaagctgcagctgtggatctttggatatccttttcctcagaaagtacaagaacgagaccctcagaaagctgctcttgaaaaacaataaatgaagcctttggtgctgtactaatctctgtagcactccatgatgttttattgccttagaaagagactgcatctttgcagttaatcaagcacttagtggaactggctttctttgactcatccttctttagtgacttcagggcttgggaatgggatctggaagagaatctctcttcatagggacaggaggagccatatgttggcttcctcatttatggttttttgtttttttttttttttttttttttttttttttttgagatggagtttcactcttgttgcccaggctggagtgcaatggcattatttcggctcactgcaacctccgcttcccgggttcgagtgattctcagcctcagcctcccgtatagctggattacaggcatgcactaccatgcttgactaattttgtatttttagtagagatggcgtttctccacattggtcaggctggtcttgaactcctgacctcaggtgatctgccagcctcggcttcccaaagggctgggattacaggcgtgagccaccgcacctggccctcatttatgttttcaatgtttccctttgtcagcttactaggggcattgttattttgtctcctaacttttggggaaagcttcagtggacctctctctaatctgaacagaatacagacatggccagttatagagcagaaggcaaaggtgtgaggaagtctttgtaggtatgagagttcttataggcctgagcgttatggtgagggcaggtcctatattaagtgggctcataaatggcatatatgagataggtagaagagaagcatataatggcctcgctttagactcctttactgtgaatttgacatgccctccttgtactatgtgtggttcacccactgtcttactctctaggaacactgaagtgatttgtttgcgtgccctgcagcacagtccttggtcccctctcaacatgccaccccacacgtttttgttacctgaaaattctatttgtatcactttctccaaaatggctaggtgcagcctaggtcagaattaatcgctccctttcccgagtttccacatcttattctttgacttatccaaatttctaccacttttgttattgctcctgcttacattctgtcccatattgaacatgtagtatatgccaggctctatgctttctctttattattttattgccttcttatgtaaccctaaaaaatgtttttttttttttcttataaagaaatggaagcttaaaggaggtgacattctctatgatttgcttggagtatgtttctgaactaaggctgctgtccatatccagcatgcggtactgcctgtccttctattcacagcacatgtggcagcaaaccccatattacagtgatacatccctgcatcccttataagaatatatataagctttgcttcctcattgaagcaacaagacatggtttctcactcgtccttatgttcctcatagctcatattatgctactgtgtttttagtaggaatggttgcatatggtcaaatgtatgtctgtgtgttcttatgtatgcatatatatttggatggctggcggatggctggctgggtgagtgcactgctcagtgatgcttctccaaagcagtttggaatatggtataactcagtcttttgttttctgaaattttggctctctcttgcatttctgccaattctcactctttttctctctccccctctctctaaatataataacctttaccttttctgaatatgcaagagaagaaattttcctttaatatataagttaaagacaaatcttgggaacagtttatggacattcagactttttaaaatagaagctacatttctgcatctgctgtatgaaacaaagatgtatccatgtatttgttggaagtagatttgcttttctttatatttaatttaaatgttatcagtgcattctgttactctgaacatttttgtaacttacatctattgtgtttgtttacacatttaaacaatttataaccattccttttcgtttctttttttcatttagaatgttctatactctcagtgaaattcccaagatagtaggtagcacaggttttatttccaggatgcattggtgataccagcttatgctctgtattgcctcagctcatgctgtttttggcttttagagtgtacttgtcccccagtttcctgcttctacagtcttttaattcattgcttaaaagttgacctccacgaagctcaaccacaaatgcagaaagttagaactaatagaaatcacgcaatccatcttgttctgacgtaaatgtgaaaactgcagtctagagagtgtaagttatttgttcagagaagcacagcctgctctgagccgagttggcactcaagtcttttccctctaactctagagttacccaaaccttgtactatattctaatggcaaactgttctttactaccccataccctcatgcattgcctacaattcttatgacaatgtgttttttaatagatttgcttgtatatgcacctgtcttctctagcggagtctgaactttgagagtcaggggctgcctgactcatgccttttccctcaacagcacctagcaggatacctgacacatactaggaactcaatagtgtttgcagaactgaattaattgataaagcacagtaatataaacctacttctccagacacaggttctaggttctcagctacttattagacactgtggttctgcagtttcaacccacgtctttgcattacttttccttcctatgcccattctttgaacttacatttctcaccttggtgttacgtctgtaatctctggagtttgctttcccatgttttaattctgactgtgaaagtagaaaaatacccacatgttttccacatcaacttatctttctggggtacccatatttataatttcttttataagatattctgataataaccattttctaaagggctttggcacactgaaaagtggggcatgctttttttcccagttagtagctctttagatctcagggtccttttattttacttccattgttctcatttcttttcactgattttgtaacaagttgtgttttcatagctaacttagaatacccctacatttccaaatgctttctctgtgttcaatgctttgtgcttacgaactcatacttattttttaattaaatttagtcttcttagagattttttttagttcaatagcttttggggaacaggtggtttttgcttacatggagaagttctgtagtggtgatttctgagatttcggtgtgcccattgcccgagcagtgtacactgtagtcttttatccctcacatccttcccatccttcaccctgagtccccaaagtccattatatcattcttatgcctttgcatcctcatagcttagctcccacttataagtgagaacatacaatatttgattttccattcctgagttacgtttagaataatggtctccaactctatccaagttgctgcaaatgccattatttcattcctttttatggctgagtagtatcccatagtgtatatataccacaattttttatccatttgttggctgatgggtatttagaagatatacagacaataatcatatgaaaaaatgctcaactcactgtccgggaaatgcaaattaaaaccacattgagataccaccttactcctgcaagaatagtcataattaaaaaaataataaatgttggcatagatatggtgaaaaggggacacttttacactgttggtgggaatgtaaactagtacaactgctatgaaaaacaatatggagattcactaaagaacgaaagtagacataccatttgatacagcaatcccactactgggtatctacccaaaggaaaagaaatcattacatgaaaaagacacctgtgcacacatgtttatagcagcacaattcttaaagattttatagtgttaactatttcattttttgtgaaattattttggtatatatttatgatgttgttccatcactttctattctgtgtaactgatgacaacaagataagataatgcaatttttcttctggtcttcaaaatactagcctttagtgttgtttgtcctataatctgggttttcactctgctccaaatcaaaaaataaaaagatacaacaaacaacaaccaccccacccccaaaaataaaacaacaacagcaattaaactcagtcttagactttgatggcagaacagtatagttctttttctgtttttggtaaatagcaaagcaaatgaactttcctactgtactaatataattttttaaagatggtttttgaaattatcttactaatacactctggggattagtgttaggttgcctttaatggcaaaaaccacgattacttttgcaccaacttaataactctctctctctctttctctgtctctctctctctctctctctctctctaatttggctgaatgaaatttgataatactttttatccatcattaaaatagataatcatttggaaagatttgtaaagttcacgtttgtgaagctggagttgtcttgtggcctagaattcactttctttaatttctgaaattctttttaaaaaacatttttatgttagatttttgaaaaaacaaattggcatgacatgccagttctcactctttttctttctccctctctctctctaaatataataacctttaccttttctgagtatacaagaggagacattttcctttagtatataaattaaagacaaatattgggaacggtttgtggccattcagactttgggtctgcattaggtaccaattcaacgtgatcattttggtggaatccttttatattggtatactcttttatagtttatttagcagttgcatgttcattgtcttttcatttcagtagaaaattcttactgtcactctctgaggtaggtagaacagatgttattgtcattttgatgatttgtaagtagtagaagtggaagagcttaataaggaatcatgtagctagtaaaagagtagagggagaccctcacacctagggctcttacgaattttaaatgctttcgtttattaaagcgttggctacacagtctgatgtctcctttaacttcattattttattatttcatgattcttctttgaaattaatttcaaaatggtgaccctttttacaaaccagctttgtgaatattggttcacatagacttgtcaagatagatcaagataggtgaggtgaattatattaaatagggatcctaagcctggattatttttttatgacatctttctgtgctttctgctactgtgaggttacgaatgtattattccatggaggggaaacagttatagatgattgctaatctacccatgagtttggggctgaattgatccagaacccaggtttcctaaatgcactcattcagctgtaccactgtggtttatgggaaccaggcaagtttggagcttggttcctaggaactgatgagtcctggattattgatgcttggtggagaattagccattagtgatgtgaagccatgtatcctgggtaggcaggacacatttgttttcttagcagataactaacatgtgagggaaatggatgtccacttatggcattatatttaaaggaataatttagactggattttccccattatttttgctgcgaacgtatggtcctcatggtgtgcttttctgtctctggagtcttattgtccttttccccatgcaaagagaatcttgctctgactttggagatacaaatgggaaacatcttttttggaggttacaaatgggaaacatctttttgtaatcctgacagtcctgttaattgcaattagagactgcagttgtaacatcttggacgtttggtataagtatgcgtgttatgccatgaggatagccacaaattcacggaaacatcaggaactgtaatgaagctcgggtttgcctgtcatgccccttttctggatgagcgtaagcatctcgagcctcatccatcactgcacagtgcagtgcatgagttttaattttcaggtcctcagggggacaaaagaacaagctgtgtattcattaaaggatcaaatattaattgtattaatttgatctttacactgcatctttcagcagagaaattaacttgtaattcttggagtgacatcagatcttaccaaatattcttaggccttattgatgctcaaaagtgccaagatgcagccctggcttgatggtcagtgcagttacattcaagcttcagtttcatcacttggccttgggcatgatgcttttctaatccatatcctctttaattcataaaatattagctggtaataccaactgcctcacaagattgttttgaaagccaaatatgatgataaatgtgaaaatgtttttaaaccataaaataccttataactctaaggagttactattatatacttattcagcagtcatttacttaaaacagattttgtgccagatactcttctaggggctgaagtaatggcactgagtgaaacagagactagttcctgccctcttgggatgtattttcttgctataataaaaataacattattaataataatagtgataacatttgtgaaataaaatttatttaataaatgcattttataaccttacatataattaccaataactattcaaaattataaaaaatactttaatataggttaagtaactctaatccaaaaatctgaaatcttaaatgtgaaaaaatctgaaactttctgagtgctaacacaatgctcaaaggaaatgctcacaggaacattttggatttcagtattgtggattagggttgcttagctggtatgtgtaaatattccaaaaatccaaaaaatctgaaatttgaaacacttcatgtcccagatgttttgtatatgcgatacttagtctgtagtaatgaatatgtgataatataagtataataataatttagcatgttatccataagtactcatgtcattagcttctaacaacagtgatagagatcacaatgcctcaacactatataaactgtaaaattctagaaccagggtgaatcttaaaagttatctaatacaacccctttctttcctagatgagaatagttgagaatgtattcactaatacatttcagcgaagtacaggttctttgcccaggagtgctgtaaataaccaatgaaaattcttgaatgcaggcaacaatttaatcttcatttcagagactcagagaggcaggtggcttgttcagtattgcagattagtaagtggggaagccaagccatgatcctggggattccttctctggttgccatagacacgttttgggggacttgtttagaagttacagtgattgaactaatatacccgaacaaagtggattggatgttttagaacaaggagaagtccctgtattgttgacagaaatctcttttattttgtaacttgtcagcttaattaactactgaaatgagttccttaataaggtgatgggtgcctcctaattcttgtatggttcaaaaacaataattaatgctgatttgtgtggtgagatacatattaatcatctttatttttgaattatacaaatatacaatactattgtccctccgtattttacatctgaagagaatttaattgcttttttgataataaaaataaacagagagccacaaagagatatcaccacacatgtattagaaaagctaaaataaaaatttgtaccagatgctgctaaggatgtggagaaatgatctctcacaatgctggtaggcatgtgcaaaattttgtagccacgatggaaaactctttggtggtattttacaaaagtaaacatgtactaaccatatgactcagcaaatataccctttggcatttaatccagagaatcaaaatgttatgttcacgaaaaaacctgtacatggatgttcatagcaacttttttttttttatcataatgacaaaacactggaaacaacccaaatatcctttgatgggcagatgtttcagtgaagtctggtacagccatacaatggaataataccattcagcagtaaaaaagaatgaagtattgttggtatatgcaataatctggacatgcttaatgaaaaaactgtctcgaaaggttacatgtattatatgatttcattttaagacaaagctctagagttaaaggacatattcatgattgctaggggacagaaatgggtgggtcgggggggcaagtactggtcattcctacaaagaggacgcagcaagagtctttgtatgggtggaacagatctgtacctcaattggagtgatgattacatgaatctatacatgggataaagttacatagaactgtatgcacacacaaatcaatgcaggttataaaatggtaaaaactgagtaactcctagttaacaataaggtaacaatgtcagtttgctgggttttcgaatgtattacagctttatgagcattaccatttagggaacctgggtaaaatgtacatggaaactctgtactatttttgcaactttctatgagtccatatttaaaaaaaaattaataatagtaaaataaaggaatgcatatagatatcttaatgtattcttctcttactcaaagtgctatcttacatgccatctgaattgcttgcatgatactttgaaagatcactgctatatgtatccctgccaaaatgtatggcttaaacctgtggttttcaaagctggccagtcatcagaaagacttggagaacatttttcaaaagaaaaaaattaaagcaagtcctaggtcccatcacaattttacagaatcaaaatatctggccatggggcccaggaatctgcattaaaacaaagcaaaataaaaaataaaacagaacttcccgggaattgtgattgatgctcaaccaacgtttgggaaccactcatttatttcattaacttcagggaccagtgccttaatctcctttgaaccttctccaagtcctgagagtgtactcttcctcccgtagttaatgatggtagcttttgaagtcttgagagtctttatcttgtgaacattgtacagattcagagacctagagcatccttcatgttgctattcttttccctcagtgctttcattatagacaccaatcgtttgcatatgttgtcctgggtcattttatttgggatccaaaaccagaaaatttcaaacaacaacaaaaaaatggattcttcgagaatgccctagccatggccaagcttctgcattacagagctcttgctattgtgttgctttgggtagcaatgcctgaaatctcagccaattttgggtcacagtaggcctatgtaaattatctaaaaatggattcattatggacattataaaaataaatctgacacctgagcctttgggcaaatataccatataaagaaatcataccctagaataacgattaacctaaagaacttaaaaaaaatcagtatgatatttttatcatcctttcttaaaattactgcattcagagagacctgatggctgaggacagcacctggggcagaggagtataggtcattgggatgtggcatcctgagtcttctagcagtttgctcttccagcactctcccttattatatgttctttacattgttctgtatgtcgctgtcttcaaacagaatagataagtctactagtcaagatagacatataacaggcaccacatgtgcataaaaattgcattatgtaaatttagtgccgtaatataatatgaaggatgtcctctaggaggaactggggaaagcatcacagacgaggacacatctgatctgagtgttggagaatgagttagttgtttaccaagcagaaaagggtggtggacagcatggcatgccaagtaaagggaacagcatgtgcaaaagcagagaatggcccccatcctgacccttgtaattttggcagctctttgctgatgtcctcaggcaatgcatctgggctcctgggaatagctttgcaatgtgaacagagtgacttcactatgggtagacctaaatgttctagcgtgctctgaaacttacctctagaaatagctccaggaagttaggtagcttcagagaggaaggaccaagaaatatgatcttataccacaggcaagaagtactttcctggaggtactggccagaagtactattgctatctctctgcacttgtctgttatattttagaatgaaatgtgcctgtgcatacaaatgctaaggcaagaaagaaaaagcaaaaggcaattctctttaaatctcctgaaataatttcaggcagctttttttacctagtcaaacacacacgcttaagaatggagttgtaagctaacttaatcattttttgttttgttttgctctcttacttgttcacacgttggggtaatcctgagaaaacaggaagcaatgaaagaaggattttattgtgaaatgttcattacaacttgtaattttaaaatgtgtttgtatgagtgtgcacaaatgtgaataaattttagagcactttctcacataatatctagtttaatcaccagaatatcctgcaacgttattatagttcctacattattatggttcctaaagacaaatgaaaaatctgtgattcagagacccaaggttaggctaataaatgtagaagtcacatttgaccaaattttagtatcttcccttaagtattggtaatgtacgataaacactatttggtaataatgaattattacaattactaaaacaacttatctggcagaacagtatcttaactatttgaaaaatattgtagtggatttattagcttccatttcatctgaagtccactttgctttactgcttactttatctttctagctactctgtaaaaaagttattatcaccctcaatctgccaagtataatgtatgtaaagtgaaataactagcatattgcaaagctgggaattgaacccttgtctcctaaatccaagtctgtagctgttcctcagcagtacactgtatctcatgttaatgccattattacttgtattaaatgaaataatttttccatcattattttcccgaattattactatccagagcgatttgaaggttaaggtcatccaaataatgtgtgaaaattgcttaaaatcaatctcctgtgcatggatgtctatgatgtatacaaatataaaacagccaaagtagtctcaagaagttattaccaagtttctcaaatagtgtctcaaggcgacattatttgacaagacctttggaataaccatttggaattttccttagttcagttgaattgtgtcatcttgcttaaacttttcagatatcaggggtagttttattgacattacaatggaattaaaatgacattttattttattttttaccgttctatagaaatggcattttaatttgtcattatttttattattgatctgttaatgttgtaatgacttgggttttagtaagggcatcctctgtaaaaattacctcctgggaaagaaatctccaagttctatgaggtctcccagaaatatcaccacttgaggtgagagtaaagtgtcatgaatgccacccaatgtgattcctggtagataagatttcactgttttatatcttgacatctgcattaaattccgttcttttactgggtcctattcacttccatcttgtgccattgttacttaaccaggctctgtagtggacaggaaaaagtaaaaacacgtcttagcccttaaacagtttatattttcattagaaattcaacatatgaaaatgcccagttaactaacaatataaagctttactgtacagcttctatttgtgaagtgactccatggctaactctatcagaagaaagagtttgcttggagccaaggtagtattggaaggttacagagaagaaagactcagggaggcagtggttaagcttgtagactctggcatcagatagatctgggtttcgagttttgattttacctcttaattctctggaaacttggactcaccaggataagtggcaacctaagttctttcagttttaaaatagagatagttatgcactaggcgtggtggctcacgcctgtaatcccagcactttgggaggccaagggtggatcacctgagatcaggagttcaagaccagtctggccaacatggcaaaaccccgactttactaaaaatacaaaaattagccgggcgtggtggcacacacctgtaatcccagctacttgggagactgaggcaggcgaatcacttgaacacagaaggtggaggttgctgtaagccactgcattccattccagcctaggcgtcagagtaagactccatctcaaataaatgaataaataaaaataataaataaatatatgaataaatgaaatagagatatttgtatcttaaagagttgttttcaaagttaagtcatgacaaaataatgacaaaatcagtggaagctgcaatcattgttcttgctattattattgaaatgaaaatatgaacattagctctgagggttctatccatagttttttttaaaaaattctgattataaaattttaattataaaatcccatatagctcatgctgaccatttaaaaaataatcttagttgtatccttgtttctttttgtatttgctaatagagattttagaattggcttggtgtatgtttgtccttgctagaattatgattccttttttgaatttgcattacacctttgttagaagtagaattactttacttgaactttgtcaatgtggcaaaaaatgattcatgtttatattatctctttgaaaagtagtgtttttactattgaactataagtacagttaaaatgtaaatgaacatttcagaaagaaactattgatttttattaattaaagaaattaattttccaaaatgtcagttgctacagagagattttagggattattaactacacaatctcagaaaaattaatttaattagggattttattttgggttccattcgtttttgagattcatattttggattaagccagtctcctgaaattgtatttaaacttagtctgcgtgtatgtcttttttagggaaagcattcacaacaccatcagaccctcgaagagattcttaacttacccattaagaaaagtaacatctctgtctaggggtcaccagtctctcaagccagttatattgttgctgcttgaataaacaaaacaggtttttatttctgctcttaccaacattactaggctgtgtttgtagcaaaaactgagtatgtggtggtggtagtaactacagtagaaagtgtaacgtgtacacaattatatcatgatacatggtttttaaacacattttatatatgtatatatttaatttattcacacaacaaatatttgcacatgttgcctgagctgtgcatgtgtaaggcagggcatagaaatgaatagggcatgggttctttctgctgaattagatggtaccccctcaccccccattttactgttgaagagagggaagcttggtggtgaggtggcttgccccagaccatacaggtaaaaagtagtccagagtagattcaggcataacttgtttgaaccaaattgtgttctttagactgcaacatgctttctgttccttagcatgtaactattacccatgtatttttatttatttttcttttacgtgaatttaaaatgtcatatttgttctgcttctattactgcagtcttgaatgatgattcatcagtgcagtggcctattttagtgaaccacaatagcttgggtagaaagaaaaaagatccaacatacacaggaatggaaagcagccatctttttatagctaaaattgcaaacatctggcaattactctattctacctcccttcaaaaaagaagaatcatcccttcaactggagcctgccactgtgtttaatcaaggcagaaagcaagccttaaggagcaataggttttgattcaaggaggccattgcctaacctagttggccaaagtctcttcagaaaataccccatttagtgctccccataagctactgggttatataatgatagtaatggtaatatagcaattaataactgcagaaatccccttttgtttttctgctgtttcatttgtggtggctcttatggcagcttttatattgtgaaagttaattattttggtcagttttgcctgtctccatctgcttaagcttcttgtattccttaacaaaagattcaaccacatcgatacaaccaataattgccaacttgattttattataaacatgtccggtaaaatgctgaaggaacaaataaatttatttttaaagcctggccgtgatcttacagtcaaaaagtggtccaccaaggttatggctcctaagtaccccacccgtatttcttattgtgataattgtttgtgaaactagttcttccctcactggccaaagtcaacactgttggcaggggaagtgagaacagctggtggttcacagtatatgctgagaatcagaacttctgcatttttctcatggggctagtaccagcttttgctctggccttgaccaatgcacgtacctttctcttccccatttacctttctcttcctctaggtctctgaagagtagaggtggatctttcccttcccaggttgtgccaacattattaccaatgttcccttttgttgtagaatattttggtcagtaatcatcagtaatcgctaagtaacagaaaatcaaggttcgacagcacggttttcaaaaacaacctcaaatactataaatagtctgttttctagtgttagcagattatggtacatggaaatcataagcattcagtgggggcctttgagcttacattaaatgcctgccttttgcttttatgtctttgctagaactgtgttcaatacccaaagacacagctttttctttgatataataatttttctaggctgtctttcctgccagtcttcccaaaatcccagtgaagtttgcaaacacctcattaaactaaatgcagttttgggagagatgagattgtgactagggagttttctggtttttacaaaaagaatagaaaaagaaaaagaacaggaactcctaacaacctaaaatgcatgccttgtgcaatatagttatcccatgcagagctacatagtgtaacgatctctggaatctcaaatgaatgtgctcccttttctctgtcttcattcagttggatagttctggtcttcctccctcgtgtgcacatctttgaacttgaactactgtattacagccagtgttctaacctatatgcgtttctctttggtggccctgctaatatagaagaggttacgctaatgttccttaccatatttttctttttggtgtcttctttgtgtgtgtgtgtgtgtgtgtgtgtgtgtgtgtgtgtgtgtgtgtttttaattgtactttaacttctaggatacatgtgcagaacgtgcaggtttgttacataggtatacacatgccatggtggtttgctgcacccatcaacccgtcatctacattaggtatttctcctaatgctatccctcccctaggcccccaccccctgacaggacatagtgtgtgatgtacccctccctgtgtccatgtgttctcactgttcagctcccacttatgagtgagaacatgtggtgtttggttttctgttcctgtgttagtttgctgagaatgatggtttccagcttcatccatgtccctgcaaaggacatgaactcatttttatggctgcatagtattccatggtgtatctgtgccacattttctttatccagtctatcattgttgggcatttggattggttccaaatctttgctattgtgaatagtgctgcaataaatatacgtgtacatgtgtcttcatagtagaatgatttataatcctttgggtgtatacccagtaatgggatcgctgggtcaaatggtatttcttgttctagatccttgaggaatcgccacactctcgtccacaatggttgaactaatttacactcccaccaacagtgtaaaagcattcttatttctctacatcctctccagcatctgttgtttcctgactttttaatgatcaccattctaactggcatgagatggtatctcactgtggttttgatttgcattgttctaatgaccagtgatgatgaggtttttttcatatgtttgttggccacataaatctcttgttttgagaagtttgttggccacataaatatccttcacctactttttgatggcattgtttttttttttcttgaaaatttgtttaagttctttgtagaatctggatattagccctttgtcagatggatagattgcacgcttttttttcccattctgtaggtttcctgttcactctgatagatagttttttttgctgtgcagaagctctttagtttaattagatcccatttgtcaattttagcttttgttgccattgcttttggtgttttagtcataaagtctttgtccattcctatgtcctgaatggtattgcctaggttttcttctagggtttttatggttttaagtctcacatttaagtttttaattcatcttgagttgatttttgtataaggtgtaaggaaggggtccagtttcagttttctgcacatggctggccagttttccaaacagcatttattaaatagagaatctctccccattgcttgtttttgtcagatttgtcagagatcagatggttgtagatgtgcagtgttatttctgaggcctctgttctgtttcattggtctatatatctgttttggtaccagtaccatgctgttttggttactgtagccttgtagcatagtttgaagtcaggtagcatgatgcctccagctttgttctttttgcttaggattgttgggtctatatgggcttttttttggttccatgtgaaatttaaactagttttttctacttctgtgaagaatgtcaatgctagcttgatggggatagcattgaatctgtaaattactttgggcagtatggccattttcatgatattgattcttatccatgagcatggaatggttttccatttgtttgtgtcctctcttatttccttgagtagtggtttgtagttctccatgaaagggtcattcacatcccttgtaagtcgtattcctaggtattttattttctttatagcaattgtgaatgggagttcactcatgattcagctctctatcattggtttataggaatgcttgtgatttttgtacattgattttgtatcctgagactttgctgaagttgcttatcagcttaaggagattttgggttgagattttgggattttctaaatatgcaatcatgtcatctgcaaacagagacaatttgacttcccctcttcctatttgaatattctctatttctttttgttgcctgattgccctgaccagaacttccaatactatgttgaataggagtggtgagagagggcatccttgtcttgtgctggttttcaaagggaaagctttcagcttttgcccatttagtatgatattggctgtgggtttgtcataaatagctcttattattttgaggtatgttccatcaatacctagtttattgagagtttttagcatgaggtggtgttgaattttgttgaaggacttttctgcatctattgagataatagtgtgatttttgtcattggttctgtttatgtgatgcattatgtttattgatttgtgtatgttgaatcagccttgcatcccagggatgaagctgactttttcatagtggataagctttttgatgtgctgcaggattcggttttccagtatttttattgaggattttcacaatgatgttcatcagggatattggcctgaaattttcttttttttgttgtgtctctgccaggttttggtagcaggatgatgctggcctcataaaatgagttagggaggagtccctctttttctattgtttggaataatttcagaaggaatggtagcaagctcctctttgtacctctcttagaatttggctgttaatctttctggtcctgggctttttttggtcagtaggctattaattactgcatcaatttcagaacttgttattggtctattcagggatttgaattcttcctggtttagtcttgggagagtctatgtgtcgcagaatttatccatttcttctagattttctactttatttgcatataggtgtttatggtattatttattggtagtttgtatttctgtgggatcattggtgatatcccctttatcattttttattgtgtctatttgattcttctctcttttcttctttattagcctggctagtggtctatctattttgttaatcttttcaaaacaccagctcctggattcatcgattgttttgaagggtttttctcatgtctctatctcctccagttctgctcttatcttagttatttcttgtcttctgctagcttttgaatttgtttgctcttgcttctctagttcttttaattgcaacgttagggtgtcgatttgagatctttcccgctttctcttgtgggtatttagtgctataaattcccctctaaacactgctttagctgtgtcccagaaattgtgacatgttgtgtctttattctgattggtttcaaagaacttatttatttctgccttcattttgttatttacccagtagtcattcaggagcaggttgttcagtttccatgcagttgttcggttttgagtgagtttctgaatcctgagttctaatttgattgcactgtagactgagaaactgtttgttatgatttctgttcttttgcattttctgaggagtgttttacttccaattatgtggtcaattttaaaataaatgtgatgtggttcttagaagaatatatattttgttgatttggggtggagagttctgtagatgtctattaggtctgcttggtctagagctgagttgaagtccttgatatccttgttaaccttctgtctcgttgatctgtctaatattgacagtggggtgttaaagtctccaactattattatgtaggagtcttagtctctttgtaggtctctaagaacttgctttatggatctgggtgctcctgtattgggtgcatatatatttagggtagttagccctttttgttgcgttgctccctttaccattatataatggccttctttgtcttttttatctttgttggtttaatgtctgttttatcagagactaggattgcaacccctgcttttttttgctttccgtttgcttggtaaatattcctcgatccatttattttgagcctgtatgtgtctttgcatgtgagatggatctcttgaatacagcacactgatgggtcttgacgctttatccagtttgccagtctgtgtcttttaactggggcctttagcctgtttacattgaaggttaatattgttatgtgtgaattttttcctgtctatgatgctagctggttattttccctgttagttgatgcagtttcttcatggtgtcgatggtctttacaatgcgctatgtttttgcagtggctagtactgtactagttgttcctccatgtttagtgcttccttcaggagctcttgtaaagcaggccttgtgttgagaaaacctctcagtgtttacttatatgtaaaggattttatttcttcttcacttatgaagcttagtttggctggatatgaaattctgggttgaaaattcttttctttatcaatgttgaatattggcccccattctcttctggcttgtagagtttctgcagagagatccgctgttagtctgatgaggttccctttgtaggtaacctgacctttttctctggctgcccttaacattttttccttcatttcaaccttggtggggtaacccaatctttctctctggctgcccttaacattttttccttcatttcaaccttggtgaatctgacaattatgtatcttggggttgctcttctcgaggagtatctttttggtgttctctgtatttcctgaatttgaatgttggcctgtcttcctgggttgggaaagttctcctttctttcagagatgccctgcccagagaggaggaatctatagcggcagtctgtctacagtgcctttgtggcactgtggtgggctttgtcctgttctaacttcctgggggctttgtttacactgtgatgggaaaaccacctactgaagcctcagtaatggtggacgcccctccccccaccaagctggagcatcccaggtcaacttcagactgctgtgctggcagtgagaatctcaagccagtggatcttagcttgctgggctctgtgggggtggggtccactgagttagaacacttggctccctggcttcagtcccctttccaggggagtgaacggttctgtctccctggcattccaggagccactggggtatgaaaaaacaaagtcctgcagctagctcggtgtctgcccaaacggtcacccggttttgtgcttgaaacccagggccctggtggtgtaggcacccaagggaatctcctggtctgtgggttgcaaagaccatgggaaaagggtagtatctgggccagagtgcaccgtttgtcatggcacagtctctcatggcttctcttggctaggagagggaattccctgaccccttgtgcttccagagtgaggtgatgctccaccctgcttagactcaacctctgtgggctgcacccactgtctaaccagtcccagtgagataagctgagtacttcagttggaaatgcagaaatcacccaccttctgagttgatctctctgggagctgcagactggagctgttcctatttggccatcttcatcctaagtcccatatttttcttttactttgggacttggaatctacaaatgttccggaatacagacagtattgtattgcagtggactttacatgtttatagtggttctctatcctcttaacactggtaataatcacctggggaacttcaaaaaatttccagtcttgggtctcaccctcaagtattgtaatgtaattgctctgggatgggcactatatatatatatatattttttttttttttaacactatccatttttagaactgctaaggtaggccaatctctcactgatgcttgaattcatataatcactgtcaaggtgtttttcaggcttatattgagtatttctagtgcaggaaactgaaagaacgctttctgtcttaaggaagttctgattttttgagagatcagatttattattatttaaattctgccttcataacatgagattatcttttagtcttataaatttataatttctagccatggagtttagttagtacttaaaattgtaactacctgcccttcaaaaaaacaaaaacaaaacaagaacaacctgatcacgtctttataattgtgactcaatcctcatcagataggacctttctgttcttcacttttgagttataaatcctagggaaaggaacaatgaggaacaattagacaaagaaataaaataagtactttctatagtgagacagcactagagttaccttgttaactagactgagagctggaactctaagcctttcatcattatattgacaatgtgtaacgtatggttaagttacagaagaaacattacattattattattgaataagtaataattatgagttttattaagagggcccagttcaatttatatgtgcaaaactgatgcccttaattgtaacaatactttagaaatgatagtggaagtaagttccttttgcagagaaaatgcaccttaaaatgcctaggcacaaatttaatgagatacattgttctatatcccaataaaaacaaagacaaagccaaagtaatgtcctcaaactctctagaaggacacgaggcttaatggtaacagtccctgatgcaggtgggtcctcttaggcaatcttaggtttgcattggccttactatatggtgaaagtgagcatatgttttatttatgcatcatccattttactttagattgaaagtatttccccatgttttggtaaaacctgctgctcctgaaacctacctttgttcctagtcctgcccttataaattgcaaaaaacaaagccaattcatcttgcttatatgagcccgtcttccctttcataatagagatatgtccttcattctgactcgtcttcttttctttaagcggaatagttccactgcagagtctcttaattatttaatgtagtacatccggaaagacctcatttgtaaggaccaagaactgaaaatattgctattgaatgcagaaagggaatggtaaggttctctcagagaattccttttcctaaacaaaggtgcaattgccaggaagcaccttcacatttttctacaccatgtcaggcttccttatagcactgttatatgtggccgtattatggttgacattaaaaaatgtgtgtatttttgaaagaactacttcctttattttaaatagaaaagaacacagcatctctgagagtgagaagatcaaaaataagttaaaagcttttcttgtgattagattaaccagattgattaggacaaatagggtttatctatagcttaataaataagttattatttcctcaaaatttagacttactaggcctaaaggagcatagaggtctttagacttaataagtctaaattttgaggaaataagttggaaaaactagagttcagaatgagtaatagtaaaggcaaaactaagattattaagaaaattatcagaatttcctatgtgatttttttaacaactttccctggcttatattgtacatgggtttaagttatcttacagctctttaattatttttaaaagtaggatagcatgttatcttccttctctctgtctataccaagtgtttgttatttgagcattacagttacacaccaccactatctggttgtaccgtgactgaaatatcagttaattggaaaagtgaaaaaaactctttaaactcaacctatacaattaagatgatgaagtggcagcaatcattgcactcttttacttacctgtgtgatttgttataccatgtgtttgtttagaatgtaaataatgtgcagttagagtaatagatgcagatgactgaacatccttagacatctggagaagcagcactggcaagattatctctgaaaatttctgaaaatctttttgttgcaacctgagaaggcatagacataactgaaagcccaatagtaaggccaagttcagtaaagttgaaaatgctttacaccatcactgatgatgttgagtcttccccacccagctcaacattgagattttttttttatatgtagaagttatttgttccagaatttttcctttaattcattgaattattacataattaactttttttttctttaggatttcttggctctcaaatacttttactctttttagagtgctacagccacagttttcttaaatatagggatttttgaggtatcatattttgctaatggtaagtttatagtattcctaagcagcttatctcatacagttttctctatattgaatatgattcagatgaaaattaacctgcgtgaaatggttgtcatctggaatgactgccttttaccctagaaaacagccagcccaaggttgagaacacatctgagaaactgtgcctattttgagaactaccaagaaatttttattcactggaacagctgccaggaaacttgttggtcatagaccagtgccttagttgggcatttttttcagaagtagagaaaggcaaagctagagtcaccgagggattggaaggatgaaagacgtgtagttgaaagctgggcaccatggaagaccgaaacactcttcaaacattctgttttcaagaataaacccaaccctaggagcacgagacagagtataaagagccatgatttttagcgaagacctcgcatttatcttaaaatttgattttgttgtgaatataatctcagaattatgcagggatggtccatcaaaaaggtctgccagagtcaagctgagtttatcttagccatgctgaaaagtaggtggcagtcaatcaaaatggcaattactgtacaagacaagagttcactggagggaagggtgaatggaaaggacactccctgcattcttgaggcctatgtaaatcaacaaatgactctgggttagtttccacaattgtaaaacaatgtgattgaacaatattgtttcttcacttccttcctgctctaagattgtacaaaagtatgattcaactacagatattgcataaaattggttactcctgaagtgcatggagtaaaattgttcccatagaatatcgtgaatttagttaggttgtgacatgggtcatagtctccgcagtctgtacgccctcagtatattcctctgacaaccccatgtcctttcattctaagctaatatccttacacatctttttctctacacctgagcaaaatatacattcatgttcttaagtgcatgtagttaagaggaagctaacacttaatttgttcctgctgtatgccgggtatctggtatgtcatcttcatagcattatttgaagtttggtactaatatttccatttttcaagtgatgaaattaaggctcagagagatagtaagttgcccaaggcatcatgacttacaaagaatggatcttagatttgaacacaaatatctctaaatccaaacttcatgatttttctactgtatttcatttgctcacttccaaagtctatacaaaaatatttgttaaatgtgcatgtactgagctaccgatatctactatatctgtgtatacagcgatagctatcaaaaggagagacgtcctctaaatctttgataaaagtatgtcaaaatggaaccctcccagaaggacttcatttttaatagaaatcagagtattagctgaaggcacgaagttctaagataaaaatgtagctatgaatcagggtggattcagagaggtctttgtgtgtatgctataggtgatcatgtgtgaatttgacctacggcaagaagaattttttttttttttaaagctcttccaggttatccttgtgttggggaggaggatagaataaagaaatgaatgtcttgctggttcttccaagttgtatgaggataatatcacccagggatgatatgctagataaagacccaggatctttattactttttgacatttagttttgttgttgttgcttaaatttctagtctgttttgatggcattagaacctttaaaaggagcttgtaaccttttctttttacttttcctgaaatgtgtggatgggaggattggacaagagcctcaagggatgggaagaagagctcagtgcgaacacacatgcatttattcatttagcaaacatccattaagtgcctaggacctttaaggtattctgccaagagctgtgcaggataggaatgaacaagggatgacctttgctttggctatgtacaccagaaaaacgagcaggggctggaggactcttgccaagaagctatttagtggttctcttagagccttatctctatctaggctggagattaactcagaacatttttttagtctgtttacctctaaaatgaaaagaaatatatattaagaataaggaggtggcgtggagctttcactgaatgtatttcaactggagtattgaacgttatagtgatggatacagttaatccatcacaaccaccatttcaaaggaaagtggggaaaacctttgtccctgtgtgaaaaataacttaggaaattttggtctgacagttgtgagagggttaagaaagtcaatcattttgtaaccaggcacagcaatcttgtatgaaccatgtcaggatgttgtctgcatgccgtctttgctgatcacagtaatcgggtcataagagaaagggaagtaatagagtgtctcttagcaaccaaccccaggaaaaagaaaattactcaaacccagccatccagccagagaagtagaaagaaaaaaatattctgatagtttgctgaaagagctcagggatgagagagagagaaagagagagagacagaaagtgagagagagagagagagagagagagagagaggagaaaggagagagagaaggagggagagagaggaaagggagaaagaggagaaaataggaaggagagagagagatgatggagaagagaggccagagagaaagaggaaggtatggagagacaggagggagagagagagagaaggaaaagaaggaaggaaaaaagcagaaagaagtaaacaaaaaactgaaaccttttatttctttgttttcctttctcttggtgttatctttttttaaaatttttatttcagaaagagagaaagaggcaaagagtgggtgaggacaaaagaaaccctgtctcctaaaacaggaacttgatagtccacatcgtgagagaaagtggggagggtgaatggtagtataacttcatcgtgtcccatgtttctcatggtttccagttgcgatctggattactgttgagaagtaataggaagacgaagtctacagatgctgtgattagtgttctaagacctgtttttgaattctctgcttgttaatcgtgtagcagtcagttctacagcttactgcagtctttatagtaatgactttcgaactttgttttttctgacataaatagtggtaagaaacacatagtacattgacaagagcgtatatatgtacatgtcaatgtaatatatattgtcaatgtaatattatgctaagtgaaattttcatatatagatatatatattttttcatatataggctctttatgtgatgcatactaatgttttctattcaatttcattacaaaaattcttttggatacctgctgaattgattgtatgaccctaatgagttacattcttccatttgaaaacaccagtctaggatcagcacttgccttacattttgattttactagagtggtgccaggcagcaagttcagtcttggtgaagagtctttggccagcactgtgatgttcagaataacagctatttaagctaaatattttcttgtcatctgccaagtagatgtatcctaagagtctgtcctggtttggaatttaaggggataaacctgaggcaattccccctggactatcttcagtttagaaaagtgccacagtgtgttcaagaagcaccggactggactcaggagacttggttgcgcttgatggcatccttttctcactctgagcctggggtcaatgatggatcgaattagatgatgtcataaattccttctggctgtaacatcttggaatttatagctggatggggctccagaaaccatcctgtctaatgtctttgtttccaagatttagttcttgaaaaggaatgatagacttcctactttctttaaagatctgtgctaggaacaagtatacatgaaagactgaagcttagtacataacttcaaacatctcagtgtggtataggagtataccatgcgcacatataaacataattcgaagaaaatatataatttgttaaacactacaggtagggtagaagtaaaatataaaaactcagaaaaatgataatttaatcttactgggaagaatgtctgaatgctacactagtatataaggaggaaggctttgctgtggactttgagggaaggaaaatattgataataataggatgttccgggtagattaaatgttgtagggaatcaaagaatggagtcttaattgtctcctttgagttctgttttttgacctcattgaactcacaagggtttactttttaccactaaatattcctattattttatagctgttttttcttccaatttaacatgactttttaataatgatccattgcccacatttagtgataaggtgaggtttgattaaatagtatttgtacagtactacctcctacttggagacacacgtttatataaacacaaggtgttatataatttgtttctctgttggggggagggggaaagtaaataaggaaatataaattaatacctgttttcttttcaggataaataatatctgaatatgtttctttttctttcttttttcttaatgcaggctttatttagtttgattttacctttagaaatttataaaccatggaaataccccacatttttggggatattggaaataatctctgtgatgtcactttctgaatcagactaaggtttgtttattacatcagttacaggaaataagtgcataaacctgaattaatctgaggatgttgtgtttgtaatgttgcttccattttgtccctttccttgaagcttgaggcacttgcacatctcactcagtcttccttttctctacagctttcctgctgtcctaaagagacaaaaggcatatggctttctccagctgcatttcctgacctgtttccttgccatagatcgcttctaaagcaacattcccaccatttgaacttccattcttcctctgtcccaaacctaatattaacaataacaggagccaatgcaatttttcattataatatggtgttttacattcatagcacacacattactttatttgatccttggaactcgtggatatgtaaatggcaagagttactcttccattgtgtagattactaaaatgaaatatctagaggtaatgtcacctagtaccactgactatagtgttgtgataccaataccagaataacagggctcctgacttctgacccaagggagataaggtggatcatcttaaggttatggctgatatataattgacgttatcagttttagtaaattttattttacacgaagaaactgaggctaaaagaaacggagccactagtgcttagggtgtcaacatcagaatcagatctttgattcccagatttaacatttcctagattctgtgttctaatcatctcaatggacagtgcagatattacttgagaaacatgtttgcatttcgtgaacaactcctgtttattttcaacattttctatgtataaataatgtttgtgtaagcatatatttacttaggacccgatatctgttcagtactgttaattgccttgggagaaaacaaaagcaaaaatgtaaggcctgggatttctatgcaaaaggccaaaaagggcttttggtgagattttaaaaatagaaaaccaattagaaaataattaggtgtatagtggtaggcccagacttgaatttcagtatgaattttgaaaaagaatatatattttaaggcctacaagggcaaaagtagatgggctttaaagtttgtgtaggtaagattgtctgtgggtgaagatgggtagtgggatggtgagcaggcagagtggggttggggtgtggggtggcacggccagctttaatggagacaggcgacttcgatggggggtaggacatgaggtgcacagagcaacagttttcagaggtgcagtagggatgatccaggggatcagagaggaaaagagtaaagactctgccaacctttcagcctggagcctagagccacagtgtgagttaaagatgtaaattccttggaattaagaaccataccttatttagccatttatacagctgcttaccatggtaataattagaaattaagatgatgatcttttatgtgagcaactttcctaaataacacttgatgctgctgataaatgagacttaggtacagtgctttttctgtaggattcaggcctaaatggatctaggaggatactagagcttccgttccaaagtacgtgcatttgaatgatatgctaagtaatgccttgtgtatccttcaacaggaaaagttcctgctattaggataatttgatatgcacttgatgtttgctaatatgtttcaatcacataaatccttcttggatatttttgttctttgtggacttcaggtaagtttaaagatattccacacacttaaatatgtacacaaatgactttataacaagaaagcaaatttgtttaaaaaacaaacctacaattctgtctctctaacacatcaactccattttctctgtactcttttagtctttgccaatatatgtttatagttttcataatatgtaactaaagatagacataattttgcatttttttcacttaatactacagaataagaattccccaccatcatatttagcaatggcattatagttcttgaagtaagcatcccagaatttattgaactattgccatattactggtcgtttgtgttatttcactgctttaagtgtttttatgttagagaacataatgaaggtcttcatgggtatagctttttgagaagctagacatgttgaagaaattgggagcatgctattactagcttctatgaattggtatttactatgtatccctttaattaaattccattctgcagtaagtgtgatagctttgccgaagcacttgggggccaaaaggacatttgtaactggttaagttggaagatatttatttgtataaggtgggtagggacaggatggacaggctatttttcttggccacactcactgaatttaaataggcaatggagataaatcagttgtggcccaactagactgcctggatataatatccttttggactggatcatgtcgtttcattgcagtcaggatggctaagcatggtgatggatcataactgaccaaacagacaggttggttagaatgtatgaccagtcatagctgtgtaactgaggaactgattatattcctgtgactaatgaaaaagcccaatcttagagtagctgtggtaattataatgagaatactagtaaaacattttaaggtgttgtgttccagacactattccatgcatttcacacacacacacacacacacacacacacacacacacacacacacacagtctcatttaatcctcataatattatgaggtagtgctattattaatatccattttctggatgaggaaactgaggccccaaccagtgaaataacttgctttgagtcccatattaagtagtactacccaggcaacctggccccagagcttacttacacgtgtagtaactacactgttcttcccatttatgaggtgattaaactatggaggcaggcatggcatacctgcagaacaggactagaatctcataggtttttgaacttattaggcagacctaaggttttttacacttcctgaggctatagaacagaactaatctcttagccttaatgtcactataacgtaaaaaccacgtgaagagaattacgatggtgagcagaggataggacacttattatagttgttacctcatttatttaattctttgtttcttagagaataagattctggtacatagcaggttcccattaaatacctattgatttaaagtttaaaacaaggaataatggctaaatgaatcattgaatgcgtatgtctatttcttggaggtctaatcatgttttcaaaactttggctcaactgtagttagtgcagagtatgtatggtcattctgctagagcaaaatcttagtataggattaaagaactctgcaaattgttaaaacatgcaggtacactagtttcaaaatgtattagtttgatttattattgtcattttctgataaagaaaggggagtagtctcccctaaagtttggtgattaagtcaccagccaccttttctattttggttgttgtggtaattggtgtttcctggaaattttccctctgttctattaataatgttaaagggggttacagccgtgactcactccaggaagtcaaccatcattcgcttcctcaatctcaccaaccagtccccatgtacaaaatcagcgacttctgcaaatgagttactttacagctctcaagagagttctagaaaatacagcttttgtatttcgctgtgtgcttcctgccttggcagagagtaaaacaaaccttcatgttttgctccttggtagtctcgagataattgaccagttaggtaactagtgtagtctcactcaagagaaatcccacttgctgtctaacaaaagtcccttggcactcagatttgcaaagttaaacctggggacagttcatgaagtccagtggagtctatacttcttttatacctggctttatgtttctgtattcattattttgctcaatgtttaattaagtaatgaatattttaacttgttcaacatataactccgtatgtcttagcactgctgtgtagtagataccatcataggcactgaggatgcagtacagacatggtagctgcccttgggaaccttctatcctagttattgttcactatattaccaagttaaccacagggaaaacaagttcagagaatacataggctgtgggcctgtcctaaaggaatcaatctgtaaccgacatgtctaaagttgtgcaggataggattattccacttaattctgtaatttgttttgtctggaatttatctcatctatgcccccaccctcactcatacacataaacatggagatggaacttaactgtgcattctcgtggtacttaaatttttgtaccttggattatcaaaatttttgttcatgtcctagcttctctgcaagttctttggttaaaaccagtgtgtgacacatctctggatcagaaatgtcttcctttctacctttcaccttccccaaccttcctggtctcctagcacagtgccagatgaatgacagctgtttagtatgtttggtaaatgctaactgtgtgtgatcttagaaaagttagtgaactttgctgattttcagtgtcctctttcgtaaaaaagagaataataaccatttctacttcctaggttgttgtcaaggttaagtattatatttaaagtttttttttagtagtgactagcacttagtaagcacttactgaatgttatcattaataaatgatcttacaaagcagtagcatttccttctaggatttttttgtagtccttcatgattgatagagaagagacatgcagtctaggatttcacatcagctttttaaatataggaaaccagatgtaaatatgctgcttcggttatttacatctgacattcttgcatgattgctgacaaaacattaagtaaaaattatgctactctttcccttagatgtcaattcatggtcacattaaagtcacaagatttttcctgaaacttactgctggtaccaattttaccataggttatcttaattagtatcatcacacagtggtgcagtttgacctttggggtttgattccagtcctttgtttattctgactgtgaatggaggagtcaggcagaatgacctttacatatctttacctccttctcccatcttctgctggcatagaaaactttgcataaagaaaggcaacagagcaactgcaaaattgctgggattaaaaagaaaattgtatgataatgagaaatccagtgtactctctctcccttaatatgtgtgtgtgtgtgtgtgtgtgtgtgcgcctgtatacatcagatatatggattgatgcagtgtactctctctcccttaatatgtgtgtgtgtgtgtgttgtgtgcgtgcctgtatacatcagatatatggattgatttctttttgtttataaaaaatattcacttttcaaaatgtatttatactatgctatcattgaattcttacatatcaaccctttgtggttgacactgcagagatgatgagctccattttataaagatggggcagttttatctcaacaactagtgtgttctagatcaaggactgattccagattctcaaagtcctacaacagtaatcttcaccatgctgtgtgtatgcgtgcgtatgtgtttatcagaatatattagaagataatttgcaagcagggattggttaaagttgaatgtttatatattcttttgtagtgttgcttacattttaaataaaaataaaactgcagtggatgtgcatttgtcatcatttagaggccttcagaccccaattcgtagtttcttcacagttgcctctattttctgattactagtccctggaaggtacagtgtcagagttgaagggatgttctcaaatccccctaaagttttccattgcaatactcattacagtttctttttttcttttcttttctttttttttttttttttttttttttttttgagatggagtctcgctctgtcgcacaggctggagtgcagtggtgtgatctcggctcactgcaagctctgcctcccaggttcacgccattctcccacctcagcctcctgagtagttggtactacaggcgcccgccaccacgcccggctaattttgtttttgtatttttagtagagacggggtttcaccgtgttagccaggatgctctccatctcctgacctcatgatccgcccacctcggcctcccaagtgctgggattacaggcgtgagccaccgcgcccggccgcaatactcattacagtttctaattgcgtatgtgtgtaaaagaacatataacttcctcacagactcagctgtacactctacaggggcatcattgtatcttaggggtctagcctaatggctggtgggcactaggtgcttagcaataactattgaatgaatgaatgaaaaaatgaataagtgaattcaacacaacttttatttatttatttttattattatactttaagttctagggtacatgtgcacaacgtgcaggtttgttacataggtatacatgtgccatgttggtttgctgcacccatcaactcgtcatttacgttaggtatttctcctaacgctatccctcccccagccccacacaccccaagaggccctggtgtgtgatgttcccttccccgtgtccgtgtgttctcattgttcaactcccacttgtgagtgagaacatgcggtcaacataacttttaaaatccagaatgtcagtactaaaaggagccttttaagtattagaattcaacttaatgaaatgttgctacgtattttctctgttctcatcactgacgtagctgctttggagcatctatatctgatatttagatagtggatggcttcttgcaaacacttacattgctcacgtagtaatgtgaaccaacagattggtggcccgggcagcaacatattttctataatctgtagcatgaagccaactgaggtgtgaccgtggtatttcctgaagtggctttcttttgcttttctgttttgattattatgtggctgtggatttagttcacaccatcactgtgaagaattttcgaaacttaagaatcaagctctgtttatacattttcaacgtaagcccttaattacagtcactcctcgggcccagtgattttacagttacatgtcagattgaggggtttcgtcttgagaatgtcagctggctctgtgaagaagaagaagagcagatacgtgagttacccagaggagtgctgattgagtccaggagtctttctgtttaagagcacgttgaaagagtttgtgtgtctatttgtaaaaccattttggagatgataaaaagcattctgagacacacaaattttttttctgttttcaaaggcaagacagagacatgtggacaggttgatgaagggatcattgtgatcttttctctcagaacttgattttcattacttgaactttgtcttctatgcttttattaccaacacctgtacacaaaggtacacataatacttgcaaaaaagagaagaaactgttttcagactggggctctattaagtgttcattgaccacagtctacaacaacaaaaatgacaattcctgcttgccattgaaaataatgcaattgaaaagaaagggcggaagcaagttcttggctgcatagcttcagtctgatgccatattctagagtgaaaaggtattggcttggttttgaggcctgccttcatcacgtgaaggctctgtggcatggcagggttatcttacgctattgaacctcagtttctccatttatccaatagagatggaaagtattggcctgcatttatttctccttcaaatgacatattgtatagaagcgtattgtaagttgtaggtacttaacaaacatgaaggactgttatgatctcactttctgggctaaggagaaaatggtgggatgagtttcatgtccttttctttgtggttttgactccagcagcttccaaacgacttttgctgatgtttcctaattagcaatgctgaatctcgtgttgtatcaatcctccccattccttaagatggaaacaagtgttccagttatagctataccatgtgcctgacaggaaagaattgggttgccatcagaaccttaatttatcaatctcagtggcttaaaattttgaatttgcagcttaatattattcattaacaaagtatttttcatcccttagctttcctccagggaacaaaaggaaatggtacacactagctcttctaacaggctctcattcaataaaggatggtgtgcccttaattttgttagcatgtgtataaagaatgtacttttagtggacatgcttcactttgcaaatatagtgcataattttcaaatacatctttgactcttcctcaaacctgctcagaagctgtgtttttcctctcttcattaaaatgttccaacctggaaattttctctttacaattcagatatttttcacttcttgggaagggaataactaaataatttcaatactttaaactacaaggatgatgtatttttgttctacacagcattgatatggtggagctgtattctttttctaataatacaaataatatagggctgtaagggtttgtatcattgcatgtatatgttaagaggataagaggtatgtataaaagtaaattttgagaaattataagtataaaccaaaaagtcttatacctttagcaatgcctttaaatcttgaacttgaaagaaaaagttatgcccgactcgttgattgcatattaaataggaaaatacatttgttatacttgaactagattgttcttaggattttgtgaaagaaaatatataagcatgaatttattatagaaaataaaaatgaccctagaagaaaacctaggcaataccatttaggacataggcatgggcaaagacttcatgactaaaacaccaaaagcaatgccaacaaaagccaaaattgacaaatgggatctaattaaactaaagagcttctacacagcaaaagaaactatcatcagagtgaacaggcagcctacagaatgggagaaaatttttgcaatctgtccatctgagaaagggctaatatccagaatctacaaagaacttaaacaaatgtacaagaaaaaaacaaacaactccatcaaaaagtgggcaaaggatatgaacaggcacttctcagaagaagacatttatgtggccaaccaacatatggaaaaaaaacctcactatcactggtcattagagcaatgcaaatcaaaaccacaatgagataccatctcacgccagttaaagtgggtgatcattaaaatgtcaggaaacaacagatgctggagaaggatgtggagaaataagaatgcttttacactgttggtgggagtgtaaattagttcaaccattgtagaagacagtctggtcattcctcaaggatctacaaccagaaataccatttgacccaacaatcccattactggatgtatacccaaacaattataaatcattccactataaagacacatgcacacacatatgtttattgtggcactgttcacaatagcaaagaattggaaccaacccaaatgcccatcaatggtagactggataaagaaaatgtggcacatatgcaccatggaatactatgcagccataaaaaaggatgagttcatgtcctttgcagggacatggatgaagctggaaaccatcattctcagcaaactgacacaggaacagaaaaccaaacaccgtatgttctcactcataattgggagttgaagaatgagaacacatggacacagggagggtaacatcacacaccggggcctgttgggcagtgggagactagggagggatagcattaggagaaatacctaatgtagatgacaggttgacggatgcagcaaaccaccgtggcatatgtatacctatgtaacaaacctgcacgttctgcacatgtatcccagaacttaaagtataatttaaaaaaaaaaagtaaaaaagacattgattcattcattcatttattcaggcaatgtttggaactcatgatgtgccaggcactgttttaggaccaggaataagcaatgaccaaagtatttgctctcctgatagattataaacaaataaatatataatagctcaagctgtgaaagtcacaggcacacagagacacacacatctccaacatatgcagcaaggtaatgagataaagaattcctggccattttttgtgatacaggatagatgtaatggtttcctatcagttttatcatttttaaggtctctcttcttagaataaattattttatttgtttcttccgtatgccatttaacagggaggggaagttttctgccagttttgcacccactgtttttctttttcagtaagagccttctcatagtctgcttgaaggcagcggtcttgccacatgtgttctatgcataataatttcaggagagtcttgtccacaatgcttggttgattacggcttgtgggacaccacttaaatgactagaaacagctctctttaataaacacactggtgttgtccatcattttaagtgagcatgagagcccagcttcattttgccactccaatctcacacggcctagaagaactagtgaaagtagcaggtggtgtttgactttcagtttttctgaaatgtgtctctttctgccactctccagacgccgtgccagtcaggccctcaaggtcaaaacatcatgaaattgaccatagattatctcagccttttctttttaaaagtgtcattgtaacctgttggttactgtgtatgtcatttaacttctctgtctttagtttctgaagtaactggttttacattgccatcaaaaggcttctgtgggtttttatttttctttgtttttatttgtttgtaaacaatctccttttctaaactcatttccccaaatttccttaatttttcacggactgatgaaaatgttttgctgcttccagagcttgtcagcttctctttgtggcattgctttcattgttgttctccaagttcccactcagctcctgctttcttcaaaaaaccctttggtttctaacatctatgttttcaacatggcaatggagtgagttgcccagggaatgattggaccgtgattgttttcatggctttcttttgccttttctccatgtcctttttagctctaagcctcatttgtaagctttctagaaatgtggattctattatagaacttctgtttttctcatttttgtagttgctttctcaagagcaggtgctggtgaccacaggacgagtgagagacgagatggtgtctctcctttagcagttggcttaattaaggaggttttttgaagtgtatgggcttcaaaaagtctgacatgtgagttgtggcctgtgtggtctaactctgattcctttggatacagaaccttagaaagccttgagaaaaacctcagagatcatctatgcaatcaattctggctttacctggagggagttttataaaacacaaatgccagggcttcaacttgagagactctgatttcattgttttgcagtgggtctgcacatcagtagtttatagaaatttcccacatgattttgtgaaaccagggttgagaatcacttgattttacagggcatatataaggtccaaagcaaaagtgactcttggctgggcgtggtggctcacgcctgtaatcccagcactttgggaggccgaggtgggaggatcatgaggtcaggagatcgagaccagcctgcccaacatggtgaaaccccgtctctactaaaaatacaaaaattagtcaggcatggtggcaggtgcctgtaatcccaactactcaagaagctgaggcaggagaattacttgaatccaggaggcagaggttgcagtgagcagagattgcaccatagcagtccagcctgggcgacagagtgagactgtctcaaaaaaaaaaaaaaaaaaaattaacctgtcatggtggcatgtaatcccagctactccagaggctgatgcaggagaatcacttaaaacccgggaagtggaggttgcagtgagccgagatcgcgccattgcactccagcctgggcgacacagcaagactccatcttagaagaaaaaaaaaaggtgactctccgggattctatagcagtatggccatagagtagggacaagaacatatgcctcctcatttaccatcagtgctatttctattttgtttactaccatttactctcatttgattgtgtcaaattatctactgttgtactggggggccagagtggattcccaagcctcaaccacatagaagagtagattggaggttgttttcaaactattcaacattatcagtgggttgaatttgtaagctatcaactcaaaatataaagataatttttataacagggtctatattggattgtaaaaagagggtcataggatttggatctttagggctctgtaattcaaaatttgggatgttcattaggactatttgtgttatgttgtaaaacaattgtacttgttggcagacgtcttgggttcaagttatgattttgcatttaggaggtttgggaacgtggacaaactcccttttgagttttccttcaccccgtctttgtaatggagataatattctcatttccctgggtttttaggaaggttacctgagatgactcgtgcaaaagctaacacataatagataataatatctatctaaatagatattatttagatatctatctatattgagatatctatatttagataaagatatctatatttagataaagatatctatatttagatatctatatttagataaagatctatatttagatatctttatctaaatatctatctaaataaatgttaatttattctgaagtgtggtaagtttatctaacatttactgtagcaaccaaggtggggctaaatatggggaccaatcagaaagatgatctctgtcagttttgcctaggacgttcagtgggacttgggtaggagactgtggactaatctcacctatggaaatttgtgtggcctgtgctataactgagaggaaccaagtaagcctgtgtatatggcaaatggtagtcctctcccaaacaacatttgtaaagaaaatgcattttgcactatttcttagtgtgtctgaggctttttatgttcataaaaatcttagtgagttgttgaaacgtgcttttctgaaaaaccttggaatttacctggtttagaattagaatcagaaatgtgtctttttaaactgtattctaccttcttaaatcttttgccttctgcagcaacatggagcaactctgatacttttttctacttgagggcctttcgtagtcagagattatactaagatagcaaaaaatagaaagtgacacactagtcaaggttggtttattgtgtggtaggaaatccaaaagacgttggaagcaacaacaatagctctgaggtccttggaaccaggagttttgaaacttttactttattgcacgtctgttgacatgattccatgaatatttctgctctttctcccttatgtataccagatccactgggctgagttaaatataagaccccaagcatggtcaattcttattaatagtccttgaagaggctctctcttgtttttgattgactttctttttctttcttttcttttcctcatcctttctccttcttccattctcccttccacctcatagaagcctaatgggcttggaatagcacttataaatgcatgaatttttagaaatatatactattgttttcatttccacaataatcatgcctaacatttatcagccacttcccatatgctaggctctctttcaagtcctttaaatgtaataactataataatctcacaacaaactccatgagacagggactgttatctagtgtgttttatagattagaaaactgagacacaaagaaagtaactttctaagctcacatacctggtgagtcagtagctgaggcaagatttaaaatcaggcaatctgactgtacatctcactcttcgctactttgtccttgtgcctttagatcatggttctgtgctatcgatctgatcttatttcttactctttttactactgttgttgctcagcatagtcttcccccctcaaaaataagtaacatttatattgctattattattattattattttgagacagagtctcgttctgtcacccaggctggagtgcagtggcacaatctcagctcactgcaacctctgcctcccaggttcaagcaattcttctgcctcagcctcctgagtagctgggattacaggcgtgcaccaccacgcctggctaatttttgtatttttagtagagacagggttttaccatgttggtcaggctggtcttcagctcctgacctcgtgatccgcccacctcggactcccaaaatgctgggattacaggtgtgagccaccacgcccaacctgtattatgaattataatacatagataacgtgtaaatatttaatgtcacatattattcgtgnnnnnnnnnnnnnnnnnnnntgtaaatttgattagcgctgagacattggtattagttttttctacagatgagaaaacaattacatacttttacaaatgatacaaatatgtgtgaaatatatttaatcacatacatgaataatgctcagtgagcaggcatagaattgtcaggacctttgcagtatctccaatatataccctgcccatagattaggaactattgctgtactattgctcatcagtttaaataattatgttaattcacatttatctatatgatcagcataatctttcaaaaatcgatttacaggcctggtgcggtggctcacgcctgtaatcctagcactttgggaggccgaggcaggtggatcatctgaggtcatgagttcgagaccagcctgaccaacatggtgaaactccttctctactaaaaatacaaaaattagctgggcatggtggcaagcgcctgtaatcccagctacttgggaggctgaggcaggagaattgcttgaacctgggaagcagaggttgcagtgagccgagatcacgccactgcactccagcttgggtgacaaagtgagactctgtctcaaaaaaaaaaaaaaatctatttacattgcagctcctttaggaggtttactacttgtaatactgtagagtcttccagagtgtgcatccattgtatttcactgattgatttcgttagtgatacacctcaaagtgaggtagtcatatacctccaactcttggctgccacaaatgtactgtcgtgagcattttgtatatgtgttcttaatgattggcagaagttagctcaggatttgtggctgtggggagggtgcttgatcatagtgcattttaatattgagtttcactaggctctgtgttttttgttttttgtttttgtttttttttaaacataaaggcttcactagggttactttcccccagtaaagcattaggattcttgttttcttcatgccatcaccagcacggggtattgcatgactttatattttttgctaatatgatgggtatggaactactagtacctcctggtttctgcttcttttccatacatagtaaacagattcagtctctcaaaattactgggaagaaaagtgatttgtttcataagtgttaagtgtctgtttctggtcatggctatctctgggactgtggtcatagagaggcatactggctattcagcagggtttctgagtgggaaaaaaatctcttgaaaatgtggtgttgtcaaggaaggccattttactgatgttacttcagggcccttctttcattccttcatatttttcaatatttattgtatggcaattgcattgtagaaacttttctaggtacttgggaacaaaattgtgaacaaaatagacatgtcctgtggtttctctggaacctttagtgtggtcaaggggacaggcattaatcaaaatactcaagcaaacatttaattacaaactatcatgagtgctacaaagggaaaggagaagagctctggtatataacggggtagatgatctgtgtgtgcttacttgatgcaggtgtcttttggggatgctataagatagaaaatttagaggataaggtaaagcagtaggaggaatattcagacagagagaataatgtgtgcagagatccacaggcaagagggaatgtggcatcctcgagggatagtgaaaccagagttgttttgaggacttttattcatttattcaacatatttttatggagtgcttactatgctctagaatatgacagtgaacaagacagaacactaggagatgtttgagatgaggccgaaaaaataggtaaggggctcgccctattgtacactcatctcccttggtttgtttttttgtgtgttttcagagagaaacagccgtacttaacaatctggtttcagattcttttaaccttctgtttgcctttctctgaaggtgctacagtttgtttgacaccctcttcaagaggggccagtagaactaaggataaaatttttaagtcttcccatcaagaaatgtgtcgttaacattaattaagtttcctcactgttatcaatgaatatccctccgtatccttctctttcactagctgagcattatattatgtgttgttcaagggcagatagtctgtgaagaagtgctttaaaaactgatagcgtgtgggctctgagcatgttgtgcggctgactggcccccacctcctcttgtttcctttctccccagaaaggcctcacttgctgcatgacaagtcaggctattgtttgctcattcgatattgtcagctaagatgcttcacaattccttaagaatttattattgttgttgttgagggatgatagagtcctcttcttctcatttaagtgacgtgtatcgaaaaggaaaaatgacaaataagaaaggacttgggaaaatttcctccactcctgacttccagacctttagaacttaatgctttccgttcagtacttctgccccctaaccttaaagtcttgagagaagaatgactggtgttgacaggatgcttgtttactggcttctgcctaatttttgaggcatgaagtggccatctcatataaagcaagtagttcacatcctgggactgagactacaacctggtttctccttgtcttgtttcgatggagttattctgtatcctgtgaagaatctctgttttgtcatattgtattccctctttaaatcttttatatctctttctcgtactattttgcccctgatgctgtttctttctttattttaagctttagattcacctcttaagttgtcagcccacatggccatacatgaccatggttcttactggtgtgaagaaagcagattgtagctggttgtttgagatgccttcttaggtggaccaacctctctcgggttctttggttttatctcttgctcttcctcttgaatgtttatgatacttcctggtcacgtcatttctctttgactctttctttcttccttccttaggttccggattcatacaggtatgaatctacttccccatctttgccaaccctggcatcgtgcccccttgattccttggcttttcacaggctagatgcttaatggactctggaagcctttatctctaggacgcctttatctgtaggactgggcttttttgtttgtttgagacagggtctcactccgatcacccaggctggagtgtagacctggggtttctaaacactcttcaccttgtgctcagctccttgtatgataccgaccggatcctatccatggacaataacaatcttgaatgtgttcacaatgcctgggggaataagtcccaatccggccaggaaatgctgatctccttccgacgggatctgcttgtctcacctcagcgccagttgcttccctttacaatctctttgctggccaggttagaacatgtgctaattctctgaaaacacaccatgctttccttcctctgtgtctttgcttgaatggttctctcagtccagaatacattttaaatatttctacttccacaaatctattctatagtatttatcaaaatagtaccttccctattaagtctcccctgattctttagctgaaagttattttgatttcctctgagttcctgttaattttgtgggtacttctgttaggcttcttagcattctacagataaggagatgggacttcgtttaaacagctctgggccacaaatatagcatgtagaactgtggagattctaactcacattttaacctaaaatgccatactctttttatcctattacattcttctcattccatatatgtctatcttatgtagtatgattgaaggcagggtgcttgaataaggtgtaatgtttttgactacttagcatatcctaggcactgtgtgacatattttgcatttatttaatttggctgtcataaaatttctgcaaggcaggtacagttactattcccactttacatatgaggaagtgaggtatggaaagattatgtaacttgtccaaggttaggcagctagcaggtgacaggcaggacaccagcttaggcagtgtggcatcacagcctatgcttgtaactgccgtgcaatgctgtaggtaagcaagagctaacaatataagcctgaaactactggctttctcagttgatggtatttgagaagtgtggtctatgatattcctcagtaactttcatccatggaaaaccaacatatctcatttctataggttttaggatttaaatatttttaaggatttttctgttgtagactttaaatttacgatttgagataaactgaatgctaaatctttcctgcttgggaagaattcagatgtaaaattgtaatttgtattattggaaaacaactccagttttatgcattctatgcaaggatgagctatgtattagttcattttcacgctgctgataaagacatacccgagactgggaagaagaagagggttaattggacttacaattccacatggctgggggaggcttcagaatcatggtgggaggtgaaaggcacatcttacatggcggaagcaagagaaaatgaggaggaagcaaaagcgggaacccctgataaacccatcagatctcatgaaacttattcactaccatgagaacagtatggggggaccatctccatgattcacatgatctcccacggcatccctcccacaacacgtgggaattattggagtataattcaagatgtgatttgggtggggacacaaagccatgactagaataaaccacatcaagttacctgcttatctaaagttttagaaggtgttcacaatgttattcgaaagccaacttagtgtagtgagcatttggagaagcatcctttatacaagtgagatgacatacattgttaatatgtgcttttatgtttgtctttgcaagatctgagctagaatagaatcatagctctagggccaattagagtgggagatagtttaatagataacacaggtgctattttgtcaagttgcatggtttctggacagtttacagagaaaaaatttttagctgagagcctgatgaagtcttaaggctattattaatagtaatatttggggactagcaaagtgctcacataaaaagcaccaacaaggattaaaaaaagagaaggtactgaccagattcactgccttctattcccaaaaagattattaaaaggttcatgtaaatagaatatgcgcacacccaggagaaagtgatttatttttaagctgaagccgaggttttacacatccctgataatagggtttaattaatgtttggagtgaataaaacacactcagaagaagtgtagtcatatccttaatttccttgattggcaaagtaattgatatcatgtgtgacatttgagtcagtgctattttatcagtcacttgctctctgcgagacagagactgtgattgaaaacagtaggtatgggtacttgattttaaaatgaactctatcataatatactgattacagaatcagaagggcaatgttggtgaatatttttgggcaaaaaatgactgtaacctattctagatatggtaaaaccagctctcagtacttaccctataaagagaatattggtttttttcagaattttgcagagggtctttttacttagggaacaaagagaactgtaattgtcaaatgtggttgtaaaacggtaaatctatttttgttcatggctcattcattcacttggcatttaaaaaaaaatttttttatttgtttattttagagacaggattttgctgtcacccaggcttgagtgcactagtgcagtcatagcttactgcacgctcaaactcctgatcttaaacaatcctcctgtcacagcttctcgagtagctgggactattggtgtgccccaccacacctggctaattttctattttttgtagagatgggatcttgctatgttgtccatgttggcactgggctcaaatgattctttgctttcgcctccccaaccactgcgattacaggcgtgagccaatgggcctgacctcatttggcgtttattgacaccatattagaaaccctgtactacgtataaagattattgggggaaacttctcagctatgcatgtgtgtacatgcatatgtgctcattagatcttggtgtaagtacagtttttcttctagtcatggtttaaaatatctgaaaaggtgctatggggacacagcagtttacaccaacagggaccttataattaagtagatatgactgtaacatagagagcgataacgttataaaagaaacacaggtatgttactataagaatgtgatgaacaaatcatttgataaagatatcagcagaggcttagtgtgggagatgccttttggctggacttgggcagttggttaattctgaatggggtttggggtaggggagtcaggtgaggattggtgtgtgtaggtatgcctaaaggcgtgaaaatatttccaagaaggattgcgtttctttttgccactgatggcagagtcaacctcggcttctgagtttaagaagagtgtgagcacctcgagcaaataagtcagctaaacaaatggagctgaggcattagaaaacgcctgtcgatttttaagaaaaggagctcaactctaagagtgcaaggaaaaataaatgcgtggagtgacaggataatagtctataattacttttaagattgctatattgaggctgtgacagtcacttagttcctgagtcttttcaggaaagggtaagaggtaactagccagagctggagtcactccttgtagaagttaggtggctttgatagtgacattaactcttcagaaactccatgactattatttggtatccaaagcagaaatttatgaaagagtcacagaattttacatctgtaagataatcttttgaaaataattagaaagaattcaggtttagaatatacatgggtgatagacagagtagtgaaaacatccccagaatctggtcctgctcaaaaatggagcagagtttcttagaatgcactgacgtcttcacattgaccctgcacagtaccatccctgggagatctggcaaaggagacatttcagaaatgtgtgagttaggtgccatggcattaagatcttttcctactgtacaacttcccgtttttaaactcaccatcttgatgtacagctaactaatgtaattttccaaagtttctagagaagacaacaaccttattgagatactgggacatctgggtgccagtctagttccagttacatcttacttttgaaagaaaggaaaatccattaaaattagaatttgtctaggaagcatctccctcccaggagcggagtactagctcttcactatcattggtctaagcgcttgaaatgctcccatgtttggaatcccattgtttatgtatcagttctcccaacacttccactcgttaggggtatgatttaagagttaaggccaggtgcggtggctcacacctgtaatccaagtactttgggaggccaaggggagcagatcacgaggtcaggagatcgagatcatcctggctaacatgatgaaacactgtctctactaaaaaaaaaaaatatatatatatatataaaattagccaggcgtggtggcacacacctatattcccagctacctgggaggctgaggcaggagaatcgcttgaacccaggaggtggaggttgcagtgatccgagatcacgcccctgcactccagcctgggtgacagagtgagactccgtctcaaaaaatatcctttgaggtcacaggattgatgctatacaaatagtaattgtattattaatgatagaaatatgaagcatattggtattaaactatgagctgatacatggagcagcagatattgtatttttagttcatttccttaggcaaactcaaatattgtactcgcacagttacctcaggcattcacaagttagagttccagtgcaaacagtttgcagcaaatatgaaccacagtggtactattagttttgcatccactaggcacattttccagcttctgaagagataattgaaggagaacttggatatgggctaaattgtgtatatggataaaagattcagcagggatttaagcactttcgacccacatgaaacattaaatattagctgagactcacttgaagatggacttcttgattttgaagagttgtctgcatttttataaaactacatgagcatagtgcattttaactaataaaggaagtgaacacagttgagatgcattatctttcttagccttagggtactgggtgttactattataatttttaaaaatgtatgcttttcaatttttaaacagtttattatggaaatgtttaaacatatacaaagggatgagattactataatgtaccgccaggaatatattatccagcttcagcaataattgactgatggccagtcttgcttcacctatacacctattcctttccctcaccctggattattttgaagatagtctcagatattacgtcagttagtcacttctgcaaattttagtctttagtaggtatgtctaaaacatctctcaaccataaataacatgtcaggagagctcttttgcaagatgtttattgatcttgtgccttttgcatgagtatgggaatggctactgttttatggaaaaggagattaaagaatgcagtgtgggttttttttcatggccgatttctttctttccttctttttttttttctggaagtaggattggtttggggcatgatgtaggaatgttattgggtaagggtttaaactctatgtggcttctgtggtttggagagaccccaggttgatctgatctactatagttaacaagtcagataaactagattttatttgtaatccttttgtactgaagcccaaacaactggcattcttaaattagctagaatatcacttagtattccatttatagaagagttgtggttttaatttaaaaaatactgtaagtggagctactgaaataggcccaagtttattatagctaatacttcattacagagacttccgccattccctaaatctaaggagggggttgtttgtataccaaacatagtagatgtttctgtttgactagattacctagaaaatggcacctagggtaacaacttatgtgcttaatttgaatgaacacgcccagaaaaacaggagagaggaaaaaaagaaaagtaagagaaaagaggagagagagcacatagagagaggtacattatcaagctgtccacagcttcctgacaagagcagctgagttcttggtatcacagcacatcttcacaaaggcctcataaactagcgtgtctcagaatagttcattaataggagggaggaagaagaatttacgtagcagttcctgattcccatcgttcaaagtacatatttcctttttagtattgacttttccaggaaacttgttttattagtactcctactttccaaaataattctctatgtatggttttattttttaaaatgaaaacgataggaaagaaaattcttcgaattcattgtcatggggactcatactcagagaattggatatgacaatactcaacaccaaacctagttctgaaccccaatatctgattattatcaatagaatcagatcaagggaatacttattttcctcttagcaatctatattgattattcatgggggggggttctttgttctgagatcaggagaatgccctggttatatgtccatgtgtggccttagtcagtttctcatgtttcttatgttcatgtatcttttgcttaaaattggaaatatctaccttcaaggaaatactgtcgaagacatggttgacaatttcatagcagcagtttgatgaaatcattttgcacactgagtaaattagtcaattatgtaaaaattttatctgtagttttgtccaccttatgacaaaaattttggagaaaaacaacagccttattgatttacagacatctttctatttatcagtactagcatcagctttctgggacatgtcaactttcctgtttttgagtctgaatggatccataaacctaaacttgctgcaattggagtgcagatatcaagactattgcagaggtcttctcacacattatctgtgtgccttgagaatgggacctctactttggattctatttcatccatcctatacaaagagatcaagcaagataatcacgtattctctctgctttggcctttgaagactttaaatgacttagcttggtattaaatatttcatccaggagaagttgggacttgaaaatcaggctttgtcccttgcagaaaacttgactggttccaggcgcagttactgttggaacagaattctctttaatcttttgcggccattatcaacattgattttattccttgtgcagggcagtagagttccagcttctgtgttattacttttaaaacatggtataattttaggaaaccattttctttgtttctgaagtgtatgtataggctatgttcttcacattagatttttattttgaaagaacatggcaaagtgtggaaaacaaggaacatagttaacatgatcaagatatctgaaattgtgtaattagtgatagcttggataaagttgatatgaataagtaatatagagcagggagtgtccatgaatggagtggagttagcctcatgtcaaagtttactgtcccccagccagacctcagcttgtagacttagtattcaatttggttactctactgtgaaagagatactctcatctggagaagaccagccaagatagagagagaactaggctatgtcttgggaggaactgttgaaagagattgtaaggtgactttaagaaggtgataatcagggataccagaggaagacttagaggactccagaggatagaaatatgccagaatacagaacttaaacagaggcaaattttcattcagtacagaaaaagagtttctgacaaagtgatctgaaggtagaatgggctgtcctgggggatggtgagctccttcccactggaggattttcaagccttagcctagtgacccctaaggatatcaagatgtacaagggtcagtttgtggtttaactaggtgaccttcccctccaacctaaagacatttttgttgtctggctagacatcttacttcccatagtcttttaaaaaataaaattaaaaggcaataaataacttctgacaaaagaaaatagaagccatgttcttatcacccagtaatgaatatattgatatggttctttcaagtaacttttaaccttttacaatatacgtatcaaatgcatgtatcataggtgatatgttcaataatttttgcaaattgtgcatttttgtttaaaaaacacccagatcaagaaatagaacctcactagtcactcagactacttcatctccccatgaaaaacaccattatgatgtctaacagcatagattagttttgcttatttttgtatcatatgtaaaaggaaccacacagaatttattaagtatttttaattgtggttttcgttttttgactcaggcttaaatagctctctttttattgtccacagatttttatatatgcctagtcttgcaaagttattgtaggcagcaccttaatgaggttttaagggaattttgctattctaacattggaaaatttaggctgttttcagtttttatctgttaaaatctttgggcttgtagctttcctatcccctccacacccatttcttcactcatatttctcacaatatttcaaattgatttccatatgtggaattattagatcaaatggtacaatgaagttttaaagtttgatatttaccaaattttaatccaaaagttaccaaattatacttgcattagtaatatttaatagtgcctattgctttgttttaaaaaatgtgctaattttatgagaatggcttttcttcaattattaatagggcaacactttctttcacgtttgtaaactagttatagatttggtacatgtagtcagtcactgtgctaaattctccttaagaattacgtctcttttttgaaaaactaacttttaaaatagacattactattattattattattctcattttgaagatggggtaactgagaaacagagatactaactaatgtagctaatgaagtgaagctaattagtgtcacatttggagtttactcaaaatatgatactcttcagtttgatatgctactgcccttcatgttatcctttttaaaaaatatttttaaattgattgtatattattgcattagcatatttagccaatttatatgagcttcatatatagcatatgtgtgtgttaccttcctggtaacacaccaaatggctcatataaatttagccaatttatatgagctttatatatatatatatatatatatatatatatatatatatatatatgcgtgtgtgtgtgtgtgtgtgtgtgtgtgtgtgtgtgtgtgtgtacttttttgggtgtttatttttaattttgttccaatttagaagcatataaaagtttgtttcaatgtgttttttaaattattcaagttgtaatcaaactgaaactaattttggtcaaaggtgaggctctacattgatttttaaataatttacccgtttttccaatttcatttaataaataatcttttctagccgagcacggtgggtcacacctgtaattccagcactttgggaggccgaggctggcagatcacctgaggtcaggaatttgtgaccaacctggccaacatggtgaaacactgtctctactaaaaatacaaaattagccaggcatggtggggggcacttgtaatcccagcttcttgggaggctgaggcaggagaattgcttgaaccaggaggcagaggctgcaatgagctgagattgtgccattgcactcctgcctgggaggcagagcaagactgtctccaaaaacaacaacaacaaaaataatctttcctttactgattcatttgtggtgtctcttttactgcatatgtatgaacgtgtggggtgtatgtgtatgtgtgttttagacataggatctcactctgttgcccatgtaggagtgagtggcacaatcatggctcactctgaccttgaactcttgggtgcaagtgatcttcctgtctcaacctccagagtaactaggactataggtgtgtgtcatcatgcctgactaatttaaaaaaaaaaaaagtttagaaatggggtcctgcaatgttgcccaggctggtcttcaactcctggcctcaggttgatcctcaagtgattaacctaggcctcccatagtgctacaatatatttggcaattatatctgcgtgcacggtttcttcattaatgtcgtcttattcctgtgtaaataacttccactcccatttcattttagattttcttacccatctttgcaatatcttcaaaaagaaagaagacttacaggagtccaatgctgcataatattaataaacttaattttcttaaattttcttctctggcagagaccataagcagtatgatatttagtcatgctaggataagacctgagtagaaattgtactagctatccagctcgtttgttaatttacttttgatgagacagagaacggtcatttaaccagcttttgttcggtgtctgttcggtactaggatctcctgagaaacccttgcatcctttatgtacttggtcctcataacattcacactaagcattcatggcagagccagcactggcacctgtggcttctatgttgctttttaccttgcattataccaattcatactaagaaaattgaagtgtgccctaatcacagtctttcatttgtaagtcgactcaatacagtattggatttggagttttgaaagaaagtaaaacctaatttccttccccaaagctattattattctatttagataaatggaaaagcaggtatgtgttgaggtttctagcttttaatctacagtgtttaataggttttaagttatttgttattgaaatcttgaagaaaacacataagttagatttcttgcttttatagcaaaaaattttttggatggcttagggagtcaagtgaaccattttaaatacagtatgactaaatctgaaaggcctgatatggtagctgctagccccatgtgaccatttgaagttgaatttaaatctacattaattaaacttaaataaaacatttgtaaaaattagtctctcagccactagtcacattttgagtgctcagtagccatcccttgcaagtattaggacagtatggaacattcccaccactgcagaaagttctgtggtgcagtgtccatctagatgattctacaaatggaagatttaggggaagaggagaagtaagtagtgaggtgtacctaattgcttctataagttttagtacaaagaacccttcctttaaaatattgatatttggtgaaacattcagatatcacgttttaaagtgatttcatggacactaatcaacagagcaacaacatagatatatcattgactacaaggatggatcaatacttgttctacctgtttcataacttagaggattatagggcactctataacacagcaccttaagtatcagaaaaataaaggctgcaggtgtttgaatgaattgttggatgttctgtttttataaacatgtggtcttctcatatttacaccccatttggtttgggatgaatctccattctgagtcccttaaatgttagggaagcttaagatgagaccctttggattccacacaccaatctaatttcggacccaatttgaagctgaaaaaggcttactatggaaaaaaaaaaaaaaaaaagcccaagccccaaaacatacacacacaaaacaaagtagaacaaaaggggataccatgatctttttatcaaattaggataataggatgacatggaattcagaagacagtgtgatattctctgggaatttgttattttatgaatgttcctgactgaaatttaaataaaaataaaatccagagtatacttccccctttagtaacagatagaagtgacaccttgttgaattccatttctggattactctgtttttattttcatctattggcacccaggacctggtgtttggtttgtaactatgattagtgggttggggttaatatgagaaattccgcaatgagtaagtcggaactattcggtgttatgtccaagaaagctcacatgtcctagttaaggctgtgtgaagtgaattggaccatcctgatgtggtggccccaaacactgggcttaatcctctggtgtgactgctttcacaggtcttttcaagagcctaagtaccataaaatattctcacaaaagccttcattccaaagaatgtgtgtgtcggctcatgtcaagagcttttagtgtagaacaatgtgtcgaaaaccacaatctaataaacaaacagataatctagttcagttttgtctaagtaatataatgtctttattaaactatttcctgcacctttagctctattcagaaggagaaagttctgcgtgggaatgtgtgtatatttactcttaataggaggccgtgtagctcctgtgactggatgtcttgtttttctcttctgagtagctcttgttttccatggtgggaattttccgtcttggtaatttggtattttacttggttttcattgtgaagtgtggaagtgtgtacaccttagttttagaaatgttgttttatcacctgcatctcagttatcaagggccaagtcagaaagttctcacgtgtttttaagcctttctaccagaccttgaactatccattaagtcaaaggggataggctatttccatgaagaaggtttagggattcctggcagggcaggaagaaggggcaagatttgcgaggatcagaatcctaggtactctcctttagactgcctggtgactactcatttgtcatatggaaaatcatggctcaatagttcagtagaatataactttgtggaaatttctgaatattaaaggcttcattttcaacacggcagtgagatgggagagtcagggtcattcattggtattgtccacgttactggttgctttttgtctgatcttgcctggagaattatttttaagtaatgtgcctggaaagtgcctacttacagttaggttaacggccatcttatggcatcaggaggagctttctggctatacctattaaaggaagccttagtctcttattgccattaattgacccttgcattttgagtcatagaatcataaaccatcagtgtcgagagggctactaagcagtttccttggattaataaagcttgtatcttctttataatattcatgtcaagtggccttcctgcctctacttgaatacttccagttatttgtcaatctcacatcctcaaaccaggtaatttctatttaatttttgcccttaatcttcagggtttataaatacctattgataataccttcgttaatatggtgctttgaaactcttcatttttttccctaaataaacttgtaatttttctttctatatcatgacagtagaggctcatatttttatgccttttagtctcagttatatttttgtctgaagagctaaatatacttgaaaaaagtggtttctgtcatctcagaacatatatatatatatatatatatatatatatatatgctgggtaaactccacctgtttgctaatcataacattcatttttctcaatgtgatggattttgtcaccacctccccccgcccccccgcctttatggcattgctatgtgaatcattgcaaaaactctgcactaacatttttcattctgtttataaggttcaaatagatagaacaattttctctaggctttagctctggtgtgtataattctggtcaggctcctaatctttttgagggatagtttccttatccataaaatggacctaagaaaagcaatcctatggggacaatataaaacttgtttagctgcaatcttaactcagacttgcttcctgaaattcctcaatctaatattaaataggggttttttgtttaaatgtggtagcaagattatagttacaaaaagaatagaacaatgcattaaaaaatagaagtatcttaaataatatgtttaaattttttaaaaatatgctgaaattataaagaaattcttagaaaatcatgaggaactctggaaaataggtaccatgaatacaagaacttttgctcttgtctatacttgtccttgcactgatgttcctactctgagtctagcactatgtgcagacttcccttcttatggtatgttgtggtgagcagaataatagccctcaaagttgtccacgtcttaatctctggaacatgtgaatatgttagggtacatgccacagggaaattaatgatgcacatggaactaaggttgttaatcagctaacctaagataatgaaattatcctggagtataaggatgggcccaacgctattacaagtgtgatagcaaatggaagaagaggacagaggaggtctttgaagtgatgtgatgtgagaaaaacttaacgtgtctttgctggctttgaagatggaggaaggggccacaagccaaagaatgaggagtagctttgagaagctggaaaagacaaagaagtggattctctggagagactccagaaaggaatgctgccctgccaacaccttgattttagtgcattgatatgcataactgatttctgatttatagaacagtaagataaatatatttctgttcttctaaaaaaccaagcttgtggtactttgttgtagtaacaacagaaaacgaatacacacaatatcatgttaaaatgatctgtttatatgtttttctcctttctaggcaatgaattcctcaagggtaacaatgctatctttgaaaaatcattttagtccatttccatatgaaaagaatacgaaatgtcctgtcaaacaccagaggtggtatttactcagtgtgtatgcaccatatgcctggcactgccctgggtattttgctttgaaaattttatttcctgtctgtttaaccctactaaatcttaactttcttatctgtaatgtgagtctatggactagatcaggtttggcaaacttttctgtaaatctggtaactaaatattttaggttttataggccatatggtatttgtcacaactattcatttctgccactggaatgcaaaagcagccatagacaataagtaaatgaatgaccttggctatgttccaaaagaactttatctacaaaaacaggaggtggtctggatttggccatttggctgttgcttgttgacctgtagactagcggacctctttattctgttctaattcctgtctaatatgattattctgtcagtttataacattgtgccgtgtcagttaagccaaggaagtgccagtaagacctgaagaaggaactcaagtgattggatgggtctgtttataagaagaagcataatattggagactcaagtgccaggaaggggactgtcaccatgtccttggcaaatggacctgggacaaattctctttaggatgagacataaggagatccttgaatgccaaagctgagctcgctgaacttgaaactcagtgaactggaactactgctggaggaataaaagggagcaataaatcctttgcactccagaatgaaagaccttctgaggcagctggccaaatgaagcaggaggagggaacaagttcctcactcagctaaattatgtctttgggctggccgacctggtctgctaaaataacaaggtggctgaacttctgctcagaacacgtcaccaaattttgcaatttgggactgtcttctatcccatgacttcctaatctgaggaagtgaagaaagcagagtgaatgaaacccaaggattgacttttttatggagggcctccttagagacaaaagttgatttttcaagagaaccctttatattgtgaactctgtattctaattcaaaaaccgttaagttcttggatgaagaacatccaatagattttggaggtcttgtaaactttgctattgatctgggacttaacctttgcagatgtgggactgtgtgtttatacatcaaagtgggtaaagaagagcccatccagagctaggcagacggaattgggatatgtttgtttgtctgattgcccggttgtggtggtggcggttgttttgacttggttacatcatcgcatttttgaggacaaaactaccctctttgattggtatgttacaatagcttgtttatgtcttgcaaattgttcgagaacagtttgtccattaaagaaaaaagtgacctagtaatactcccctacccaggggaatgtcgggttaatcagttgcacaagggcttgatatgccaagtcagtactaccccgaggctccgtatgcagttcctttccaagatttttaaacattctggggagaacacaatatttgtttatttggcttctaggactttgttttgttatcgttttagttacggtcttatgcttttctctcactccctgtctttcttttacccctaactctttggagccctggtgtgctaagagccatgttaacagtaaagcatctattcaataaacacttaactatattttatatttgagcttctaaatgtttgtgaagaatgtgtttctgggcaagtcacataaagaataatctcacagtaaaaataacttatatttatgtaggacattatagtttttatggtatttctaaattcagtaaaaggcgaaagatttataccatctgaagaaaaaccagggtgttgtatttttaaatttaaatactttggtctacacaaccctgggtagtataaaaggtaagtgctgttgctctcatttacaaacaaaaatattgagaatcaaaagtttcatgatttccctaggttcacacacatctagtaaatggttccaagtggacaaaaacttacacattttaatgtcgcagagctatttttttatatatgtaagttacctaactgcagcagtgattgccgagatcatccctatggtgatgttcaattgagtctccctatttcaatctttcaacctctcttttcttctctctctctctcatacacacacacacacacacacacacacacacacacacacgcacacataaaccacatacacacacattttgaaattggtagtcactcagtttctcaatcttcctttaaagactaatttattgggctagaatttatgggtgtagttgtcaaaaattcctgcatatacccactcaggaaatattttcccaaatcttctccatctcaactctgtgaggcattggaagaggtgcttttaggatagactgatgactcatatatgatgtctgccctcagggagcacacagtttagtgaggtaaatgtctcatgaatattccacaagatccaccttgataatgctctaaagttactatagagggctgaaggtgggaagatgctttcgtctggtggcaaaggatagtagtgtagggtgacatgggcctccaagaatagcttgggctcagatagtggagaggaaactcttaacggagacagaggtgtgagcaaagtcttggtgtccaggaagccagaggaagcattctggcagattaccgggtatgtggcttagcaaaagtcattattctgaaatataaaatgtccagtgctgctgtctgcagtattagtctcaaaggatacatactcaccagtacattccagagtttgttgacaaactttgacaacaaagcttatcaagtttctctccattgcctcataagaggcccatccagttagaggattcctccttttcagaatgagatcttgtcaaatcttgggaggctcagaacagacgtttaccaagcttccaataatactctcaaaccataattctctaaaacttcagcataattgccataaaatcaattgaccatatattagagagtttatttctgggctctgtattctattccatttgtctctatgtctgtccttatgctaggaccacactgttttgatcactgtagctttgtgataagctgtgaaatcaggaagtgagtgtcctccaacttggtccttttttcaagattgctttggctattcaaagagagccatgatatttttaatctagcaacagttgtatcaaatacattggaaaaacctgggtcaggaagaatgttgactatctgggctatttgtttagtctagatatgaggtaactatgcattaggtattttggtggcaaaggagatgcagagcagtaaatgaattagaaaaatttggtgtaatttaatatagcttgtttgtattcagagtgggtggttaagataaaaaggaaaagggttttccacctttgtgatagggagaattgtgataaggtaaatagaaaaatagagcacacaagaggaggttagcaggtctgtgggttatcctatctaaattcagatttgagcactgagctagaggttcatttgatgatgctcattcagcaatcagaaattcagaggtgaaatcaatgagtaccacaattattctgggtcttattttacttataaatggtgtatttatttagaattgcttttttaatgtaatgcatttatggttaccatggcacaagagccagatactgggaagcagttggggacagcagcaaaaatcaagatctggataaaggcagcttcatgaggcttctgtgccttacctcagctaagagtaaacagagtgctagatggctgttgacatgtgttttattttgaagtgactattattactaggatctgaaatccttagccttgatctcttggagcctaatgttcctgttctccagctgagagagactaattcaccatcttgtgttgtgaacactcactcattttaactgattacacctccaatgattctcaaatcactaaaattactaattgctattccttacacatcaaagagtgaatcctgaataattaaccccaaataaaattagatgaattggcccttttaattagagtccctgctgctgtttgttctgagcttccttttcttactgttaagagacttttagaatgattaaaactgtttaagacttaaacagccagtgaccttttaatacaatataaatccatgaaagcaatatttcagctagcaggtggtgaagtaaatttttagagcaagtacctgtcagctccagtattcctttggaaaaaaaaaatacatgccaaaaaacaaccaccttgaaatgaaatgagtgtctctatttgattatttttaaagcattcatgcatttgctaagcttcagacttgatgaaataaatgtcagggttgaaggagagtgagtaatggttggcatcattttatataaatagtaacaagaatttctcagtgagaagaatttgaagtcatttgtgcataaaagatgaatactggataaatcacagaaggcccctggcctcatgtagccatccttgtcttcggggattctcttgaagcaagagaatgagccccaacattggggaaaaggaagttttatggggtttaattgctgctgatcatcgaggcaggattaccagcctagccatgctgcattcagcctggattttgttggagatattttacatgttcctgctcgtctattccaagtctcctaaatagtaagaacctcttctcttcttcatagtcttctgaatttgtaggggtgtagcgggttttctcaccattcccaagaagtctcagtttctcacactaagtctgccatgtgctgtggtcagtgtgtccttagctagaagttaagatatttggggtcacagtgggctgcctggtgtggttctacactctttgactgtttctctattttttttccatggtggaaaatgtattcatctataaaaaaagttattggactagttcaatgacttactttttccttaaaatttaaaacataaattttaactttttattctgaaataatttgagaccctagagaacggttgaaaatagtataaaggattctcatttagtcatcacccagttttcccaagtattgacatcttacataaccacggtagagttaccaaagccaggtaaacactgacataatacttccttctaatacataaaccttatttagatttcattgattgtcctagtgatgtctcttttctggtctagaattatatccagaatcacatattgcattttattgccttgtcaccttagtcatctttaatttcagagagagagttgttcaatctttgtttttccagaaggtcaatgattcttaaccagcgctatacgccagaatcattgaaggagctttgcaaggtccttgtctgggtcccgaccccaaagattctgaattaaggattctaaagtcaagtctgggtgtatgtagtgtgagcaagtgccccaggagattccgatacacaccactggttaaaagtcagatgagtttcaatacctcaagctaagtattttcaaattctgtctatgacatgtatccttccccttccctcatttctctgctctttcttcatctccatctctcttttatgggattaaaaagcaaatttaaatgtctctttatactcttaagggatatacatatactgggtaaggcttatcaacagatcttttattggagaagatcaatacagtacagatggttgcaatatttctgaaggctagggtgcccccataaccaggtggtgacttgaggatgaagactctgttcctatactttgaagacataccctcagtaagataatgtgaaaacaaacaaacaaaaaacctagctagatggctacattaagacaggttattaactgtctagctgttggtatcatgaaggacctatgacccaccgtagtacattgttgaccttatgtcaatatttgaaaagtggcaaagttgaccatgggaaaagttcatgtgttcattgtctcaagagttctattcaatttaatatatgtagttttgtaccaataataatttatagcaataatatcattactgtttactgagtatctcatatgtgttctatatgctttatgtagagattataaaacagagagtctgccctcaaggagctgttaatcaggtaggggaaaccaatagttatccaattaagctaacaaagagcagaatattggctgtaatagagcttcagcaggaaggaagcctgcattatcattgacatgtcattgacaatgcattgacatgcattgacatgcattgacatgagaatggttccctctatagccaaagacagcagtggtgaaataaattaaatgccctatttaaagtgtttttattatgaaaccacactccctcaggcaccatcattgtctttggaggggttgtaagcttctggccttaatgaccaccacagggtaatgtcccaatcctaaggggaaaggatgtttttggactattctgtcagcactctgatatttgtttgcaagcttctttgtttttactggtaaattaagactttttgttgttgttttcctgggatgttgcctcattttctgtccatcacatgaatttttagatttttgtttcatttttaaaccgaggtaattttactttttcgcattggagctaaagatatctcactagctgatagaagactgatgcattaagctcaactcattgtcctatttattttgaatgctcatctttggaagtcaaaaatatatggtgtggtttgttgtctggatagcaattactatgtttttgtaaaacaaatgatacttggtggattcaaaagtgctatttggttctagtcgatgtgcagagctagactattgtcttaatttcatacgatttgaaatccatttaatgttttctactgagaaattgaatttgttatccaaccactgcatgacagagaattatagtatgcttgtatctcatgtaatacactgaggtgtctcacatttgtacagggtacttatttgtgattataaaagaggacttttaaagtctcagatatattctgtattagctaaatatggagtgaaactgtccaatttaaaatcagggagacgtcatctactttaaagataattcttcttgctttttaatttgagaatctcaaagagcatttcaagctaagttatttagaaagatgacagggacattaaattttggcttgagtacatatactgatgcattaaaattaaacgctgggtttgagtagattctgcgattcattttaaagtatcttatttttggttttttaaaaaaatgcatgcctataattcacttattgtataataattaagccaaaaggataaaaaattgaaaacaatgcttagcatctcatgagctgtagacaacccctgttaacataccggcctatataaaattgggaccatattataagcactattcaataacctcccttgtttcttacctgataagatatgaaaagcaggccgggcgtggtggctcacgcctataatcccagcactttgggaggccgaggcgggcggatcacgaggtgaggagatggagaccatcctggctaaaacagtgaaaccccttctctgctaaaaatccaaaaaaattagccgggcgtggtggcgggcgcctgtagtcccagctactcgggaggctgaggcaggagaatggcctgaacccgggaggcggagcttgcagtgagccgagattgcgccactgcagtccagcctgggcgacagagcaaaactctgtctcaaaaacaaacaaacaaacaaaaaagatatgaaaaacaattttttatgttcttcccccggatatgccaatacttactcccttactagatttaagtctttccccaaatatcaccttggtgaggccattttcatttttttttctttaaaattgcaactcccaccaccaccctaacagtcccaacccccttacttgccctacatttcatcatagcccttctcaccatgtgatattccgtttgatttactttttaagcattattcttctttggagtataagttccatggggcttcgtggagaagcacactttgttagttctatttgtttgtttttccctggggtctagagtaatgtatgatatatagatggcactcgatgaataaatagttgtaagatgtagatcaacatcattattttggtgaccacacaatttcccactgtatgattgcaatttatttttcaaccagtaccctgttaatgaacattctgagtttttgcattacattgctttgtgatgaagtttccttaacatgctcctctgcatgttaagttacttctttggtaggataatttattaaaagtgatattgctgaattaaagtttataaatatctttaaggcttttgattcctcttgccaaattttcttgagaaaagtttagtagcagtagcatatgagaatgctggtttccctatactattatcaattctgtgttttatcaatatttttaatcttagtccttccttttaattaatttgttagcaacttgagtattatcaaaattaatagtaatgttttctagttaaatagcagaaaatacaaatggaagaaaaatagaaaggttaatttttctaatgtataaaaggaacctgaagtttaaggatatctagcatgataactaaaaaattaatgttcctcggtcaaggtcacatatcttatttacagaggaagatgtgtcactgaagggagatatattgtgctattttgatgacaatgaggacagagaacatggaatggccaagccttgccctgataattatccctctcccagagagttctcaaaggagtttcacgctgtagaaacgggagcaaaatgagaatccaggtgccgctttattaatagcttcataagtgcttgctctccctctgggacagaggtctgtgatcccactgacatagtgcagaggctttggctctaggaataagtagaatttgtatccggtatcttcctcacaccactgtatcttggaagtcaacatactcagtgagctgcagctcctgaagacctggcttgacattctgatcctttgctttagagtcaagaagtacaacattccagctggtctgtcctgggagccagatgctcagaggtctgaagcaggaagtttaagaaggagatttcctgggtattgctttctaaaactgagactttaacagtagtagctggatcagtcaaattaataaccccttccttgtcagagagaagggcagagtgggacaggaaaagagcttgaaaaggtttcgtctctaatagaaatagcatgttgagcaagtcagtgcaattgctttcatattgttagttccaaccagtgcactgtaaataggttgagaaggccgagaagtgatgcattaaatgggatgtatcctcaatttttctcttggcctttgctgtaatgcatttcctggtggtttttaaaaccttactcagctgaacaattggagatgacacattttcaggtactgaaaatttctgttttgtgcatatgtgttatttaaaaattataaatgggtaaaataatgacaggttaagaatttgtataatggagagtatttcccttctactttcattcctcagttgcaaaatttagcttcatagaggcaacttgctgttatcaatagtttgggactccatttaaaagatagtccgtgataatacatacatatatgtgtatacattattaaataaatgataacgttatacatgctgtcctaggccttgaatgctgcatttaaaaatatttcacccaaggtgctttctggtacagttttcttggtggcacacatattttgatgcagattgaggatggagttgaagttgaaattggaagtgaagtcttcctttatttagtttcataataaattgcctgtagtctgtggagtgtacattatagctgtggcataattcattgccttatggagatcatcattgctgttacctttgttttatcctctcactttttctctttaagggaccttgttcagggagcttggtctcctcctctgagtgatcaagtttagattcagttgccctcttgtgcataaggaaaaagaaagcattgtcatgtataatgtagacattgtactaatcacttgcacgtaatttagctcagttatgttcaaaatgtaaattgagacctatttctgggccacagtcaatttagtgggtcagaaccaattttttttcaaataacagagcatttcaatgtgtgttttatttatatagtaggtatggtttcatgaaaccctttttttctagtatacatgtacgtgtacatatctagatagcaatattaccacattatataaaatatatttttttaatctaggttgtggtcaaaaagtttcagacttactgtgttagctgctttgatccacagattgacactgtgaagtagctgtggttttcctcatttcataggtgaggaaaactgggtctgggactatagaattgccttgcctgaaataaagggtagagctggggtttgtgttttaagtttttggacttaaaatttcgtactattttcctttcaaacatatatttttttctgtattagttactatatagttttttgtttttttgttttcttcttgttttgagatggagtcttgctctgtcgcctaggctggagtacagtggctccatctcggctcactgcaacctccgcctcccggttcaagcaattctctgcctcagcatcctgagtagctgggattacaggctcctgctaccacgcctggctaatttttgtaattttagcagagactgggtttcactctgttgcccaggctggtcttgaactcctgacctcctgatccgcttgcctcgacctcccaaagtgctggggttacaggtgtgagccatgcacccagccactagttactattaatggaaatgaataaccgtctttacttgaaacttatgctttgctaaccatgattaaaaaagtgttcaccttgtgtgtgtgcgtgtgtgtgtaggtattccaatccagtctcttttgacttcataatttagaaagttaacttgtggagtatctacatgcttttatgcttaccttaatagttagattttcctccaacaaccaaaaattctcccctcaacaaagtgggagaagcaatagctgccagctagcagaagctagagacatgtcactgccagtgcagcccatgggtctatgtcagcaacacctgagagcatgttggaaatgcagaatctctggctccagtgtggacctgaatcagagtctgcgtttgatctaggttccccgatgattggaacattgacatctgagatgtacgagtcaaagacaccaggtcatttattaaaacatcagttaaggaattgaatgggtttttatttttcagtcatgcgacctacagttactgaggatgttctggcccaaacctgtgactagagatgggcatataaagataaatcatgagtggactctacttgtaagaagctgcagttctaaccaggagggagtgatcataacacacaaatacaatcaagtattacagatgctctgatagaactgtatatgagacgcaaaaagggctgctatctaaatccttggatgtgtgtgtaggttttatatggatatttagatgaagaagagcatgatgctttctttgttttctttttgtaccacagtaaatgaatccaaactttgttgatagtcagagttgaattgttcccatgtgtttttctaccacaattacccataactagtaatttacttactttgcaggtaaattcttgttatcttcaccctctgatgggggcctttgtttcataaagggctaagcaagctctgcgttaggtagatgcctttcgtatctgactgacgcaagtgttagggtaaccacagtggggaatagctcagctggtcccagctaaccatccctgcttctcaaggccgcatcctttttacccctagattaaaagggagagcttgagaaaatatgcatagctaggtcctccggagtctttcctcactccctttttgagttaacaatatgcctaacaggctgttttctgaagtaaattggcagtaagtagtgtttgggaatcagagatggaatacttgatttgtccaactcctcatttaactgtttcttgctgctacctcttgcacccagcaaaaaccttttgaatattagctgaatgatttgggttcacatggagcaaatcaagcaagatatgtctcagcatctctccaagagtgagaatccatttcctgctctgtatttcaccagctatgtaactttgaataaaccattttacatgaaaattgaggcataaatatattttgtatgtaggtaggatttggaggatgagtggaggagtatggagggaccaggtctgaaggcacgtgtctatgaccactctactgcttctaaaactggacatttccattttagatttgatacatcgctgccaattgccggatggcattttgttttgttttgtttaaaagcttgcctgtacgtctcagagtctgagaggtgagttgcaatttccctgtaggtcagagaatctgggaggtgagttgcaatttccctgtaggtcacagaatctgggaggcaaggcagagaggacagggcatgcactaatatgaaggtctacagcttagctgtgctggctggaaggtactgcatttcatttcatccaggggctttcctccagaaggatcaccacctaggaatgaaagccgcatgctctttcattctttcattgttttcagaaatctattagaatggagaagacctccttcccccttcttctaatcatatataaatacagttcttttcattttcccatttttcttaaacatgataattctgccttgtctctaaagctgaacttattttcactgcaacttagaggcattttcctttatttacttgtctatgaaaatgatgagctctgagttagaattctcttaaacttttagtctgatttaggatagttattagcagtttttcattgaaactctcccggttagtttatgcctctctccaagggaaccatttcctctccttttatcagatttgtatctgtttttgagacatttgcccgttcctctacatcttttgaaaacgtgagcacctctctaaggaatgcagtaaggaccctttgatggttaagcttaaagaactgaaaactttggtctgacttaataattgatctaaataaagcagataattatgtgtttatcacgagggcttttaaacatctgccttttcatgcttagaatatagaatccatcttttcaagttgtttcttaaaaaaaccaaaaacattccacttttcttttttgttcgttttgaccctcccaggattgtcagcagcctgtgcctcactgtgtctgagttctattagagaaacagagtaaagaaggatatatttggaagggacagacagttgtactttttaagacttacttgttgtgacattttggacttttcatgtagcttctttatgacatagtttattgaacctttccaattttgtgggtctaaagtaggaataacatgttgtggttctcaaagtgcgatctcagacccagtcacatcaatcacccagggcctctgtttgataatatgatctccaagattttgttcagttctgatactgtctgatgctctgaaaatttcccatgatgtaacagaatctgatgaagtataagaggggacccaggaatccttttataaaatgggtatgaagaagacatagtaatatggtttagctctgtgtccccacccaaatttcgtcttgaattgtaatccccatgtgtcaagggagggatctggtgggaggggattggatcatgggggtggttcctccatgctgttctcatgatagtgagtgtgttctcacaagatctgatggtttaaacttatatggcagttcccccttcatgctctctctttcctgccactatgtgagatgtgcttgcttccccttcaccttctgccgtgattgtaactttcctgaggccctctagctatgcttcctgtcaaggctgcagaactgtgagtcaattaaacctcttcttctttataaattgcccattctcaggcagttatttatagcagtgagagaacagactcatacaacatagattcagatagaacatttgaacttggaaattaggttgtgaacagcaacctaaaccttttttgcctcattgcctaagctctcattgtgagcactgttttcatacatatgacctttaaaggcagtaaaaaacttcttgacagttctttttaattaacagatatgaaatattttttcatgcagtctgtggccaaatgaaagtttctcaatcctggctgcaggttcgaatcccttaggttttataggtgtcctggtgcctgaccccctcactccctgtcttctatccccaagattctgattgaattgctgtgagatggaatttggacatcagcattttcgaatgtgtttctttggtgattctggtatttaaccaatgtttaaaactactgaatggaatgcatacagatttatgggatttataattgtcataaggatatgtacaaattatttccacagatttgtgcacccagagaataagaggagtagaaattttctttatgttgtaagttattgaacatttcttatcctgtgggtctaaagtagtaacaacatacagtggttattaaagtgtgctgtcagacccaaaggcatcgatcacacagggatttattagaaatgaagatggttggagttctccccagacctactgaatcagaatctctggatccaggacccaaaaatctgtattttaaaaagacattccagagatattgatgaactctaaagtttgagaaccatcagctttaagggttgttgtatgattcggtggcagtgtatgaaaatcttagcacactgcctggcatggtgtgagtctagtaagcggagtactcgagagatagtgcttttgattgcttagcagtctgaatttggcttggggctagacctgacagttcttggcttagctacactttgaattctaagactgttatttataaggcaaatagaggcaaactgaaccatttcaaaggtgtatcagaacaacaaaacctactcacagtcattctaatgtgctcactcttccattcttatacttctatttctcagggcctaaactgtgatgttttgataatatccaaaagcaactcacttaatgatggagactgctgccctaacccacaaagtgttgagcaactaaaatgcaaggaaaagctactcctccataaatagaaaagatctcttctccaacacatcaaaaacattatttttaataggaaaataacaaataaagaacaggttaaaaggtagaagtttctgtttccccaatacaattttttgcagactatttaaaaaggtttcattccaggaaccataaagctcttggatatatgtgtataacttagatcacagagatcaggttcactccctcaataactctgacagcagtgtgcttctcttgttggtaagagatgctaggtttttctcggtatcccaaagtctcattacttcttgcctggattatgtatagatttctaaattgggtgtttcttattcatttctcctaatctgtcctgcatggacttttacattagtctttagtaaatcgtattgtaaccaagtgtttctttctcagaaatccttggtggatctctgctgcatgcatgataaaattcaaaccctttttttgatgtgcaacatgtaaaaaccttaattttatcgcatatctaatctttataactcactggcattattttacattcctgtgtcccatgtttttcctatgtcatgacttgctttttattctctatgctctgaactttctgatcgccatgcctacattctcctgtctctctaccaaggatggacgtaccttctacatcatgtttcaggaaaattatatgatccactgagacttccatgatcctccactttatcttaatttccagaggttattcatgcatctttataaattacaccttgtgttatctttagttttgtacaatttttcttcctcctctatttgattgaaaatgtattgagggcaagcaccaaggtgtataaaattcagtaactctatctcccacccaagctcattcttcgctttgcttaatatattgacccctctagactagcttttataccatttctaaatatcaaatccgatactctttcttctgaaagttaagactactaattaaggctactaattaaactaagatggggaataattgctatacaacacaaaattatgtgtcaaagccaattataaaaaagtaaaatgccagcaaatatatcacgagtactataacgttgcatccttattaacttcatgttgtttacttcttttctgtaggtgattttcttccacccccacctccacctctagatgattccagtgcccttccatctatctctggaaactttcctcctccaccacctcttgatgaagaggctttcaaagtacaggtaagagctgaagttaaagtcatgttaggtaagagctgaagttaaagtcatgtttattagccatcctagggagctcatgaatttcatgattgtttctgtgctggataaacatttatccagagcctattgagagctttacaacttatgaagatctaaggtactttaatgcaacatacccaactcaagcttcccagagttctgctggcttaccctctgaagccctcaaaatacttttgcctactaattttgtttcagatcccaaagccattttttttttaggaatactatttgagaaggcaacatttccttgttattttggaggacatacagccatgtctttttattgctatgttctctatcttcaaacattgcattcaagtgagtaaggctgacattttaaggctgtagttggttaatgtggatccttttggtcagcaacatttttctagcaaaagcaacatcaaatatccttaggattttctcttctgggtaagttcaagggtgcacatcatacttatcaattatatagaactcttgggttccagcgagtggtaattgcaaagtaactcggggctgggatcagatgtgacattagaagtggttctcagactgtgatcatcggtaactgccgaaagctgccaccatttaagctgaagaagtgctttatgtcaagaagaaaatctaataaagtgatagaattattgttatagttttaggtgtgactatgttcgcatagatacattgaagaaaaaaatgagtcttctttgtctttcagagaaacattggaaatgtttgtagataaaatggaatgggccgggcgcggtggctcacgcctgtaatcccagcacttcgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcagagcttgcagtgagccgagatcgcaccactgcactccagcctgggcgacagagcgagactccgtctcaaaaaaaaaaaaaaaaaaaaaggaatggtgtctggtaattattttcaaaataataagggttggaaactactgagtgagaacatgggtgaaatagggttggttatgatttgataactgttgggtgcatggaagtttattctgttattccgtctaccttttaaaaaatacctaatatcatttgtggaacataaaatatattgaattattgctcattaattttatcatttgttttacagtattattttttcattttaatttttgtagctacaagtaggatatgtatttatggcatacatgagatattttgatataggcatacagtcttttaaacatatacctttgtatatgtttaaaatatcctataataagaagtgtaaaagagaaaaagtcttagggaacaactgcttaaatggtttgttctattatttgcctttctttctcctaaatttgaggttgaaggagacaaagaaagaaatgattcattcgctcaacaaatattctgtattcctatgtgggcattattcaagcactaggaatgttatagcaaaaaagacagacaccactctgtcctcagggaacgtaaaagttagtgggactagtggaaataaacaagatacgcacattacaaagtacattagagtggataagtggggaaacagggagggggtcaaggcttacctactaggatgggcattatcaatatggccccactgagaaggcgacgcttaaatgaggacttgaagaaggagaggagggaatgagctctagagatttcttggggagtgtattttcatatagtagatattaagaagtagaaaaggcttttgatattatctatcatttgaaatcagtaaattgcagttgtaaccagtaagtaccaattcagtttctggagtctagatcttttaaggctattgaaaaatatgtgtattgcaaatataggccatgaatttcttgcattttattttggtgtatactaataaaatcaactatcagatgccagtgatgaatgagagtcctataaagtttgtatttattttatgtaacagatagaacctttggcaaataaaaccaatatgagtgatttttcttaattttagtcattttttaataaaatgaggaaatccttagctttggctttaatatacctttggtcttactttgctgaagttggttttttgcatattgtttaatatgtacaatttttaaagtcactgactctgtttcctctcttagattgtcatagaaactattttgttgcattttaaatctttagttctcacaatgttatttgaagtagtgacagaagactcgtgattgaaaactagttacatagattattctagttgtgtgatcttgcgcaatgcatgctgagtcccggtttcctcttcattagaaacaaaacaaatatatatacctcttacaattaaatgaaatacagatggatttgaaagtattaaactgaaagggctatacaaatattttgatgttatattaataatcactattaatatgtaagaagactagtaaggattttccagtgggttccattaaaaaattcaaccatggggctttcaaaagataatgaagaatttttttcaggtggaccttgttctgttagatgtactcaagccatggctttgtttttgaagaggaaggaaataaacaaaatgcctgttgtcatgttggcttaagttctctgtaaaacagaagggaggaggataaaaaataaaatacggtttgccaaatggaaaaggacaaatctggtagggagaggcctgttatttttgagacgcttcatatggaagattgttgatacattcaaaagaaaacgaacatgccctccccttgtgcagaagtgacttagatgtgatagcggcttggtcctgctctggcccaggtttgtaccagctatagaaatgagccatggtagagcctaaagtagcatgatcactggagaaaattctgcgcagtttcctctcggctatggttaaaacctcatgttcccaagtccaaattatagctggtaaatgtgtgtttttatgcagaagactgtttatgtttccagccagattttcaggtcagagccaaaagaacgtctactaagagtgattataagagttgtaagattttgagagcagaaagggaccttagagatcatttagtccaactctggcgccaggcatctagttacagtcctttcaagtatttgctaaattaatttccttttttttttttttttggaaatggggaaactgagacccaagaagggatggatcctctggtttctgacagaggtcttattgaatttgaaaaatcttgactcctggccttgaccttcttcctgctgtcccagatggcccatgaacttggttttgctttagtcctctagcagacttcaaggctctgagattcattgcagagggttacacgtttttatttggaaggagcaggtgatgccggagttttgcttggctgtctgaatttttgatatatgctataagcttttatttcttcaaaaaaggcaaataaatatttagccttaaggattcttggtttaacagttctcattttcatgtgggaagatgcaacttggaaaacaggggaaggatttggtttgcttttctgtcaggatcaacgtgacctccatgcctgtgatgtttgtagtgacacttcagcaatcactttattaattcatttgttcttcattcattcagtgtaaattgaatgcttcttgtaagtagacatatatgctagtgattatagccttaaaacttggcatcataggtttaatgctctgagtctcagccttgggacggtcagttagttttatttatttatttatttatttatttattttgatacagagtctcactctgtcacccaggctggagtgcagtggcgggatcttggctcactgcaacctccacctcccaggttcaagcgattctcctgcctcagcctcctgagtagctgggactacaggcacccaccaccacgcctggctaatttttttgtattttcggtagagatggggtttcactatattggccaggttggtctcaaactcctgaccttgtgatccacccgccttggcctcccaaagtgctgggattacaggcatgatccaccgcgcccggccagttagttttattcttatctgaccccacagttggtaatttcttcctcttttcagccaggccataggcaagtattagtattatataacattgcttaaggtagttacaaagaagtcacgtgtctcagaattttggacttgcaagagaattagagttaatacattcaagttcctttctattgtttgaatcttgtaattttttcctacataacaaaatgtttatgggtaattatgataggtgaggcagtgctgcaggataaggagatggatcagtacagtactcagaatcacattcggaagatgcatatacacagtcatttaagtcattttatggtaaattatgctttggtcatcatacattgatcagaagcataatctaagtcctaggttagtggtggagagtgagggaagtaaattaactgtgactggagagaggcaagaaggattcatagaaacaatttaaattgaactgaactttgatggctgggtgggaccttaattttcagataggtgagtggatttttcagcaataaaataaaagaattaaaacacagaggaaggagagctcaaagtaagtgtggtaggccttgtgtttctaactgtggaacctactctttgttctgaaaccattgacaatttattgtaggggcttgttattattttaaatataagggtgatatccccagaactgttgttggatgccaagtgatactgttaacataaattaaggcaaaacatgttgcacttgcaggaaaccccatgcaaacaattctgagttgtctggtagacttccttcagatccatggggacttacctgctgacatctgatggctttgaattcaggggctcaatatttaacttcctctttttatgatatctttgttcgtcttttcttggtgacttccagttgacaacttctaactctgcttctctgtttgtttcccagtcctgtggcttgctttcatttgcctactattcagtatttgcatacctctggttttcatctttccttttctgtttggtcctgcaaaatggccaggcttgctaatgtaactccaggccctccacattagaaaacagaggggttttgtccattggtgattacttcaaatgttaaacatttctctttgttattgagtagaaatgtgtccctttatgatgtcctcatattggttttctttccccttttaaaaagtgatgcaaagtcagaggaatgaccaggccaggagagagataggtgctgtatgtctcaaggagttgatgagtaaagctactgaaagatgttacttttcaaaggagtgagtaagcacagagtaacatgagctatgcccagaattagtggaaaagtagagaaatgtctgaaattgtttattttaaagtcagcctccaaaagctcttgagcatctattcttgtgaaaacaattcaaagctcatatatgtgtatgatgaatagtggcttataatcttttttctttttttttgagacagagtcttgctctgttgaccagcctctgcctcctgggttcaagcgattctcctgtctcagcccaccgagtagctgggactttataagcacgccccaccaagaccggctaattttttgtatttttagtagagatggggtttcgccacacaggccagtctggtcttgaactcctgacttcgggtgatccgcccacctcggccccacgaagtgctaggattacaggtatgagccaccatgcccggcctcattttcctacttactaattttatgtgtttagtttaacaatgataatttgaaaatcaattcaagttttagcaaaactggcactggaatttttttttttttttttttttgggacagagtctcgctctgttgtccaggctggagtgcagtggtgtgatcttggctcactgcaagctctacctcctgggttcatgccattctcctgccttagcctcccaagtagctgggaccacaggcacccaccaccacacctggctaatttttttagttttttatttttagtagagacgaggtttcaccgtgttagccaggatggtctcgatctcctgacctcgtgatccgcctgcctcagcctcccaagtgctgggattacaggcgtgagccaccgcgcctggccggcactggaatttttgtcttgtgattccatgtaggactatcatggtctcaggtacagaacaacaggattttatttttagacataaggaactcaaacctacagtatggccacattcattcatgaactcacagaaataggcagctgaactggctttacgtgggttggaccaccttatcataaaagtctgtctttctgctgccggttagtgtgataaaggaggaggaggctgggtatgaaaagagatgtcggctgtggagattaagagtagaggtagtggacagtgttgccagggcaaaaacaacatggtcagcaagagctttaatgtattctaaaatgcttgttttcaaaagggtgagaatacaaggatatcttgatccatgaaaacataccaaagagatgattgagatgcttatttcttcctggccctttgcctagttccttttgggtcagcaaaccccagttgatttgtagcttgtttgtgaccctgacagcaacagtagcagcagcagcagcagaagcagcaatagcaggagcagcttgctttgcaattatctcctatttttatggtccacatatgtaggtcattgtgtgtttattaaggctgggtaggctcttagcatgtcactggctctggtcattgtgactttctagaagcgaatgtcacagttttcctggttgctttttgctcttaatcatcatctgattggttattcagataagaagatggacatttttgttgtctggacttgtaaaaacccttttgacagtagccgacctagagtccaggggagtattccaatatttcatttagcattaggaaacttttaatggaatatcatagtttctcttctttactttttaagaacttaaagaggtaaaactttcccctgggattgatagtggagtatgtgtacatatacacatacccacctactcacctatatcaacctgattaccactgccaccactaccttgaaataatttgtgacacatttatactctctgcagtgaaagattggttaactgctcgacaaaaaaaagtcttgtggggaattgatggtggttagttctgttgaatgtagggataaccaatgaggttagctttgccttagctcctgagtttctgtatagggagtaatatactatgcttgcatatttcagaacatttcctttgctcaaagttaagtgagactatagttggttctttttgagtcagtgaaagttttatcccaatttgtctctcccatcaagagtcttagtggtttcttcaaaggtgaaatgtacttattgttttttttattttaacttacaaaaaagtagtgggtctttttctacttataagaaagtaatgtcagccgggtgtggtggctcacacctgtaataccagtactttgggaggctgaggcaggtggattacctgaggtcaaggagttcgagaccagcctggccaacatgatgaaaccccattgttactaaaaatacaaaaatttgctctgtgtggtcgtgtgtgcctgtaatcccagctactccagaggctgatgcaggagaattgcttgaacccagtagacagaggctgcagtgagccgagattgcaccattgccctccagcctgggtgacaaaagcgaaactccgtctcaaagaaacaaacaaacaaaaacagtaacgtaaaaaaatcaaacgatgtagattagatattttcaaatttatttctctatgagggaaaaattatgatctgcttatatgtcctgctcccaataaacacgccaaatgatgcttgaacattcttttcttccctgctccatcccacattctattaaaataatttggagaatatgttgtaacatttttaactttatagcaaatctcttttgagaattgtttcttgcattaaattttataaccacatcagtaataaactgtaacttttacctgtttgctgtgctattttctatttactatctttttcttgtattcatcatcttgattcttctcttttttgttctttttttctgccatagtacttcattaagtaattttatgggaaggctacatgcttgatgtatttcctgagtctttgtatatctaaaatgagttgttattgccttcatatttgagtaaaagcttggctataagtagaattctcgggtcaaatttgctttacttcagtattgtaccaagatttgcacactatcatttagtatcatttagtattcagtgcagcagatgagaaatctgatgccagtctgattccttttccagtttagtaaatttttcttgtttggtctataggctttatttgtgggattcagcaattttactaaactgtgtctagacacagctcgctttttacctattctgctatttctactcaagtcaaggttttctttatgtaaatgggattttcttctttcttttcttcttttcttttcctttctttcttttctttctttcttgaactcctgagctcaggtgatcctcctgcctcaacctcctaagtagctgggactaaaggtgtgtaccaccatgcccagctaatttatttatttattattattttatttttgtagagacagggtcttgctattttggccaggctgatcttgaactcctggcctcaagcagttctcctgtcctgatgcctctcaaagtgctgggtttacaggtgtgagccactgctcccagtcaagattttcttataatatgttgaaaatatattttaatctttcattcacctttttcttctttatgaactcctactatatggaattggatttcttctctattcttcatattagttttctttttccaatagttctactacatggagggatttctgttgcttacttcccttttatattcttaatttttgtggtgatagtctgcttttgacttataaatgctctataaaactgaatttggggagagtatttggtaggagtggctctggatatctgttgttcagggtagctagcttgcacttaaacctttatcttttatctgaaatgggaatatatagttatttaaatgcagggtggccatagggtatatacgttcagtcttcaaccatatatgtaattaggggatgcaggccagcagaagaattgcccttagatgcacaggtcaagagcagaccagcaaggttaatctgggtcctcaaggctaatggtttggggattcataggcaggtagcaaagcccctcccttacatgccatacatgtatgccaggtgagggctgcaggagctgtggccagcgcttatgtatattggtctctagttgaattctcaagcccctttgatttcctccctcattgtgttttcatcggtgactttgcttctcaatgacacactgtcaccagcggtgctgggaattgtggcagagtcctttttgttagaaagcataaactcattaaatcacttcagtcaaatcacttttgactgactttcattaaatacccctaacgtccattctaaagagccttgccccacccctcaccctttttgttatgacagttcctggtgtcctgctcaggtcctggtgtcttttgctatgtatctcaaactcactttgctgcctgtgaggagttcatcacagaaaacgtgctctctgatagcattatctaagccaaagaaagcttcagagacagcataatgcgatggttaacactgcaagtgctcttccaggcttcctgggtacacatctggcttcctgcttactggctgcatgactgtaacgtgctgctcaacctttctgtggcccacttaaatcctctgtaaaatgggtgattgattgttgtgaggtttcaaagacataatgcacataaagaatattttatgtaattgacatgtcctaaaacttagtaaatattttcactgttgtgatattttgggctagcaggtctctgtgctgggttttgccatagttgtcactgacatttgatttgcaccatgcctcctcagagttaacccgtgatcccatcccttgctattataaggttcaggattttatatatatatatatatattttatttatattttattatatatttttatatatttatatttatattttattatatatttatattatatttatatttatttatatatatttataaatatataatatatatatttataaatatatatatatttttttttgcagaagaaatactcccacaaacttcctctataaaatgaatgattgaattaaataatcatgtagctctcttacagctctaaaattcagtgccttggtaataaaatatcacttctttgtaatttcatggtgatttataatttgcaaaatacattataacagcacaagtataatttaactaatgaaataaaaatgaggatccaagagttgaaggaacttgtttagatctcataattgtcatgaaagcagttacttatttttaaatagacaataacaaaatcatttcggtgactttttacaaatgagagaatgtggatactcttaaatcctcaaaaagcagccattgtcgtcaataatatatgttgatgtttagtaaccatgaacctccgaggtagttttctttgtaattttttagtggaagattagcacatcttccatcctggcctctagcatattttctgacaaaccccttgttgattgtatcacataccttttatccatggatttggtacgaaagccctattgggcccacaaatctttcggttcttttgtaatttacataatccaatcaacaggggcacagaaacaccttgttctgaaagaaggagtgaaagggagtagaggatgctgacaccaaaaacctagggcactaactcatattttatctctgaatatagtactttgaaaccctagtgtcttaggaaggttttctgttcatagctgatttcacttgatccattcaaaagtcaagcatttttgtactcttactatataacttaaaatatattatagcatggggtgtttataccaatccttgaggggttaagctattattatcattattttatcattaacttctgtgagtttgacttgtacagggcctcctagcctgcaaatttcaaaattgacgtcttttttttttgagacagggtcttcttgctctgttgcccagtctggagtgcagtggcatgatctccactcactgcagactccacctccagggttcaagccattctcccgcctcagcctcctgagtagctgggattacaggcacgtgccatcacacctggctaatttttgtattttttttagtagagacaaggtttcaccatgttggccaggctggtctcgaacacctgacctcgtgatctgcccacctcagcctcccaaagtgctgggattacaggcgtgagccactgcacccagcaaacattgctttttttaataaaagactttcatatactttatctcacttgaacctttagacaacttctgcaaagggaaaggtagggaggattctccatcttgtatcagtgaaggctctggggctctgaggttaagcagcattccaggtttccatggcattaactgtcccaggcagggatgaagctctctgagacgtgccagtccatttctctctccattgccatcgctgctgtattgttactctccctttatattcatttttagtgaaggaaacaaaacagcagttgtcactttcctttcccagtagtttcattatttgctgtcaccagttctgttgcaggatcctctattgtaatattgtcttcagattttaaaaaatgtatctctacatattggaagaaagcactgtggtggaaaatacaggaaaactgtgtacagacctgttaaatggaaatgttttcataatttttagttagttttatttgtattttactaatgaaatttagtaaagatgtcaatgtcaatctttcttactacggaaataagttaaattttgccaactagtggaaaaaaagtttctgtggcattttttttttttaaggaatacaggattgatacaagaatgagagcattcatattataagaaatataagttttgtggttttttttgaaataaaaatttggtttatgagaggcttaaaaaatgaataaattcccttctttcctgatagtttctgtcgttcccttggggattaaaggagtgtgaatctatcctacagccacttcctctctgaactgtagatgacacatcaggatgtgatttggggtagatcaagcctcagagtcgaatctcagtgtctagccgtagaggtggtatgatagtatgataattccacatgtcctgccttctgggctttttgacattcatagcatttctaaacaagtgaaggatttatcttaaaaaataaaattttagtattttcttcattattcgtgagctttaattctttccattagaaattatgtcatccccatatttagagcaatgaataattgcataacttttaaattgtgtatttgatggtatggtgtatattgaaaagagaatgagaaactatcccctgaatagagatttagtgattcaagccatcactttctaaaatatacgcacttcagagtgaaagttcagtgtcagaacttcatagagtgtctggccagctagagttaggtatttcatggagagatgatcaaacaattgaacagaaaatacagcaaccagaagagtttttcactgtgcatgttcagaagacttcatcatttttattatcattttatatcaagccattttataagtagagatgtgtctagaggattgttttcatttccttttagctcattgaaagtcatacagtgtcactttagtaattctcttcttgcccagtggggatagaaaccagttttgggccacggcaactatatagaagtattttcatagagttacagattcattaaatgagaccctctctcctccccttaacacccactgtgtttctgctataatgaggatttaagcaacagtcccaacatgaactagctcatttcagtactagggaaatggctgttgcatgggtttaccacctctgattctgcaacaattgttctttttctgacagcgtcttctacctcctccaggcaggcacaactcttgatgacttgaacctcctatgttcttttttttcccccccagcttgtaaaattatggtaaaatacacataatataaaatttactatcttcaccgtttaatgttctgttcagtagcaatatgatgaagtacattcatattgttgcaactgtcaccagtatccatcttcagaactcatttcatcttgcaaaactgaacctctataccgcttcaccaataaccccccattccactctcagccagcccctgaaaccaccattctactctctgtctctaagattttaacttcacgagcacatggtaaaattgtaatcagattgtatttgtcttcgcaactggcttattttacttaacataatgtcctcaaagtttatccatgttgtagcatatgtcatgctatatatatgtcatgttctgcttatccgttcttgttaatagacatttgggttctttccccattttacctactgtgggaataatgctgctataagtatgggtgtagaaatcactcttttggaccctgctttcagttattttgagtatatacccagaagtgaattgctagataacatggtagttctatttttaatattttgaggaacattcataccattttccacagcagctgtactgtttccattcctcacaacagcacacgagttctgatttctccacgtccttgccgacactgttttttgtctcgataatagccatcctaatgggtgcagagtgatagctcattgtagttttgatttgcatttctctaatgattactgattttgagcatctattcatgtatgtattagccatttgtatatatatatcttctttggagaaatgtctattcaagttctttattcatttttgaatttgacttttttttctttttgagttttgtaaggtctctatatattctgaatattaatcccttatcaggtatgatttgataatactttctcccattttgaagattgcctttttactccattgatactgtcttttgatttttaatttttatgaaattcaatttgtctcttgtgttatttgtgccttttgtgtcatattaagacattcgttgccaaattcaatgtcatgatgcttttgcatatgttttattctaatctacaattttagatgttacctttaggtcatggatccatttcgagttaacttttataattatgctaggaaagagtccacccttactcttttgtgtgtggatattaaattttcccagcaccatttgttgaaaagactgtccttcctgtattaaatgatcttggtgcccttgtaggcagtgacttgaacatatatctgagggtttatttctggactgtctcttatgtgttattatgccaatagcacactgttttgcttactttagctttgtattaatttttgaaatcaggaagtgtcggtcctccacctttgttcctttttactcaggattgttctgcctattttaggtcatttcatattccatatgaattttaggataggtttttctactttttaaaaaatgtcactgggattttgatcgggaccgcattaagtctggatatcatattggttgatattgacatcttagttatattaagtcttgcattctatgaacatgagatgtctaccatttatttatgtcttctttaattcctttctgaaatgtattcaagttttcattgttcaaggcttttaactatttattcacgttaatttctaagtattttgtcttttattttttgatgctattgtatatggaatgatttgcttaatttcctttttgaattgttcattgttgatacaaatgtaagtgatttttgtgtagtaactttatatgctctacttggctaaattcactatttagttctaatagtctttgtgtccaatctttagggttttctacatataagattatgtcatctacaagaagagatgatttaattctttctttttaattttgacacctttatttttttttcttccctgattactctgatgaggacttccagtattacactaaattgttatggcaaaagctggtattcctaatcttagaggaaaagctttcagtcttttatcattgagtatgattttctctgtgggtttccatctgtggcttttgctatgttgagatagttttcttctattcccagtttgttgaatatttttcttatgaaaggatattgaattttgtcaaatgcttttctgtgtcaattgagaagataactttttttccattctgttaatataatatataaccttgatttgtttgttgagtatccgttcgttacaataataaatttcacttggccatgatatatcaaacttgtaatatgctattaaatttgacttggggtatttgattgaggattttgcatcaatgtttattagggatattgttctgtacttttcatgtagtatctttgtcggactttgatgtcacagaatgagttaggaagtgtttccttctttttaattttttggaaagatttgaggataattgttgttagttcatgtatcaatgtttggtagaatttactagtgaagccatggttccagattttttcttactcagattttggatactgattcaatcttcttagtattcatagcatattcagattttttatttgtggtttagtcttggtgcattttgtgtttcttgaaaatttccctgtcatctgggttatcgaattttttgccacacacttgctcatagtactctcttaaatcttttttatttctgtagaattgttagtaatgcccctacttttatttttgtcttttgtagtttgagtcttctctctctgtctctctctcacttcatctagctaaaggtttgtcaattttgttgatcttttttaagaactgttggattttgttagtattctctattatttttctattctccattctacttatttctactcttatctttattatttcttcccttctggtagatttgggtatggttttttctttctttttttccaagtttcacaatctgtagatttaggttgttggtttgacgtctttcttatctttaaatttaatggtgtatagctataaattgcctcgtttgcactgttttcactgtttcccatacgtttggtatgttttctttcatgttcattcatttttaagtatttttctatttcccttgtgatttctcctttgatccattgtttgttaaagagcatattattggctggatgcagtggctcacacctgtaatctcagcactttgggaggccgaggtgggaggatcacgaggacaggagtttaagactagcctggccaacatagtgaaaccccatctctactaaaaattacaaaatattggccgggcgtggtggctcacgcctgtaatcccagcactttgagaggccgaggcgggtggatcacgaggtcaggagatcgagaccatcctggctaacacggtgaaaccctgtctctactaaaattacaaaaaattagccgggcgtggtggcgggcacctgtagtcccagctaatcgggaggctgaggcaggagaatggcctgaaccctggaggcggaggttgcagtgagccgagatcactccagcctgggtgacagaggaagactccatctcaaaaaaaacaaaaaccaaaaaacaaaatattagccgggcgtggtggtgggcacctgtaatcccagctactcgggaggctgaggcaggagaatcgcttgaacccaggaagcagaggtttcagtgagctgaggtcgtgccattgcactccagcctgggcaacagtgtgagactccattaaaaaaaaaaacaaacaagtatattatttaattactgcaaatttgtgaattttgcagttttacttatgtctatttatttctatttttatcccattgtactcagagaagatactttgtatgacatctactttttcaaatctattgacccttatttagtttatgggcttattcatgttctatcctggaacatgtcccatgtgcacatgagaagaaggtgtattcaattgttgttcaagtcctctatttcctgacttacctattgtttggctgttctatccactgttaaaagttggacgttgaaatctctattattatacaactgtctatttcttccttcaattctggtaatttttggtttatatattttgatgatcttttattaggtgtgtatacatttacaattgttacatattcttgatgtattgagcctcttattaatataatgttcttcatctcttttttgtcttttagccttttttgacttaaaatctattttctctgatattttgctagtctgctttttgtgggttactatttgcatgaaatggtgttttctgtcctttcattttaaactgtttgtgtctttggatataaagtctcttgtagacaacatatatttgggttatgtgttttaatttattctgccaacccgtcttttgaccagagaatttaattcatttacatttaaagtaattattgataagtagagaattacttcttattttcctacagatgctccttaagttgtgatggggttatgtcccactaaaactgtcttaagttgaaataattgtaaatttaaaatgcatttaatatacctaacataccaaacatcatggtttagcctaacctactctaaacatactcagaacacttgcattagcagacagttggaaaaaaatcacctaatataaagcttattttataataaagctttaattatcttatgtattttattgtatgttctactgaaagtgaaagacagaatagatgcttcaagtatcgtgtttaatgaatgtgtatcacttttacaccatcatatggtaaaaaaattgtaagtcaaacccttataaaatttataagattataaaaccatttatatttattttctatatgctttatagtttctttgtcctttatttcctatataattttttttgtgtattcaattgattttttgtagtaaaatatttaaattcctacctgatttcttttgtgtatattctgtagctattttctttatggttacaatgggggttacatttaacatcctaacgttataacactctaatttgaagtcataccagcttgacttagataacatacaaaattctgttcctttttcagttgttgatgtaacaaaattacatctttatacattgtgtacacaacaacataagctaataatttaatacactcatttcttaaattgtagaaaacaaaattgggcttaccaatcaaattacaataatatgagattttaaatttgtaatttaaaaaaatattagtttcttaaatcatgtagaaaacaaaaagtaaagtcacacatcatgattacaatgatgttagctcttataagcgtctgcctatttgccttttctgacatctgtatttctttgtatgatttttgagttactctgtagtatcatttcttctcaacctgcaggcttcctgttagcatttcttgcaggagaaatctaacagtaataaagaactctctcacctctttttttttttttcatgactggcattttgattttctttctcacttttaaaataaaattttgccagatgtaggattcgtggttgataattttttttccttttagcactttgaatatattggccctctgttttctggcatctaaggctgctgctaagaaaaccggataattttattgaggatcccttgtatgtgatgagtcacctctcttgcaactttcaaaattctccggttgtctttgtcttttgacagtttaattagaaggtgcctcactatttgtctgtttgagttcatcttacttgtacttttttgagcttcttggatgtttatactcttggctttgatcaaatttgggggagtttttggtgattatttcttcaagtattgtccctgccttttctctctgtctcatacttctgggaattccatgctgcatactttggtatagttgattgtgtcccacaggtctcttaggctcagttcacctgtcttcaatcttttttctttctgattcttagactaattaatttactttgacctctcttcaagttttctgattctttcttttgctgttaaatctgtctttgagttcctctagtgaattttttatttcagttattgtaattttcatttccacaattgcttttttttctttttctgtattgatattcccattttattcatgcattgttttcttaactttctccttgcttcctttagttctttcagcatgtttaagacagtagttttaaagtcttcgtcaggtagatcccccatcaggtcttttttagagacagtttctgttggtttatatttttgttttgaatagaccgtgctatcctgtttctttgtatgtcttttgattttttgttgttgttgaaaattgcatatttgaaactaataatgtagagccctggaaatcagaccttttctcttccccaaggtttactgttaccgtttgtattttgtggggttattgttgccagtctctgtgctaagtattagctttttttgttaacttgtggtcttaagtattttctgagcctgcatgtttccctggttatgtgccatgactttctcatttcctctgttgttttcaaatgccctggttatcaaggtctgtctcccaaaatgagaaaaagtaaaaaataaaggaagaaaaaaaaaaaaaggactggccttttgagtcccatggaagtcacttcagctggagtgagaggggcaacactaatgatagttgcccctttttctttatgtgtgtgattaaaagcagcaattaatgttcagtccacagatccttgatatatggaagacaggtcctttttgcccagcttggatcatgtaagctgtatgcaagctgcttcaagtacatgtgcacagatgcctgccaaggatctaagaggtggggtataggtagttgctattgtgctgagatgtaaactttacctaaattaaccacaacttaccatctaaagcttccctccagaaagtagactcctttaatagactctggacttccaaaataagttgttgatatagatggtggcagtgcaatggttgtctaggtggaaagacagatttgtggtgcctcctgctttgccatattctcagaatccctttcacttccttcgatttttactaagcagaactaacttccttaattcctctgccatgcctgcaactattccttttctcccttctttaccaccccctcctcctttctccctgtctctaaatttaggttcccactcagagttctcactttgaccttccgttttctctcagtagatgtcactactctaataagatcaactttgatctttctttatctaattatttgaactgcttgtgacttggtactgtgttttcctttgacaagttttgtttcatttatccatgagatcttttcatagataacacctgccttttcactttcaatgtatccctaattctactcatcatcttactcaaaggcttacattctgttagacataccattatattttctagtcttgccaactaaatcgtgttcattgatgatatatcttgctttctttgtatatctatcaccaaggcttacaggattatttcaatctctttattttcttgcccatcatcctagttcatatcttctgggttacaacctactcattgccttcattctatctttttcacattccaactgcatatctgtaaccacttagtggtttaaaaaatattattttcttcctctggcttttccacattaaatttctcctcttggtttatttttcagagtactctatgacctacctcatcctatgtagcacactgtatctcccactgtgctttttatacagtccttgctcttttgaagctcatatcgtcattgtcagcttcatatgccaagccaatttttcttgtgtctttctcaatacctgatgaaccctcatatcctcatttttagaagcctaactctactattttactcatacgtgtctgacaactggatcatcttgatctctctcttctctgcatcctcagtcttttgattgagtcatgtgatgtggtggcatgagcccagggtttagggctaagaaaccctgctctgttgcttatcactgcatttcccatctttacatgcaaaaatgaggatattaataacaatttttagaaggttattttgaggactaattaagataatgtagagtatccaacaactgctggttcagagtaaaggctactatgagtcagttaataaatagatttattaatgctgtttgattttttctgccacttaatatatacccttttgtggggtaatgtaatcattgcatgtacattaatcttgccaccaaactttattttataagccagaatcataaaataacatgggagacttgtagaaattatttaaaatcacaaatcgtagagcaccagatttgacatggtcctaacccctctgccctttcttgtgatgaggaaactggagcctaaatttcttaagtgaactgttcatggtgacacagttactaggagagctggtcctaaccacaactagagatttctggactcccaggcctctgctctttccattaccttcttgttcatttattttagcaattgcctgaaggcaggatcacaacccatatttctgtatcacccataacctttattttcatttcattttattttttttgagatggagtcttgctctgttgcccaggctggagtgcagtggcgcgatctcggctcactgcaagctccgcctcccgggttcacgccattctcctgcctcagcctcccgagtagctgggactacaggcgcccaccaccacacctggctaattttttgtatttttagtagagacggggtttcactgtgttagtcaggatggtcttgatctcctggcctcgtgatccacctacctcggcctcccaaagtgctgggattacaggcatgagccaccacgcccggcccataacctttattttattgcgagaagatagaatagctacttgattgatatttgtggcttgattgatctattctttcttcgactgtgcaataggaattctctgggaaaggactatgaagtctgtatacttatcacccttttgatgcttttggggttgttgtaagcatgcaaagggttcattgtgcactgcttctgtatactgactcagggtggtggggagaggaaatgggagaggaagttatatacatcttgagcaaatcaagcttttctatttttagtccttgctactgtttggaaagtacagcctctgttcatggcagtctggcatgtgtttccttagtgccatttcgaaagggggaaaaaataaatatgggaattttttttttttgtagtgaaaatagttactcagtgaaatcacataagtttcccgtttttctcttgatgaaacctcaaacccactaggcacagattcctcaacctcaactatgcatgtgaaaggctcatgcagaacaggagaccagagtcagcaaaaccttgtatagcaagataagctgtggtgccgcagagaagcgcggatgggtggcggaggtggggaaggcagggaagggaatggtgatgttctttcatatttagtggggaacttggccaactaccagatcgttgccccctggaaaaggctgaaacctgaactaagataaagagacacatagctttgcagctttttgcttaagctgttccttttgcttcagtttctgtccttggtaaaagtttccctgactgctttatagctactcccccaattcaaataaataatttttctttaatagttgtgatggcatttgggagatttttccaatctaaggctatatcattaggacacgataaagagccttttatgctagtaaataaaatgatttgatctgtatttagatggattgctataacatagtggtactcaagtgatcagaaatggtgatgacagagtgtcttggagtcaccttcaggggtccattgaggcagacaaggaccttaaccaaggtggtggccatgaccatggagaaggggaacaagaatcaaaagcaatttggaaagagggggcttatgggaaagagaagagtccaggatgcttggcaggattgtgactttcttcagggagaatacatatccttcctgtcctagtatgtggcaaatggaagaatcctttggaaaaaaatgaggactttgaagcaggtgtgatgtgaatgttactagaggaaatgttgataccaatgagcaaatattgccctttgttaatgaaagggactatacagtctccagacataaacagctctgcctagacaaaattgtagcagtagggtgagaataatgcattgctataattaatgctaatttgtggatattgctgtattgttgtcattgttttttaattgaatatgtattaagctccaacagggtgctatgaataatgccaacttatagttgatttatgagaacactcagaagactttattaacaccagtaaatggaaactcgcactccttcgaggtggtaaacgtctttgccatttcgacagatgaggagaagtgaagtagattgtgttttctctgttggcactgcgggtgagaacacagaaactgtcgaatgagagaaaagtattttccttgtcccctggaattgggttagaatacattagtaaagaattctttaatgtgttcagagttgtgggattttaattaaattgttccagttattgttagcacttggattagcaactggcaaccaaattctaggccagcagatttcaaatttagcatggacaagaattggggtgaggccgatgggtttgttaaatgccaattattaggccctgccttcaaaggtttagatttggtaaatctaggagggggcttaggaaaatcttatgttcatggatatcgaaggtgcttctgtcctcaaaggttgctagcttcctttcaaaactccagtattttcttattttaggacgtatctttggccaccaaaatctagcttcacctgagaccaagggctttttatttaatagctgcaaattctcttataacacaccaagtataatcctgtaatcctcttttatacacaacataccaccagaaaacatgtgcagaagacttaccgtatgcttagcattctagtggacacatgatttctactaccttatttcacctggtctccaaaatatccctgtggggttggtattattgctcccttatttcataagaagacactaaaactaagagtatacgacttggtcaaacatcacatccagtttaatcctttctatcttaacctggttaggcatatattttactttaagtttgaacaacaggtgggattctttttggcactgacagagtttgcagttgacagtagagactgtaaactcggcttaagtggacccgtcccataaagaaaaacattcacattggaacaagggagaggtgaaaaggaaagttggaagtgagtaattcaacttttcatttttttttgtccccttccttccttccttccttccttccttccttccttccttccttccttccttccttccttcctctctctctctcttttctttttttttttttgagtctcactctgtcgcccaggctggagtgcaatggcatgatctcggctcactgcaaactccgcctcctgggttcaagcgattctcctgtttcagcttcccaagtagctgggattacagttgtgtgccaccatgcctggctaattttttttttgttgttttttttttttttttttgcatctttagtagagatggggtttcaccatgttggccaggctggtctcaaacttctgaccttgtgatccgcctgccttggcctcccaaagtgctgggattagaggcgtgagccactgcaccgggcctgtctcatttctttaatacgaggtactaaactgtcactgagtaaatagtagacatttgattattatttgactctgaatattttttgaaaaaaggaacatttcataagaaagcctgaaatgagacatgagcagaattctggggtatagaaatgatttttaagttgagacaagaatagtgaagcttgagacgacattattccttgcctcctttagactttcttcagcctccacctagcaaagtaaaagtcttgtcatagcagtctgttgcattgtattccctgggtctaaggcagaaatgtgtacgtgctccaataacccttgtttgttgtgctgtggaatcacgttcatttctgattaaggtgaaatcagtagctttctgatacggtctctcactcactttttatcaatggcaacctttttcctaaaaataggaatttctgctgggagtgttttaatataaattgtctgtgctcagcctgaaatatgtgtgattcataccatgtgtttgttcccacatcaacactaagtcccaagatacaattacccctgcccactctctccttcgtcatggggaatgtgtttatcctttagatatcagcaccttgggtaagagccaatctccttatatgccttggtttgcacacctgcattgtctgaccacagctgaccctttgagtctgctcttactctatttttaccttaaagaacactcgtgtttgccaagtacacttgcacattgcagagttccttctatatctttatgctcatgttgtaaatatgttaaatacttgttctccatttaaggccttctcaattctgtcgccatatagctctctctgatttctctattcagctactttctctctttcctctctctcattttgcttttttctcgaacatcttgtgtgtcttacctacatgtagtctgccttctaatatggacatttgtggataaactagtttcttcaatgcaactgtaagctcttggcagagaacccctgatccattctctttccctccctccccttccttctccctctccctcctttcctttctttcttccctccctgcccccctccctccctccctccttcctccttccttcctacctgcttccctcctttcttcctacctgcctccctccctccctccttcctttctacctgactctctccctccctccttccctcccttcctcccttccttcctcccttcctccctccctcactcccttccctcccttccctcctttctttccctcccttcccttccttccttgccttcctgccttactcccttccctttcttcctccctcccttccttgcccctcttgcctgcacctcatatcaccgcgacctgactattcgccaaccaccttacacgaaagtccccgacacctatccttaccgccgaaccccctggcacaaagggcgtgccccctcggcttttccgctgaggtttaagccccgcccagttcccgcagcctcacagggcccctacccctctccatgacgataaaaggtacgaccccttcccctttccgccattcctttcccagcctcctcccccgctccccctttcgtaatacccgctccctttcgaagatcaatcccaccctgcccttctcccccccccccataatgacccgtttgattccggccgccccgcaatccctcctcgtcccgcgcccacacacactctatacctcagcaacccgctacgacccccccaccaaacacacgtcctccccgcgatcttcgcctccgccccccccgttggggccggcccggccgcgacggccccaccccaccccccccccgtcacatccccnnnnnnnnnnnnnnnnnnnnttggtaatctaataggcccatataatctctgcttggtgttagaagggaagacctttcaccttttgtgttttcttcctaatgtcatgcaaagtgctagagctttggagcaaaacgtttgatttccaaattccaattcttccgtttactgcccgagtaaccctagaaagttctctttttctctctgatccttgggctatcctcttttgaaaacaggaataataacatctactaatctctaggattgctggaatagctcgatgagatcgtatatatgaaaatgcttttctaaacctgagcacttctctgtgataatggccgtacagagggagctatgatattttccctcttgttttcccagtagtgactatgtcccaggctgtgtgcagtggactgggtagctgcctagtaatattgctggcttgtaggatatttcctgttttatatgttcttaagaagatcagttgaaatgtacgagatgtcgttttggaaaagatgtttcacagtgggaggtgttaaagttttagtcctacttcagccccttcactatacaaactaccttacctttttgggggaattgtattatctttaaatgaaaatgatggaatagcgacgtaaattccccttctagttctaatattttatgagccttatttccattttctatgcttatcaactataaatgattctcttgcagttgttcaaacatcttttatctgcacatcctcatcaatggtatttaacatatagaatcagaaccacaaatgtttgaagaaaattctcggccagacatggtggctcacacctgtaatcccagcactttgggaggcctaggcgggtggatcgcctgaggtcaggagttcgagaccggcctggctaacatgatgaaaccccatctaaaaatacaaaattagccaggcgtgttggcacgcacttgtaatcctagctactcgggaggcttaggcaggagaattgcttgaacctgggagacggaggtggttcaatgagccaaggttgcagtgagtgccattgcgctctagtctgggcaacaagagcaaaacccggtctataaataaataaataaataaataaataaataaataaataaagttcccaccctctgtacgtttccatggcatgacgctttgctttatatctctgagtacatgatatggaatatgggacatgggaattgaatacttttttatggtttccaattttggtaacatttaaggggtcaaacaagagttcaagaaaaaaaatacttgaaaatgatgagctaatgtataaagttaacatcacatttctaactatttgaattttggggaatgtgagaaagtggcttttgaaatgtatcatgcctgagcttattaagcctgtgttaccaaaatgaaaaataagaaacatgtcttccttgaggttttaaaaaacaaaatcaatagcaaaattacctgacaagttctgtttgattcataaatccacacaattgttgcacatctccagccccctcaccacatatgaaagttttcttaatgtaaaagtaaaccttttctcccctacctctaaaaacttctgtctaccaattttattatttcatgttattttgttatgcaaaggattcctggaaaaatatccatgatcctagatgatcttatggatatctttataggtatttcaatgtagaaatttcaaataaatgtatttcccttttatgcacaaacacagagttcagaaaagacagttcatttagagtttgctaaactgtgtgtgtggactaactggtaaggtgacgctctaggatggcacagcttgcctagataatctgtagcagtggtttttaaactattaatttcttagaattgcttcaggaaatattactaaaggagatgggggataaagcagctctgtctgtatatgtttcatacaatgggtttccgtgtctgatttcattttaccaggggatctgctgcttaaaaagggggtgccaaatatctattttactgtcaaatagttcatcttattgtgattattcttagagttcctgttttattgatgaatagataatatatgtattgttccttattattatctatgcaaattgacctttattttaattgtaaggggttactttaaaaatatattatttatattatttttattttataaggattggaattcagtagaaatcattcaacgagtaggtaaatattgtgaaaagtgaggggtttttgttgcatatttagttttgctttcttatttgaatagaacagtgaacagtgaggctacttgtgtatacccaagttcagatcactttaaccatgaccctgcccttacttataaaagagttggcttaaactcggagttggcctaactcttacgggtttagtctgatggcttttgaacagcaaagatagtgacaggcaagttgtgaaatgtcattatagatctatgcagtattagaggttaaaaaaatagaaaacgacctggaaggtgcataccctcatttttgtagaggtaaaagttgagttccagaaagtcaaagaaactgcttgataatatcagcgggacttggtcttgtttaggctgcttcagtagggctgattgtgtgaaacagaggccccctggagtagcgctgaatcatggagtttatcttaaggatggatctgaatgagatctgatatcaggaagctcagggtcagggcagatctgtggctgaactcttccatctatttttcttctcattgttttttttccctctctcccttcctcttttcctctcctctccattcctctgcttctctagtgttcgcttgttcattgttttcctccacccaatgatagacttcctacctcctgttgtatgtttggattgttaataattaaccatgtacatcatctttttggttgatcacagccatagctcatccctgtggcaattttttattttttattttatttttttttttattttttgagtttcactcttgttgcccaggctggagtgcagtggtaagatcttggctcactgcaacctctacctcccgggtgggttcaagtaatttttctgcctccagcctcccaagtagctgggattacggttacccaccaccacgcccagctaaattttgtatttttagtagagatggcgtttcgccatgttggccaggctggtcttgaactcctgacctcaggtgatcctcccgcctcagcctcccaaggttttgggattacatgcatgagccaccgtgcctggcggcagttttgttacatgtttttcagtccaaacgcataagagaaggagatttatttgcccatctaatctccttgtcactgtccaaaagttaggttcaccagcctatttatggacccttggttctgtgggcctcagtgttctgaaatggagtcgcatggttgaaaacatggctgttttggcaacaaagaatgggggcaggaccatttcctttaaaggagatttgggttggccaaacattgctaacactgggtgagtgtgttagggctgaaaaggatgaaataatgtaaattgtgaggaaaaaaaattcaagcatttatcaagcgtagcatttatgttctatgttgacgtttgatacggcttggatgttttttccctccaaatcatgtcagaatgtgatctccagtgtttgaagtggggcctaatgggagatactcgatcacagaggtgaatctcttatgggggtttagtgccatccccttggtaatgagtgagttcttcctctgggttcacacgagatctggttgtttagagagtgtggtacctctccccaagccttgttcctcctctcgccatatgacatggtagctccctgttgccttcattcatgattataagcttcctgacgctctcatcagaaactgactggatattgacaccatgcttcttatatagcctgcatagtcatgagccaatttaacctcttttctttataaattacccagcctcagctattgttctatagtgatgcaaaaatggcctaatgtaacgtttttgtgctttatcatgaaaaactcttgtcttctgttgttaccttatttcttgtttatttaatgctgtgttctcagttgtcaagccagtattgcacttcagattatggaaatgtattcccccttatgaatgctctagtgtttgctcccaagacagcttttgcgacaacttttcccactgcctttaacatgtggagaagatgtccttctcggatattaataagacttgagtttaggcctggttttgcatattagaaaagttgaattgtatttctgttggccattagataagaaggattttagggaaggggactgtttttgtttttaaatttgtgtctcttccacatagttttacaaagagtatcaaataacatagtgaatttgatatctctaggcaaaagtgcaagtgatatttttcagtagaatacatatatataaactcctcaaggttgggtatcatggcttttttacactgcatactacttagcataaactattttctagagcagcatgggagaaaagccatccactcaaatccatcatgagagttaccctatgaacattggtgtcatggaaaattagacaaagaggagtcagttatcaagttagtgggttatttgtaagtcctcctcccctggagaagggtacatttggggagatagataggtaaggtttttggaaagctaaacacttcaactgaatgactgggaaagaggatacacatcccaataggaatgcattcattttttccctaacttacaacagtttgtatctcattccataaaatgacatttctattagataaaatagatcatattttctgcaattctcactactgaatacggcctgtgtccactgaacattaccaggatccgtttggtgaggctgctcatattactatacagcatgagagattatattaaatagaaatgttactgtcttcatttttatttttatccaaatacctcttagctattatttggtgtgtcaattggtattttcatggcatcattaaccatatatatgacataatataggttgtttttaagggaaataaactataaattcactcagtacccacccttactccccctgccccacacacttaaatgttcattgtgttagaaatccacttagaaaagtcattctcaaagtgagaacacctcactttgagaatgactcagaccagcaccatcactggggatgttgagaacatccccataccagcgccatcactagcacctacgaacttggtagaaatgtaagttcttgggcctcacccaagatgtacagataagaaactgtggcaggtacagcctggtaatctaaggtttaataagtcctcctggtggttctgtataggctaatgtttgaaaaacactgatctaggattgtgttctttatggttaattcctggcacccttacacatgttcagatgcatagaagccccatctactgaagcctctcagtaacttagttttacttttgatcaaagtactttataaagtcacatactcaattgcctgactattaacagaagcatttattttgagactattgtcaaagtaacaattaaatagctagcatttattgaatgcttattatgtgaatattacttgacatgcataaacctatttaatttttacaactgcatgagggacccgagagctcaggtgaattgttgaaggtcacaaagccagcaattgggagatacaggtattacagcctgactccaaagctttcaccagtattcttttttattagggatactttgaggaaattacttaatacaaatgattatagacaaataaatattgattgtttccccaatttcatcaaagacagatgatggaaaaaagattgatctaacttacaacaaaatgattacactttcaagagaaactagatagaaatagtttggatatctgtcccctccaaatctcatgttgaaatttaatccccaatatttagatgtggcctagtgggaggtatttaggtccctcatgaatggcttggtgcctgtatgagtctgttttcacactactaataaagacatccccgaatctgggaagaaaaagaggtttaattggacttatagttccacatggctggggaggcctcagaatcatggtaggaggtgaagggcacttcttacatggcggtggtaagagaaaatgagggtgatgcaaagcagaaacccctgataaaaccatcagatctcgtgaaactttttcactaccatgagaacagtatggaggaaactgcccccaagattcaaattatctcccccttgttccttcccataacacggggagttatgggagtacaatttaagatgagatttggatagggacacagagcaaaactgtatcagtgacctccccatggtactggtcatacagagtgaattctctgttagttcataggacagctgattgtttaaaagagtatagcacctctcctcgctctctcttccgctctctctcaccatatgacatgctgcctcccattaccttcctccatgagtaaacgctttctgaggccctcaccagaagcagatggcagctccatgcttcctgtacagcctgcggaaccatgagccaaataaacctcttctctttataaattacccagcttcaagttttgcattatagcaatgcaaaacagactaacaaacatagtgtgttttgttacttaaaaagcacacactttcaaaattcctttagttatcaccattttcccccactgatattagaaagaagagagtaataaacattactgaccataatagaaaaaaaatacagtgaaattcctgttgtattattaaatttaaatgaaactaccattgaaaagaaaagttgtatgtaaacacaatgtaatttttgtattattagcctcttaggttttactaaattaagacagttttatattcctaagttatcagggaaagcttttctaattaatcacaaaaggaagctcaagcttgggtagggtctgggaacctctttgttttccatatgggatcagtggtaagacattccttgagctctgtgaagcacaattgaaaaaaataggattatgtggttactttctcaggtctgtaattgagcagtcacattcaaattccggctttttgaactcacaatctataatgtgtcagtatggttgtctacctcagagattctgaaggttgttgaagattagttcatggtcatgtatgttttgagtatgacgctgggcattggatctaattctagtatataaacatccaagggtggagactgtttcttaattaaatagaccattccccttggccttttgtttcctttaatatcctggataagattttcctatgtaacagtttttacttgatgattaagtttctgatttttttttcatagcacaggacttttcagttagtcctgctcccctaccttgaaaccgaaatgaatactgaacaaataaatcgttaacgtattaggcaagatatgtttattttcatcccgtttcacaatcattaaggccatagttagttcaggcaaagatcatctatggacactaaaaccactgggtgggtgaaaggtttttgactagtagaatactcacagtgccccaaaatatcacctcacagattatttttaatttaaaaatcatgcagtcatgcttaaaatggtgaaatctggtacacactaccttaatcgagtcatcaaactcagcatcaccaagcatgggccaaactgacccttgagcttcctgatgggatgcagcagaagggatgtggcctcacgcatgtgatattcctgcctgacttatttaatctgaatccagtcatcaagaaaaaccagattggttggactttttataagacacctgaccagaattattttaaaagttggctttataaaaatcaaaaatcagctaggagcctgttctaaattaaaagagaataaaaagacatatcattttatgatgtgatccttggatttggggtgaaaattaacagtagataaaagaacactactggcaccactagtgaaatgtgagtatgggtgatattagataatactgtttctatgttaaatttctccagtgtgagaatggttttgaaaaaattagaaattcttaggagatgcaaactgaggtgcatatgggggatgtcggggggtggttttgcaacatcttacagatggttcaattgcaacagcaaatctaatttatgtagacagaaagctagtgtgatgaaatggtggccactgatgaatctgggtgaaggatgggtgagtggagtttattttaatagttgttcaacttctctgtgaatttaaattttttggatataaagaatgaaaaagtaaataaatacaaatgaatgctctttcataaccaattgctggtactcctcgtctatcacctgtagttagtgggttagtgatagttggcctgaaatatgacccattcaaaatcagactcttgataatggcctaagttcatttcattcacacgctgtacattttggttctgggctatttattggactgtctttatgtacttacagtgggggagtcatcatcctataattctgctggcagcacttattatgatttgtcaagtcataataagtcccaactgtggtttggtgagctttttatcacatatgtattcagataatgcataaaaataaatataaaaataacatgttcgaatggtttattcataggatttttgtggtccttggtaaagggacgctgtcagtagacacctttggtgccccacctcgcatcttcccctcccaccttcgtgtaccagcagctgctacagcgatcagctctgcacaggtgtgacctggtagcacttggcttcaactgcaacacctttcactcactttctgtgccgggccttctctgcaaccatttaacttctgagacttgtgagacttattcacaaccaggagaacagtataggggaaaatgcccccgtgattcaattatctcccacacggtcctgcccacaacacatggggattatgagaactacaattcaagatgaaatttgggtggagactcagccaaaccatatctccttccttctctgcttaactccttctagtccctcagtactgtttctcagaattgattcccaaaataaatggccaacatgcgagcttttctcacaggcattgtttttcttggcagaacacagactaagacgatgtaatctttgaaatctctctagtgatggttaaagagtgtggggattgttataattacattaactactttataaaagtttgtggtggtaactagaaaaagcattagtcaggagaatcttccttgttgctggcattgggaaggtcatttaccagtcaggtaactagcacagctacaaagatagggagttaggagaaagacatgttggtaagtctataggattctgttgcttggttataggactttggatcctggtatctactataagggattgagagtagcaagatcccctaaatcgaaaggtaaatgaatatctacagattcgtggcaggacttgggcaggacaacagttatttgaactgagatataaaattgagactcaagagtgaaaaaaaggcctattctaattcataatggaattgaaatgtaggagtaaagctactatagtatttgcacaatcttctcccctctcaccccacgctcccctgttatccagtttttgtgcaaaatcacacagcattagactggaacttgtgataaattgcatcaacctaatttgagaaactgaaaatagggagcagtctgaacttagagggtagggagaataaggaccctggaaactaattgatgtcttacaagcacagactggttgcatatcataattacttgttttattgtgtagttcagggtaattctgtgacttgttgagtctcagtggttagatattgcagtgacttcaggcatagtcagttgatgtactttctgcttcagtaaagtacagatgtagaagacctgattaaatcctgtctctttactaataccccaagggaacacttaatgaatgatgcttccctcaagaagaagaataattaacaatagctatattattcatattaatttatagttactggttgctataattaatgctatttaggaaaatcatcataattatagcactttacaacttacagagtattttcccatccattttcttatctaaatcttataacatcaccctggcttagatagaacatgtgatattctcttcattttatagatgagaaaactatggcccagggaaagatttaagcagacaacactctaccacccttgccaatatattggactatctaagagtatgtggaaatacacttaccaaatttatgtctactataatattttatatctgcgcacaagaggatcaactttactcagtttttagttgcattccaaaacaataatgtcctgtctttccttgtaccaggacccccattacccagaatgttcacatgaattttaaatgttaaatggaatttttcttaataataccacagtgtttcatagttattactgccctttgatataaacatgaaatctcctctgatagagggattagcaccttgaaaacatctgtttccagtatacagacctgctggccttaaacagtttaatcagactggaaattcagactcagaaaagtctaaatttcaaccaacctgtcatgtcactctttttctatttttggctatgacaagagagttgaagaaaatctatcaatttcacaaggctagccttcaaatctgggccgtccagcttgatgatacacacatagttaccagtgtgagcgtgtgtgtgcacacacagatggacactgaacctctttggttccgtttttatatcaaattctagagtatccactgcttattgttgtacttctaactgtgtttacccaaaagatagtgctatgagaaaggttactgcctgtgtcacagtctgtcattattcactgatttatttattcaaaaatacttactgaacacttatttgggctaggtcttgaaagagagtccaaggaaacaggaacaaaacagacaaagcttctcatgaagcttatatgttctaggggagagactgaaaataaacagaaaaatacacatggtggcagatattatttaaaaatggatttaaaagggtaggggaataacatgacgtgatgtagaggggtcataataatacatccagaaggagaaaatcataaggtggctgttttagataatgtgataatatgaaatatatatatatatatatatatatatatatatgtgtatgtgtgtgtgtatgtgtgtgtacgtgtgtgtatgtgtgtatatatatatgtttgagacatatatgtgtgtgtgtgtgtgtatatacatatatgtatgtatgtttgagacagagtctcgctctgtcatgtaggctggagtgcagtggtacgatcttggctcactgcaacctccgcctctagggctcaagctattctcctgcctcagcctcccaagtatctgggattacaggggcctgccaccacacccagctaatttttgtatttttagtggagacgggtttcaccatgttggccaggctggtcttgaactcctggcctcagataatccacccgccttggcctcgaaacctgctgagattacaggcatgagccaccgcgcccgtcctgaaatccatgtttaaagagggctcacaaacaaggaagccaactgcctcttgaagtaggtttggctccaaggacctgggccacaacttcatagacagttgatgttactgtgcttgagagagatcaggcccaggaaggattaactcaagctgactaagttcccaaaagaatgaccaaaacaccagatccctttatgtttcttttacacagatagttaaataagctccaagactcaggtaaggtggtttggtgagtaagctactagggcatacggaactagtggtcttcacaggccattaccctttacgcttgcttcaacatattcactaaaacgacagattgacttcaagggttataagatttagtgctagcctgtcatggcacgctacttgttgttgttactgaagatattctagtttcttggttggttaatgctttttctaaactcttttgcagacactagatactctcttgatattttacgtccttagacaagtccagtagaattgattagattattgtaactttccactattgtattgccattgagtcttgctgaagatacactttggtctcttaatgaagttttaagagcttcttccatattcatatatgatcattattaaattgtcactttaaaaggttatttttttacttcaccctgcctccaaatactagggtcatctcactttataatccagacagattctttgcttctttttcccaaacctgatcataattcctggaaacaccctgtgtcgatgttgttgtcctctactctcctgttgattctgactgcaggtaatacgaggttctgacataggaaatccggagatcctgacttcattgtccatgctcactgccacatgcttcccctgcagccccttggcagaaccctaagaggtctctttccagttcatgttctaggtgcatctcttgggtcttgccatctctcgcacacatgcatacctaataccccctggacctgagacttccaagcactggcatgctccaatgtcttcaagtgctgattcctctttctggaatgtccgtgttccttccctgctccttgctactccaataaatattattctaggcagtggtgtctaaacaccaagtgcttgtgagctctcttcagctggttctgttctttaggtgcaggaatggagacatttattttcctttacttgtatacttattttaaacaacaacaacgacaaaactgctaaataagtgtgtgacctgagaaaaatcatcttttatttttcagttttcatatctgtcataaagtgataattctatctcagcctacctcactgagattttatgaaagcttaattaaaaaaaaaagaggtgcagaaaaacttggacaaagccacattataacttgagaaatttgaacttataatgatatcaagggaaatttcctttgttaacatgtctgtgttgcttccaacaggggaatcccggaggcaagacacttgaggagaggcgctccagcctggacgctgagattgactccttgaccagcatcttggctgaccttgagtgcagctccccctataagcctcggcctccacaggttagtgcagcccacaatcatctccacacagccattcccagatattctactcttatcagaaagaacatgctgcacctgagagcttatttccccttccttccttccttccgtccgtccttccttccttccttccttccttccttccttcctctctctctcttctttctttctcttttttttttttttttgatggagtcttgctctgttgcccaggccggagtgcaatggcacaatcttgtctcactgcaacctccgcctcccgggttcaagcaattctcctgcatcagcctcctgagtagctgggattacaggcgcctgccaccacacctggctaatttttgtatttttagtagagaccgggtttcaccatgttggtcaggctggtctcgaactcctgacctcatgatctgcctgcctcagcctcccaaagtgctgggattacaggcctgagccaccatgcccggcccttttattctttcttgatcttcttagagtcaatgatttaagttgcctttttatttaatatcaacatgtattagtcaactggcagaaatttcttaaattgactctttgagtactttctttaaaaataacacaacatcatacaaaaatgttatataaaaaagtaaatctcttattccattgccttgctcttcttacagctttgtctatatggatattttgttacatgttgttatagttttcacaaatatgacttagcttggctatgtaaggttaaggtgaagggctgtgtcttttgcaaggaaattagttttgttggatattaaggtgattttcattatttttgtcatggttttaaataatgctacaggggacatatttgtgtatattttctttggggttatttcctggcctcagatttctaggagtggggttgctacattgatgaatgagaccactttatttacttttctttcctaaggttgtgaatagttgatactggtaccaccagttagtttgaatatatcagtttctcctcaagttcactagaatgtgatggttgcaattaatctgtgttttgtaagtgcaaatggtgccttgttagtttttctttgctttttaatttttttatttttgcctactttggagcttggctatttttcagcatcttcacttaatatctgcattccagaagctgatcttccactgctagtgatcattccctgcctctctaaagtcttgaaagggttgtggcaaatctgtttcagggcttccaattcctcagaagacagccatcagaattgtagttgcaaacgctagagaagcagtattgtcactgtgctgtttgactcttgcgtgacatttgtttgactaagtgagagtgcatagagcctctgagcctcactccagttcttgagtggcagcttctgtatttacagtggttcctttcttaaattaagaaccagtcttgtttctctgctgtcagttatttcaatacttaactgctcataaggtggcagcactttcttcttcttcttttttttttcttttatgagatggagtctctctctgttgccaaggctggaatgcagtggcgcaatctcagctcactgaaacctccacctcctgagttcaagcaattctgcctcagcctcccgagtagctgggattccaggtgcctgccaccacgcccagctaatttttgtattttagtagagatggagtttcaccatgttggccaggcttctctggaactcctgacctcaagcgatctgcccgccttggcctcccaaagtactgggattacaggtgtgagccactgtgcgtagctgctgtcttctttagatacattccctgtaccttttcttaacatataatggaattgttagccatgtgggattcatggcaaaatatactaccacttagctcttcctcactgaccctgctcttggctctatccatcctgtgagcagtaaaaatatactttgtccctgtaaatgtgtactgaactcatctgtagaaggcactgtggtcttttgggggaaccgatgaggcaaaaaaagtggatagttgagaggaagagaaataggactccgttgtaatcttctaatagcctgtaatgttatatgtgaggatatggcctatactgcaggagcacaaagaagatagtgatatattcttctgaaggtgacacagtctgataattcttatcaaaagacttgcattttcatctggaggggtgagtggaattgtatcgttcgagacagcagcagggagtagcctgagccacagggctgcaagcaagcaccaaggctgcatttagagatctgtaagcaaccagatggctgcagatgaagcctttgaaggcttgtagtagaatataggtctgggaccagcctggccaacatggtgaaaccccatctctactaaaaatacaaaaaatagctgtgcgtggtggcgcccgcctgtaatcccagctattcgggaggctgaggcaggagaatcgtttgaacccgggaggcggaggtttcagtgagccaggatcacgccactgcgctccagcctggggacagagggagactccatttcgaaaaaaaaaaaaaaaaaaaaagagagaatataagtctggtagtttcctacagacagcgtgtagacacgtttaaatgccagattatgattttaatctgtcttttgtagataatgggattatttgaaggttctcaatcagggaaatctaaaattcattctgaaaaaggaacataggaaataagaccaactctagaatgatgcaggaaatgagcccaggtcagaaaaatgttctccagcaagccactcttcatactttctgaccattgcttgatgttcagcaattttttttgattccacccaagcaaatgccccaaatctcatctcatatctgaagacaggaaggccactgactttgccactggactcagcagtatcatgcccaaatgcttttttgtgctccctttccttttttttttttgtaatgggttttcactctgtcacccaggctggagtgcagtggtgggatctcggctcactgcaacctccgcctcctgggttcaagccattctcctgcctcagcctcccaaatttagggaggatagcaacagtgtttctggctgcagtaaatttggggtaatgactttagcttacatctactttataaaaaatcctccatgacactgcatggatttatgcaattgaactaccttaatatttgaaactaaaatttctaaacattttaaaagtgtttgtcagggagtagttttagaataacagatgagaaaagttcagacatattcctgtagtgaattgcagataaaatgtgagcatagagtatcagagctttagtgggccttccaggtcatttagccaaacttacaggtgtgtgccaccatgcccagctaattttttgtatttttagtagagatggggtttcactatgttggcaaggatggtctcaatctcctgacctcgtgactgacccacttcggccttccaaagtgctggggttacaggcatgagccaccgtgccctgcccctccccgccccccagctttttttttaaacggagctttcatttaaatcttttttttcctcccctaaatccttataacctaatagacactgaggagatcatgctttgaggtctattgtttaatacaacctttattcttgaaggctgtgtctatacatgcctctcataaaccattgcattttaataggtttattctgcagctacgttttgtttgaggaatctttctgagcacacaaattcatcatcactgatatttggacagtactgattgtgaagcactttcacatatattctcacttgagtgagatatagatatctcagttctgagatgtgcgtgatgtgctcctttcagggatgatgaaactaagactcaccaagaagattaatggtttctccttggccatatgtttgagcaccgcgtgagcacaactggactttgaattttggcttgtgcttgattttaagttctaaacaccagattgagggtgtcaggttttgtctttgtttttgtaatgattttaccatcgatgaaagctggcatcagtcatctgagtgacactgtcccttgaatgttgctttcccataaaaagaaaaacattcagaaggtcaaaaaaaattaattgtaatagccattaagtagaataagttcataattatggtaaaatacactttcgatgtgcctgttccattcagaaattaaaggatgatccattctaatttttttctattactatgatttaacaaagcaagagttaattgggagatatatctcatccttttgaattatcttccctctggtggaactgaattagatgtgttaatatttattggttaacataattataggctgtgagaacaataatcacacacttaaaatattaaaagtatgtgccaagagaagatgatgtctatagtagacggtgttgtgttataattgaaaggtacttgaaaagtcctagaaatgtagaccgttaatgcccaacattgatgtttctatttttgttcaaagcaaatttcaaaacctatagaatcacctgactacttaaaataggctagtaggtctgtgatttctcattagtcaaacatgtgttgtaagcttttttgaatccatgtctctatcatctttggaaggctgctttgactcatggtctaggaaaaatgatatatatgtggaatgtttatatggtaagaggttccaaggagctccattctcaaaacaagtctgaaaaatgtgagctcttgaaaataggttttgctaaagcattttcttccttttattctagggagtattttccgctcccaaattttctgactttagttatgttcacttactaatccctatattgattttggaaatttggcttaattccacatattcattgattcattgattcattcacctaacatttgatgagatcctcctctggatcagtcattggagatttaaaggttagtatcaacaggtctttcctttagagtgatatttaatcttacagaagagataagcccgtaagtaacccaaagggacacaggagaagggcttcaatgtgctacttaaattgtcacgtaaatcaccacgtgtcaaaattattgggagataaaatacaggaataccaacattgtaccttatacctttcagtgtcagagaggactgcgtagagcaggcagtatttgagctaacttggcttaaagtgttacgggaagggcatgggattcaaggtgcaagaataacaagagtgagaaagtcaaggaacgtggaaagtgaatattatttgaagaataagtttgtctaatggggtatgtaaagtgtaaatgggattactgctgaaaaactcaaacttacttagcagtacctaagtagcccttttgatgcccaagggctttcattgttagaaagagaaatttacagggggatagcaacagtgttactggctgcagtgattttggagtaatgactttagcttacagctactttataaaaaaatcctccatgacgctgcatggatttatgcaattaaattacattagtgtttgaaaccaaaatttctaaacattttaaatgtgtttgtcagggagtagttttagaagaacagatgtgaaaagttcagaggtgatcctggagtgaattgcagacaaaatgtgatcatagaatatcagagctttagtgggccttccagctcacttagccaaactcttattctacagatggaaagcttttgcccagagagggaaagaacacactcaaggaggctcatttagagacagtttcagtgattctttgtattttccccgaactatgacacaaaggcccagcttgatgataaccacgaccaggggagagtttggtttcctttagtatcacaattggtttattccaaaaagtctttcttttatggcgtcttctttaaaataagtctcaaacacataacaaagaattaggcatatcaaagacgtacttcaatggtaaacagaaaacttatgacgttgtaacatctttaagctagtatatatctaaacccaacccattaggtaggcatgatttgttagtataagtacagcttagcctctagaagctatgcaggggttggaacgaaattctgtctatttcttagaagacaagagatcaatcatgaactaatgacttttgtgttccttcttttatcagagttagggtacagtattcatcttctagtttctagtacagggctgtctttttttccccaagtaagtttggtaggattggagctgatgactgagtgacttggaacacttttcaaataaactgtcttacgttaatatttcatggtagctggagatttagtaatttgtgaatcaagttgcttttgaattgattaaatgggctttcactatcctcatttagactagtgtgatactgtgaaataataagaaataatatataaatatatttttctactccagtttctgaatcagtgtttgtaaatccttataatttcctaggtgataggggtgctggtagcatcttttgttctaacattattttgttattgaccttggttcctgactcagagctactgaattctgtggaatttcctgagtgatggaaatatctattgttttgatgaggcaactcttggtgggctcctggattttggctggttaccagaatgaccaagcaatgatttgaagcttggaagtttaatcttcacctctcatcctctggggatgagaaaggggctagagattgaatgaataacaaatcatgcctatgttttgaatgttttgaagtctgtataaaaatccctgaagtacagagaggtttcagattgttaagcacatctttatgccaggagggtggcataccccaactctatggtaacagaagctcctatacccaggacccttttggatctagccctgtgcacttcatcatctgcctgtccatctttatcctttatcgtatcctctataataaactagtaaatgtaagtaagcatttccctgagtttcatgagtaattctagcatattatcaaacttgggaaggggataatggcaaaccccaatttgtagtcaaatcagacagaagtctgggtaactggtgaccacccctactctgccccaccaccgcagcttgtgattgacatatgaagtggaaacagtcttgtgggacttgaacccttaacctgtgggatctgtaatagtaactccaggtagattgtgtcagaactgaattgagtcataaaacacccatctgataccatagaatcagttgatgtatgaaaaaaaccctcacatttagtgccagaagtaaagtgttctgtccaggcatggtatctcacacctggaatcccagcactttgggaggctgaggcaggttgattgcttgaggtcaggagtttgagaccagcctggtaaacatggcgaaaccccagctctactaaaaacaaacaaacaaacaaacaaacaaaacttagctgggggtggtggcatgcacctgtagtcccagcaactcgagaggctgaggcaggagaattgcttgaacctaggagacagaggttgcagtgagccgagattgtgccactgcactccagcctgggcaacagagcaaaactctgtctcaatcaatcaatcaatcaatcaatcaatagaagtgaagtgttctgtgagtagcatagaggaaagaggtgagtttttcttcttcaactaatatgaaaaatttggagatattttgaaaataagaatagggtggggcatagtttgatagcctcgtctccaagtttgccaacgggaagagcattggcttcttgattccctgaggtcccctctctgaaaggagctccatttatgtgaacctgtccacgttaccagtttgtgcttccttttggttatttcaaaaatgggcagggtaactacactccattcccccttttcaaaagatagaatagtattctcaagctacaagaaataagatgatggctcaaagcaacagctcacacagtcattcccatttcattttgggattgttagcttgtgtctggagtttgttttaaaacttcaggcctttgaaggttgggggctggtcctttctgaatgctgttcatcctataaacgatatatttaattcctcactttaaaaactattctaacttcttagtctatttggaaactgagtactgaaatgctgtgtggtcatatggacacatcgttagctgcagtcccagcactcccacactgggttcctttcatagagcaataatgtatgaggcaacctgagaaattatttcaggtatatgtgtgttgtatttagagctttttataagaattcatgtggtctgagggcttgggtgcagtgtaatcagggtggagtcttgtggtgccctggatcttcccttctcatgtgttctgtgttctagcttgcaaacgccatgaggagctgcaggggagattaattagtaattaaaatgtttaatgcttcatattattcaatgcaagtcaaacatgtaggctactgggagatgaaaactacaacatgctgatactgtgtgatgagacatagactgtccctacagactagaaactttgctgtttctggcaaggctgcttgggacttgagataggaactgggtaataaatactctgttgaaaaagaaaataggtgtggatagtggcatcttcctcctcctatattctcttaggaaaaatttaggagcttttcatgatttgctgagaaatagatttgtctatgtattggcattgtctgcttaataataactttctttgagagctatggtaaaagttgaaaccttgtagaaacctctggtatgtgatgttaagtggaatacagtaaaataaaatttgcaaaacaccattttaaaagagaaagggatcttattcttcacaatgcccatgttttacttagaggatctgtgttgttttgaattagcctgtacccgccagaaaacttcaacagttaaataacaatgatttgggggtggaggagtggttagctgactcagagttgcatgccatgacttttatgacaggcaattaatttttagatggtatataattgcatttcaataacatttatacctcatcatttttttagaagatgatgtgtttgtgtcatgcgtaataagcataatcaacgttagctttaaataaattttgttttgagtgccatgaaaatgtaacattttcagagtggaaatttagcctaaaaatctaccttgcattgcacctctacaaagcttttgcccaaaaatattcatttcatttgtcccagtgtaagagctggctctgaatgtatcttagctcctagtggggataggggagggcagctgagcagatagctgctgagtgccatggggtgttcattcagctaaagcatgggagggggttgtcttctgtggttctctagccatggtccttgtggtagcctttaactgtgatttgtttgtttgaccttgatgagtccttggctccgagatgattatgttacattacactgaatcactcaatccaacattggtttgaaaagaaacgaacaaagctgcctgttgagtttctctattttacaacagtatctcagtggaaataattagtcctatgtctatgcagaagcacacatcacatttgcaaaattaaagagtgttcttgttaggactggtttctctgtttctttcttcctctcccactgtttaaatatctattttggtggtagtgttagtatgaaaccccatagttcctttcttttcttttctgatttaaaaagcaaataaacaagaaaacacaagtctagctatgttttttaactcaagatgactagatataaccacagcaaatatgtaggattgttgtgttttaagagaaaaagccgtgtctcagataatttgtagtcattgttttgtccattttgacatctacttctttatatactttatagccaaactagagtatagtgataataaggatgatctctagacagaaggttggaggtggttaataactcatcctacatatcacaatttttcatggtgagtaactggtttgccctccacacaaaatatcacattggaatgtaactgctaaggttcttcacactatggaaaaattaccagtaaagttaaacactgcctttcagtgggtatattaattataaagacaaaactatagtttatgttgcataatttgaacatacatatttccttatgaatctgtaagctggaactattgaaatgaaatatacaaagtgagcacgtgttgctgttgagccagcagttacagttttcatttacaaatgcggacagaaccatttgctcattttggtctctctgctttgggtcctgcactcacactccaatatgcacctaagttatggggtcatgttgaggttccagactgcagaaggggatcgaattatgtttcattgtattgagtcacaaatatttcaatgtaaagtaaaaattttggaagttttacgtaacagaatataccttacaggaacaatagataggtataaaatgacttcggtttgcataacaaagaaataattgtgatgagtaccagactgtgaagtccctgaggcaaggttatcatttgttttctggcacatgagaggcatacaaatttatttttgctgaataaataaatattgtcttcaaatctttacatttccattctagaaatatgctaaaaaagctaatctgtaatagatatagagttagcacatgacaaagttatagctgctttgtgatttttttaaaataaagaacatgtatttgcattaagaaaaataagtgtggccgaagtgaatatttttttataagagcaacctaatggtaaccaatgtttcatccaaaattttcagctatactcttatattgccttatatcacttgatgacaatgtattttgttaagaagatgatgttatcatgaggtataattcaatattatatcaattctgttactgttgagataacataagaaagaaatatcaactctttttctatattctccacagaactgaggaaaacagaggactattatgttattatttcctaaataaagaccaatatgataaattccttatattcagtgagaggaaagaagttgcttaccgaatgtactgatatatgcttccttttttcagaaaacaacaacatcaaccaaaacacctgtataattattacatgaattttttttttttttttgatacggagtttcgctcttgttgcccaggctggagtgcaatggcatgatctcatctcaccgcaaccactgcctcccgggttcaagcaattctcccacctcagcctcctgagtaactgggattacagggatgtgccaccacgcctggctaatttttgtgtttttagtagagacaggttttctccatgttggtcagggtggcctcgaactcccgacctcaggtgatctgcccgcctcggcctcccaaagtgctgggattacaggcgtgagccactgcacccggccatattacaagatttttttttttgcgtttactgccaggaagctctgcttcattaaaagaagcctctaagattcacctcttccttcctttaccaatttatttctgatacttcttgacccagtatttcaaatgtgataaatatatgccaattataaagcatttcaaaaccaattaattgtctaaatctaagtcatgctttttaagtggaaataaactttgtgtccatacacatatatttgcctataaacatcttaaaaatatatctaaacttcggacaattttaaaaagagagtattgaattttaaatggattctttgcttatattgatggtaaacagtggatccattaaagtagcatattctgctggtgtaaataaaatataagatttaaagtgggttaaaaagatataatatttacttgttccttttaagaaacaagttgaagaaacaataaagcttgaagcctgtatagtcagatatatgaacccataaagtaaatcatttgtgaagtgtcttgaactctttctaatttcatcttgatgttgtactgcttatatgaaaatgctgaaaaatgttacttcttagatactgctagaggtgctaagcttcttaccattcaggaatcttcttcttggctctctccgtcacccagccaacacagagttatgttttatttcccaaatggccaacttatgttaacttgatgcttaccaaggcagtccaagccaggaaacaatttttataaacagcatcctggatgacttaatattctatgtaatattaattttagagctttttctcccatcatctagtctagcatagctaaaattatgatgtttaactttgttgatctacagtcacttgtgaatgagatctcccaaccaggaaggaaggaaagataggaaaatcagagtggtctgtttgcagctgtgctagcacatgtttccttgagtgccttctgaaggaagagtggatagagatgtatctttcagggccattgcctttctagcattattgatcgtatcacatgggcaaaagaaaaagaaacaatagattttatgacaaaagttatgtaaaaaggggctgaaatcagtattttgaaagttgtgactaattaacagtggctttctgagaagtgagatgggattcaagacagtggccattgtgtatgtatttctaagagccatctggatgctcctttttatttgtgtttttggcttattcactcatttattcctttattcactgattactaattgaatacaaagtctctgtcgatttgttcaaagatattaaagaagccctaaatctatggaaagacatcttctgttgattagttgcaagatgtaatattgttaagtgggatactccccaatttgatatatagatgcaaagcaatccctatcagaatctaagctggcttctttgtaagaattgacaaacatccttaaattcacggatgttcaagagacccagaattgccaaaatcatcttgaaaaagatgaggaagtttccgacacacacttcctagtttcaaaactttctttcaaatgacagcaatcaagcagtgtgatattggcctaagatatacataaagatcaatggagtagaattgagagtccagaaataaaccattatgtttatggacaattgattttcaacagggtgttgtgacgttcaaacagggaaaaaatagttttctcaacaaatgatgctggaaccaccagatatctacaaagagtaaagctggactccctacctcatagtgtaagacacaaatgtaaaggataaaactatacaacttgtagaagaaaatatagaagtgaggttcatgaaattgggttagtcagtggtttcttaaacatgacatcaaagcacaaacaactgaagaaaaaatagatgagttggacttcctcagaattaaccaaatttgtgcttcaaatgacaccatcaagaaagtgaacaaacaatccgtggaatttgcaaatcatgtatctgttaaggggcttatatctggaatatattaagattcttacaactcattaagaaaaagacagcccaattaagtaagaaacaaagtatctgaatagacatttccctaaggatatacaagtggataatatgcctaggaaaagatgctggacatatttattgatcaaggaaatgcaagtcaaaccacaacgagatatcacttcacgctcactaaggtggctataataaaaaaagacaacatgtgttggcaatgtggtagagaaattgaaaacatcatacgttgctggtggattgtaaaatggcatagcccttttggaagcaatctgtcaattcttcaaaattggtcatagttaccacatgaccaagcaattatatttctatttatgtatccaagggaattaaaatatatgaccacacaaagacctgtatagagatgttcatagcaacatgattcataacagcctaaaagtgggaacaacctaaatatctatcagttggtgaatggataaacaaaatgtggtgtatccatacaattgaatattactcagccataaaaaggaacgaagctctgcaacatgctacgatatggatgaacctgggaaacattatgctatacgaaagaaaccagacaaaagcgaccacagtttatgattccatttatatgaatgggcaaatccagagacccagaaagatgagtggttgccagtggccagggggaggggacaatacagagtggctactaatgggtacaggatttcttttggaaaggtgattaaagtattctggaatttgctgcacaattctttgaatatactaagaatcactaaattgtgcatttttaaagggcatattttatggtatgtgaatcatgtcttaactaaaaaatttgttttaaaaggctctgtattgaataatttgcctagaatacacacatggcattgggagtggcctccactctgaataagcttacaatctcttggggaaaaatgcaatctaacagttatagtacttaagcgtacatggtaagaaagaagcacatggagggtgcttattgaatgggaaaaggaagaaatctacctggatgatcacagaaggtgtttggtggatagggagtatttgcaagaagaatccgactctcgtgtagcttgagaaagcagaatgaaaacccgtatctaggaactgaggaaggcagtcagcaatgtaaggtcaatatttttctaaaagtaatggcagctgaagtacaacttaggctgcctgagaagagagcaagttttccttcattggagcatttgaaatgacactctggtatttacaaggtgaattattcacactctttaaatctcagtgttctgagttgataacacatttcagagttgacatgaggaccacaaggaataataagtgtgtgtttaatgtgaaaatacaatatcttgtacataataaacagttattactgttggtctcaccaccaacatcattatcaaatgaatcttggcagtaattctgggaaaggaatttaggcaacagatgggagctcatttgaatgatgctaggatttcatggtactcccattgttggttacagaactccaagaactctcattcttggagttttctgtttcctcatataaaacttggaaggaagaacagaagaccttcattctgttccaggcccttaaattgattatttctgtgcctaaagcaaactgctcagcctcaatcatgactttgcacaatttgctgtgatacctggtatagatgtttcatttgttaaagttgttactgacaagaacctccaatgaccttggaacatgacctggcccctgtgggtatcagtagaattttggtgaacactgagaagtctctgagtttctttcaatctgggcttctttcagttggtttgcaaactggacttgtggaattagatgatctctcatgcccattctatctttgagttggtattatttttgccccgtattaaagaaaaactatattgatatttctttctttgcttttgttatttcactatagaaaattttgttttaacattcggttggagttgatgatatacaacccaattatatggatttgttatatgcaaacataaggaagtattcacaaatttaaagaccaagttcatgttgttcaagataatgtgaacccaaattcattgtgctcaggataatttggaactaatttcatagagtttaagatatattatagtaattaaaatcatggattttgggagcacactcccctgactctaaatatgtggcctgggatgtcacttaaacattttgtgcctcagttcttttatctctataatgaagaccattatagtatctatctcccaggattgtaatgaggactaaatgagtttccatgtataaagcacttgaaacagtgtttgacatatttagcaccatatgcattagaagatcttattgttagctgcgtgcttattcttaaattgtctgagttactgcttttatataagaagattgacttataaatttggcccatgatgtcccatccaactctctgaaatagattatctacctcttttcagctgggcatcttacttatgatatctgaggacatctctctgttcttgtgctttgcccagccccctttggtttctaatgcatggagccaaaagctacagctagagccataatggtcttgtcctaccatctgaaagacatgttgattgctagaatgtttctgtggttaacaagataattcctctgataagtgaacaaccttcacttaaatgcaaaaattatgactcatagattattaatttgtcacaatttactaaccctatcattggcctattgatgtaagttattcttgtcacgcttcacctacccagacgctaaagcatgtaaagcaatagttaagtttattgttcatctgattgacctggagggcttgttaaatgccattactgggctctaccttatgttttcaattcagtagggctggagtgaggctcaataatttgtatttcaagtgttgctctggtgtggaccacactttgtgaaccctttaaagcttcttgtcagtcacatgtttgtaagcagcactgtcttcctctgttctcttatttctatagctgcacacccttaaggcttgccctagtgtcaaaagtggatgctagttttatgtcttttttctagaggaggaaaaaccataacctagagaagtatctttccctgcatacatagtacattgacagaatctggaagatgccctttaaaaaaaaaaaaagtaaagatttgtacctgccattctgtctttcagaattgtaaatttatgtttattgatattaaatatgcctgtaatcccagcactttgggaagctgggaagggcggatcacctgaggtcaggagtccaagaccagactggccaacatgttgaaattctctttctaataaaaatacaaaaattagctgtgcatggtggcgggcacctgtaatcccagctacttaggaggctgaggcaggagaattgcttgaactcaggaggtggatgttgcagtgagccgagattgcacccctgcactctagcctaggtgacaagagcgaaactccatcacacacacaaaaaaacaaaaacaaaacaaataaaaattgtatagatttatggtgtagaacatgatgtttgatatatgtatacattgtgaaatggctaaatcaaactaataaaaatttgcattacctcccatatttattttttgtggtgagaaaacttaaaatctcccaacaaatttataatacacttgcatctgcaattcttgaaagaactattaggtttggaaaactagaattccgaattcagttctgccatacctagaaacgtgaatgtcaactgtttgatctctctgaacctcattttctttgtccatgatattaatacctcctctgcttatcatatatgatattgtgagaagtaaatgacacattgtacattaaagtgctttgtgaactataaagcgctatacaaagattattttgcattctcatcccagttgtcacacacaatatcttgttaaacatcatctgttttatgataggcacatccttctctctctcagctagggtaaatattgacttttctaactgttttcaggaaggaaatagtgcactgtgaactacttgccttgtgcacagaatccttttatttccctcctgtgattattttttcttttctagtctcttgctttttaaagtaaacaattaagaagcttgtcatttagccatttatgcatctaaacacttttgtatatgtgagatgtggtcacaaacataaacatatattatgaatttttctcataacatccttttatgcaagacatcctacacaccacatgtattaagaatgaagtgagttgctgttttgcctgaaatgcattattttttgtttttgtttttgacgtttgacttggaaaagggagttgagttgagccaagagcaatgggtcctcttcccagttgtgtaaccagcaggttgtgttaggtaagtcagctcctttcttgaagcctcaggtacatttgtacatagatcgaaatctagtcttttctcatgccttccactctcaatgtctgtgttctcagtgttaaaaggaagtttcagaagatgaccttcaccttgatgaagaagtccgaacagagtatccccatttatctatctctattctgctaagatacttttcttttcatgcctcaggtctgactgctctttgcaattcagcctgttgcagtgaagctctgacatgtctttcctttaggatgtgactggtcttcactaggactctcaatttcttagggcttacgtttctgttagtatgatcggaaatagaagaggccatgtcctgcctttaatcccctgggatagagatgttggtggattgggggattgaggggtggagaggcttttatatttttagtgagtctttccctttagtgattttcagagcatctccctattagtgcacagtaagaagtatttgttctttttgccatgcaacaaattgcttaaaaaccaagcagctgaaaacgcgtattttctctttgttcttggtgagacaggaatctgtatatagcttagctggaccaccaacttcttggtctttcacaaggctgcaatcaaggttttgactcagtctgcacttgtatctgaaggttcaacgggagaacgatcagcttccttgcttaggtggtttttaatttttttatatggttcgatttcttccaggcagttgcataaagtgctttagtttatatctggttgttggctggagtctatcctcagttatttgtcatgggagcctctccatgtggcatctcactacatcaaagcatggaagctgagcaagcaataggtagagtttgattacaagatggaagccataatcatttgaaacctaaatgtggaggggacagcccatcacacttaccatagtctgtttgtttgaagtaagtgactaggattagcccacactaagaaagatggcattgtaaaagaatgtgaagcccaggaattaagaatactagggggaatcttataaacctgccgatcacaaaagagagtgaggttagacttactgtccacagggatttagtgcaaatgtaagtttatttgtagaatctgtcaagtcagaaagcagaggaggcatgtggggtatcatgagaagaatagaatctggaaggagtaacaggtaatgaaaggtactaacagatgtaggaagaactccagaatttaagaaagttatacctgaatgtggtttaggaggtcttttgatctaaccacctccatttctcaaggagtccaaagcatatagagggccttactcaggccagaagttgtggctgaacaatgagttggaacaaagtccacaaactcctgacttagtacagattttcagcttgatgtaatgaatatagctctggatttggagtgaaaagatacacatgttcaacttttgatttgcctctgagtggctgtgtcaccctgagcaagtgataagtaaaggaagcttgatatatggttacccagtttataacatgaagctatcattatcatgtatattcatttatgtctgatgaacatattaacttttctttatgaaaattctttgtaagctgacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttgatgggactgtaaactagttcaaccattgtggaagtcagtgtggcgattcctcagggatctagaactagaaataccatttgacccagccatcccattactgggtatatacccaaatgactataaatcatgctgctatatagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgtaccagcatggcacatgtatacatatgtaactaacctgcacaatgtgcacatgtaccctaaaacttaaagtataattaaaaaaaaaaacattaaaaaaaaaaaagaaaattctttgtaagctataaaagcctttagaaaaaaaagtaagctttgtttaaattattaatgtgtaggttgaggcaaaacaagcactcccttttgacagaagggataagtactggttcatataaatacaattttatctccatctgtatctgtatcagccatttatttctgcttgataaattatcccaaagcttagtaatgtctaccttactcacatatctgcaattttgatagtactccatgaaaatagcttaactctgttctgtgaaatgagcccatgtgcctcgatttgggtgcagaggattcactttcaagatgctttactcatggctggcagtttggtgttagaagtgcgactagagttgtgtgtcaggaccttagtttctcttaatgtgagttcctctacaggctcctagggctttcttacagcatggtggatgagttccaaggccaagtatcacaagagagaaaggtagaaatgccagcattgttatgacttagttttagaacttacacagagtgtcctttctactatacactgttgattgaggtccacctgggctcaaagacagggggttagtctccacctttgttgttggggttgtagtaaggctccagacaagtttgtgggcaagagacactgtcgtgaccatctgtgtacagtacagcctgccattatattgtattttattgcattgtatcacattttactacatcatattttaatgttttatgttgtatttgtttccatttgtggaggacttaatatctgccagacatgtatattctgtattaaagttgacttaattctcacaacaaccctgtgatgacgtggtccttctcattttcaccaacgagaaaaccaagttataaagatggtaagtaacttgcctaaggtcaaaccagctcataagtggcagagttcaggttcaaaaccaggcaatctagttctggatcccatacttttcaccactctgccagattatttctatgttgttatctgtttttatgtcttaaataatatttatgccatgctgttactaatcaccatttccatccctgtctctgtatctcagttagagaaagtgggtagataaggactggatatcagactggatagggaggaaacacatgcaggagtatcattacctttgagagaggtgggtctgagcttgtccctaagtgctcctggaccagttctaggagatctcaagaaaagaagcaacgtaacatttcactagttccatacagagtttatattggccttaatgattttgcctttaatttaataagacatatgggagtctacggaatctagggaaggcagctgagtaagtaacgatatttttaaaaaaattggaaataggggccaatatttgaagactaatgaaattcaggggcatctattctcgttccacaaaagtttagctatctggtattccatctggtgatctattcaatcaattaactcttccatattgggatgtttgtcagagtccagcttacaaattgaggaaatccacagtcacttgtgagctagtttgtatcagttattaaaatttacttatttattgtaaacttcatcaaaccaacaattgttaagcccctactgaatgcaggacactgcagattacaatcaaggggaacacagtttataccctttctcacaccacaagggacttctactgtaagaaaaagatgtgtaaagccataacgacaagaatatgtgataaatatgataatgaatctatgaacaaggctgtatggatgcctagcggaaggtgctccaatattctcctggagaggtcagagggggcttttcagagcatttaagcatatatattacaggaactggaaatgttcagcccagttggagcttagaaaatgtagggcaagtgataagcctggaaaggaaggcacgtagatatgtttctgcaaatgcattccctccttctgtcttcctgtctgccttatatacacaatgatgactcagtaccaggaatctcaggaaacaaacaacacacatgcacaatataaattcctctacaatccctctatttatcctcagtgcaaaacctcaattaactaatagctcatctgaaaactgtcagggctagaaagtcccataacccctcaggataaaatcacaccaaccgtaagttacttaggctctccaaggtcagcctccttttatctagcttccctctttttataaagctgcgggcctgtctctaacaggatcatgtggtaacattcatgatttgcaagagctttactgctacaaagcacatttgcaatacactgtctcttttttttacttggcatttgcgatttaattgttaacccacctgatatatagtgaaattgtggcccagaaatgtgaaatgactgctcttaatttttacaaaaataaaacaaaataatctaatccttaaagtcgtgtcttcttttgcaaaatcctagtacatttttagtacatcagttgtgttccgtagctggggactctgttcaagtgaaccttaataagaagtgtgatgtataaaatggcagagtttgaggtgttctgactgaaataaggagtctgggctctggagcgtggctgagcatcttcttgctcactccagaaacggccctgaggcttcttcatgtctagtgttgtgaaaaccactcaactgcagtgtgcttattacctatgtctaaccttggagcactcagaaaagacctaatgcttattttactgtctgaagtgggaagacagccattgttaacgtgggatctcccctagcattctccttctgatcctagcgtaaattcctgtggatcaaagcccagcccctgagactgtaacagagagaataaaagaacaagaagatggtgaaggcgatatggtgtggtagatggagcatgtgaattctcctagttctgcttctaactcactttttgatttttagcaggcaagctatttcacttctcttgtgccacggtttccattcataaactagggaactggacttcttgtctcctcaccgtctgattaaaaacattccgtggtgattccttttcttggtaagacacatagcttagtccacctcaggtcccaaaaggaggatcaaccttagtgttttacgctctctaatatgacctcttgcggtcgatgttttagaggtatctatcatattgcatggattgagggagtttgacctgttgagctgggcgagttatcaccatgcagcacttcaggtgcttactctctttttatccatgcattggttcattggattcaaacatttcattagacttcctgccttcttttggggggatattttgaatttggggataataagtttagaaatctttgggatgaagaagaggaaagagaaggcagaaaaggagggccatgactataacatttatcagcaactgtgcctcttccagaagaatcaggatggactggatttgaatataaaaagtaggaagagaggcaaggcagaaactgggagaggccgcagatggtagtgattgcagatcctttataaaatgctgcatgtttcaactttcctctgcccaacactatcaagtgagatggatccttggaggtctttgggtccagtcctcaaggaatcaaaattacatctaggtagtaggaataggttctagtgttctataccacgtgggataactatagttagcaataatgtgtgatgtagtttcaaataactagaaggcagatagttaatgttttcaacacaaaggaaatgataaatatttgagatgatgaatgtgctaattaccctgatttgatcaatatacattatatgtatggaatttcactgtgtaccacatgaataggtataattatttttaatttaaaaaaagcagtttctcatgtaagctggatgttgctggatagtttaacagaagtctgtatagccttgttgtattttaatcattttatctttttttttggcctggaaaatattaagttagaatggctgtgctggaatacatcatccccacctgtatattaaagctctgtgttatttaaaaatttgtctaagaaacctataaattgatggagcctcactgtggtggttctacttctctattttgtgtgtttgtttgtttgtttgttttttggtctggtgccattgagccactgtctataggaataaaaggatgttagcatgactgatagttcagtgacctgtaagtagcgattttaaagaaaaattttataggtctttgttagttccaaatctgactacctgttaattctgctttatagtcatgctctgactttaccatgaaggctgtagcattgtgctttatctccttgtctccagagtacaagatcttggtaagagaaaagagtgataaacccaaaaaatacaaactcagtttacctgagactgagtagcacagaggtctccactaccactcatttccctcttcacatggcaatggaacttttcattaaaaataaattgtatttactcatgtatattcttatgctaaactgataccctttttcacaatggataaaacaacaataaatgtttgcagcctcgcacatcaattctcgaaccctgttctgcaatttctggcaataaaaggccttgcttagtgtgcattaaaatcttggttctaaagtcagtgtctactttcatagaaagtatagtttgtgacctctgttactatattttcaccagcaatttgcacacttgtcatgaggctttctctttgtatgggtcttagataatgcagtatcttgacatggtacttctatggtaagacaaagaggatgctgtttttgtattaatgcgaccaaaatatttcaaagccaatcttacagaatccccctattggacatcccccataaattttttaatggaacaaaacccctctgtgagaaataacaatttgtatacgatttcaaaggcataattcaaactatagctgaataagaaaaataatacaggatctaacaaggcaacacttaatgaaaaatcaagggccaggtgcagtggctcgtgcctgtaatcccagcactttgggaggccgaggcgggtggatcacaaggtcaggagatcgagaccatcctggctaacatggtgaaaccccgtctctactaaaaatacaaaaatttagttgggtgtggtggcatgtacctgtagtcacagctgctggggaggctgaggcaggagaatcgcttgaacctgagaggcggaggttgcggtgagccgagatcacgccactgcactccagcctgggtgacagagcaagactccatctcaaaaaaaaaaaaaaaaaaaaaaatcgaacaagtctttggatattaaccatagtgatcatgccctaagtatgtatttactttaggtaaatcttagtaaagcaggaattagctggttagctgcacttactggctttaggttgctggttagttaactggaaaggctgttagtttagaggtgatacgacacatagattatggtttaaaaaggttgcagcccttatttctagaatgtattcaatggtatctgtgctgcctaacccatagggttatgttttaaacgatatgatataaatgtgttatactacattttgaaacgttagttggtgtcactatatcttttggcaaagagtctccttatgaacttcagggagcttgtttctacagaaggagtttggttcataagatgttttccataagaattatataaatttttatataaaaaagtagtgcccaaactattaactcatggagagagatcaaattctggtctttttaaaattaagctctattagtccattttcacaccgctgataaggacataccagagactgggaagaaaaggatattttattggacttacagttccacatggctggggaggactcagagtcatggcgggaggcgaaaggcacttcttacatggcagtggtgagagaaaatgaggacgatgcaaaagcagaaacccctgataaaaccatcagatctcataagacttattgactaccacgagaacagtatgggggaaactgcccccatgattcaaattatctcccactgggtctctccctcaacatgtgggaattatggggtaaaagtcaagatgagatttgggtggggacagagccaagccatatcacaagcttagtgagaaacctaattgcttatatactatctattattttcaaattcattttaatattttggattcttatccaactaagagatatagggaacaaatgctgtaataatcacccatctgtaaaatatggaccttctcatagggaacttacgttttagtagggaaaatataacatatacactaatagagattacagagtaggaggtcctttacagagtaaaaggagaatggagatgtacagtttggtgtgtactgtgggttgaggaagattgtgtgttgcggaagatggtgacagctactgacgagtcactttctgccatagagatcaattttccattggtcaattgtggacattcactaatgtaggttggagtgatgcttcaggagcagacatggcataaactatttcaggaaaccataaacagcttagctttatcttcagagtagggtatgaaaagggagagaccaatggtaaaaatccaaattagaatgatgtgatgccatcttggaggcccttgtaagtcaagcaaaggagtttgtgcaaaaagtttgaacattaacaacaacaaacaaacaaacaaacagaaaacagaaaaaaatattgcattgtatctgtgggaccttcccatccttaggttttaattttcccctctgtcaaatgagagattttacttgataatctccaaaattgtgaccagctctaatgttttacaattcccagaattattacatcttaacttctccctgagaattatttactgatcacatagtagaactgaagtgatttctacagtagctctatagctagcaacccagcattggataaactcaaggaatgaaaaatctagtgtgtgctggggttgggagggtagtcatatattactgatttaactgtcatctggaaaactttatgggaactaagtagaggatgccataaggaccattaactgctcctaagatatgatgagcaaagactggagaataggagtgggcctagtctacagattagttttctattattgctgtaacaagataccacgaaattggtgtcttaaaacatcacaaatttcttatcttacagtgctgtaggtcagaattctagtccaggactcactgggttaagatgaaggtgtcagcagagcttcgttcctttctggaggctctagtcatagtcattacctttcccagcttctagaggctgcccatatttcttggctctcggactctgtctttctagtgacattgcatttctctgaccactctttcatagtcatgtctctctgaccacagctgggaaagattctttgcttttaagaactcatgtgattagatgaggctcacctggataattcaggctaatctccctgtctcaaaatctttaaccttaatcacatctgcaaagtctttgtaatcaacatgttcacaagttcgaggaattagagtgtgtacattcttggcggggtggggagggctgttcttatgcttatcacagtctgtttttaggaaagtagataagttcacaacgttaatgcatggaggctgagattgtgagaagaaatgaagcagccagtcataaagtgtgtttcgtgctaatgtaaagagttctgaagttattctgatggccatagagagctattcaattctacctagtagaggaatatttaatctataatgatgtcaaacaattgaagtgggtagcttgtggtacccaaccatccttcgcattttaaacatgggaaaatgaagactattttttgactcagtatacttgggacacatattagtgccatgtacctatcattattttcccatatcatgtgtttttctaccctttcctcctacttgtttttcctctagcctgtgagaatgccattcatgatttataatgttctgggtaaaaagttcaggtagacctacattaagcaaaggtaactcagatttggaagactgaagcttggtagcagggagggggttacttaggacagagagatgccttggaatggccgcacattgagctcgtgcatgttggagctggcattacccatgtgaggaggtggatgacctgtctatatattcaacactagcttttctttgagatccccacaaaacagatctaggaaatctaatgaaagaattatccctgctacaccgtgtttttaacataggaacggacagttaacttgtgtgtttgttcaagaatgattcataatgcagaagatgaactggtgaatagaagaagcctagtaaattggaagattctcttgatgaaacagagaaattgagatttattattcagtcacttccaattacactgttgtgttgcagaggaaagcagctaaacaggatgttggctggtaacaccagcaaagtggaatcaacctcaaaggagatggtgtcagagtggtgttcaatgcctgagcttctaccgagtgagtcacttgtgtgaaaatgtcttgacacagatagaattgaggtgcccacactatatctgatcacagaaatgttaatgcagaatagcaaactggctttcatcttcatgggattgcaggctgggggataaaagggggtgcatttttaaaggtcatctctattgcttatgagaaaacaatgtatcacatcccatgcatctgtgagactgtatatcaagaatcagaaataaatacatttgaaggaaaactgcaagttgtttctcacgtgtgaatttgatgcttttttttttaaaaaagaaagattttctggaagaatttagcctcctgaaaacttgtttcttctgtgttgtagttgataatatctaccacccactgtggtgcatggagaggaaaaaccttctatcccctactttatgtgttattgatgtgacataatttttcagaatagccacacaatttcaaatgtgacttcttttctaacttgcaaatagagctgacaacagcaagatatgtcctgtaaacaaaccccaaaagaatatttttgaacaagttgtagttcaatttataccagattatggaacactagagatttacagtgatgcgttcttttatttagatggaataggagaacccatagagttgaagctgtttgtctgaaggtttgcagcagatcagtggctctgccaagcctgcaactatcatcacctgactccaagttactctctttctagtccagcacagctgcctcccaagtttaatagtctatgactcacaatccaaatctatggtgacatataatattttactttgattccaaatcaacaagccagttttagaagtgcttacactgctgcattactttttatactattgggttcttcaagttgagtcttatttctagaactccaataagaataaccagaggagtcatttattttgttattatgacatatttattgaagacttattgggtggcaagctgtcttatagagggtgagggtacagctatgcataaaacaatgtgtattttcttaaaagagtttatattactgtgggagaggcatagtaaacatgttaggttctatagagaaaaataaagcaagataaaagtgaaagagtgctttgggttgagtggagccatagttgctattctgcacaaagtggttaagaaaagccttaagaggaagagatatttgaggagagatctcaaggaggtgaggaagtgagctctgcagatatttgggataagcatgttatagacagagggaagcacaagcgtgaaaagtctgagaagatcatggctggcatctggcatttttaagaaagagtgaagtagccaagggtgcctgaagccaagtgatcccaaggaagtgaggaaaaataaggttagggaggtagcaggggccctcatgatcacatagaacctcataggacctcttattcttagtttaagtgagatggagagcatttggagtcacattatcaggcttatgttaaggatcactcaggcagctttctgtaggctatgtggtaatccaaaccagaagtgacaacacaaactagaaattacaatcaaactcaaaatgatagttggttggacttggtaggtatagttggtgttggggaggggataagaagtagtgggattctggatatatttccattgcagcctcaacaactattgtgagcagatcagatgtggaatataagagtaatagaagagtcaagaatggctcctaggtttttaccctgagcaaggagaagaatggaattgctatttagtgagatttctggagacaggaagattaattttgcttctgtttttgttgtttagaagagaaaggagaaaggatgatcagccatttggctttgaatatgttatatttgagctatcttttagagattcgagtattggttgagtagacagctgtatatttgagtctggggtacaagggcaggctcttgacttgatataggtgtaggtgtcagcagatatacatttagagctttgagcctggatcatatcacctaaggtaatggaggaagccatgaatattttgatgtcatggagaaaatagaggaactattaaagaatgcttgggacaagaaacactgaggtgggaggaaatgcaaaggacagtggtgtccagaaatgaagtgaaaaatgtgcttcaagagtgagtgtgtgatcaaggtatccacaccattggatcaaatgccatgaggattaaaagttggaccaatggatctagatcttagttgaggattgccttgataagaacagttatcgttactcttctgagctatttgctcacacttgccttactttttgtcaaagtcgaggcccctctaaataatggttaaatacaagggctctggagttgccctgtctgaggtcaaatcctagtttcatatttactagttgtttgagcttggaaagtttaattaacccttctgtgtgcttcagttttttttgtttgtttgttttacttttgaaaggaaagaaatgatatgttttgtctcataggtttattgggaagattgcaaaaattaaacatataccatagtgtctgtcatatagtaaattaccaataattgttagctctagtgattaagaataaaatgatcactaacatctataaaattacacctgacttatatttccttcttaccctgaaaatcatacaaactctttctagagttgtgcttgagtcggttgcactattttctgcctttttgtttttttggtttgattttttttcagtttttttaatcattacatgaattaacctcattatgatctaattacttccacatagttctccagattgtgaatgctctgcgaaaccatagcttgttcatatcttagaaccttatgcaagggttggcacttttggcacttcaggcttgaaatccaggtttctgaatgccctggtgattgattgacatttcaccttcaaggtcattccaatacttaatgtagaagtgatagggtaaactcttaattactggaattacctataaataaataaatgacttaaatttcctaaaataatagttaatgtcttgttaatctgagttccttttctctgtaaattatttcacaggcatgaccctctgtaattttctcaccttttaaagtgatcctgaggtatatcatgcaggatagttgacctttgggattggtgttcttgccctacggtagatagctttgtgaagtcttccctccctttctatttctgggacctagaacttaaaatggcctcttatgttgaattcttctcattcatatttctataaactcaaataatggtgcctttaacatcttcagacgtgccttcatgcgttacaaaaaaaaagatggtttgatatttgtttcctttatcttctttgaaatgcacgaataaaggtaactatttacaaacctgaaataaagcaaaactgtgtttattagattcttgaaaagcggttttgcaaatctaaatcaagcaccgggctaggaggactacattaagcaacaacaccagcaatgagtggtatattttaggaactgtgtccatggacagaatgagatatcatgagcaaatatctgttgcaattcctgtgccaattcataaatggcaacagctgattcttgccttgctcacatagttgtagtctggatggtaaaaggtaatattttcaactccttggtttactttgtcaggagtaataagtttctaataaagaagctatatttatacttctcacctagcctctctctctctgtgtagtccatgccacaaacactgtacattggctaacatatttgtctgagtaagggtgagagacaagaagaacatgagggaaactagaggttgtacaagtaaattctattgttgctaatgccataatttattccagatattatctagtcccagaatgtgcatatgaatgttctggcgctctcttttctgtacttgtaataaacaagacatcagaagacacaagagttgagagggcccagtttcagtacctcttgttataaatcatcaagcaggtaaagagaagatccctgatgttatcagtacttttgagcagaaagcatggatgttatcagtatttttgaccagaaagagaatggatgttatcagtatttttgagcagaaagcatgcgtgtttgtacaccttcttgtttactccacataggcactccgacaaaatagtatctctacctcaaccagtaagttccttatctgtctctgagttcttttgtccttctacagaaacaagagtgtttctcttaaactaactccctcattctggataaactgatataataaaaacaccagaacgaaaacgcatgtattcataccatactttcccacctcactgtgctgtactctgtagagttcatatcctctcttcttttacacctcttcagtgagctctataattttctagctcttggttgtttctctgttcgtatcatctacctgcaatgccattcatcacttcctacctgccactctcacccttcattttttacctgaggagctgcctcctaccccgtatgagttgctgtacacgtttcttttgacacttgtcacatatataccctgttatggttgtggtcagctgtgtagattcaacttccttgacaaggctggaaaattgtgaattgtaggaagtgtgtttgagtgtgcttccgtttctgggattcccactgtgtctaaccctgtggtatctggcatgggttaggcaatcaacaaatgtttgctgaacaaatgaaaacaaatgggtaaaaaactcaaacctttaatattcattttttaagaaaaatagtaaatagcattaccatgactgacagaccacagttaatttgccatttctacctcccacttgctgttctcaaaaaaagtggaataaaaccacagatttgccaatggtcaaaagatgaatctaaagggcaatgatgttacaacttattattaacttatttcatttctgcctaccaagaaatgtgtatgactcagcttttgtccaagcagcactgcttttgttctattttgaattcgtggtggaaaggatgagtttttgataaagatcttgacttttttgtatcaaatagaggataggacggtattatagagattaggtaatgaaatgcatgggttctaatgcctgcactgcctctacccctgtctagctatatgaccttgaacatttccttgcctctgtctaggccttagtctccccagatgtaacatgagggagctgatgtagttaattgtcagtggctcttgcagccaagcatcctagactggaattctaggtgggattcagagtaattccttgtgatgacatatgactcaaccttcagctgttaactggctcaccatcgtgacaacaggcaccagattattcacacatttttgaatatttgaattgcataaggctgctcaatgatggtgaaaattgggtcctaaatgttctatcagatatatatgtagtgtaacctgttcaggatctcgtgtgagtgtaaaatgatgtgtgaaatatgcaccaagcaagaaacactttgcacattatgataaggcagtaatacaatttgatttttatgagttaaagatgatggtactataagagctctagttatatgaagcctggaactatagtatgtcttagtctttatagaaaggaaaacaattaaaaatgttgtttctcactcttgtatttccgtgttcgtagagtcaatagtttcactcaaggcaggaagacaagacctgatgttagcccctctgtccgagtcattcaacacctcaccccctccagttatatttatatttatacatattttattattcttttactatgccagtaccacaatgggaaatatgtttacttttaaaaagctacccagaatcctccaatttctcgtccgagaatataaaaacacttacctcacataaactcacttaagaaaatgtgaatgtaacactgttcccccaaaccgctttcttctttgaatgccagcttttcacatagcagctttcctgacctcctacttccaggacctcagacccctctgtctgtgggctggcacttggaatgtggctgtccacttggcaaagtggaaagagcttctgttctcactgtggcatctggggcctcaattctggttccaccactcagcagctctttgaatgctaggaggatatttcacttctccagatcctaatctcttcactggtaagagaggaataattatatttactttttgacatggctagaataattacagagaatgcatagagagcatctaacacagagactgacaggtagtaggtgcaggtttacttccccttctgtagatggtccagggtctctgacgcatctctgcttcttcactggtttatctctgtgctatgctaccaccaaggagtcgtctatgcacagataaagagggaaaatggtctgcagtcatcacttgggattctatgcaattcagtgaggtctcaaatcactactcaacaaccattcagcagcaatgcgatgtcaatgtccttatctgtttctcatgctactactgtttcatatctcctacgtaatgtagtttaggagaaagagtcatgaagtgggttccagtagtcctggcttccagttccgattctcagataaacctactctttgacccatgccaagtcatatccttccacatatttaaatgacaatcctataccttagttctctccagagatacatagattgttcaggctgatgcacttatgctttgatttactggatattcaagtaatgaagcctatctttttctatgttttcttctttttctggaattcaaagtctatgtgttcttgccattgcccctgaagtagtaacatttctgagcctggctgatctagaacctctacaaaggctgtccttccttcttgataataagtcagtgcatttacctaatatctgggagtttacaaagtatcttcatttattcattagtattgaagtctcagtagtaactcctgaagatggggattcttacccacattttagagatgaggaaacaggatgggagatgaaaggatgttctcaggagtcccacagtaggtgttagttacatagcttggatttcaagcagcatccttctcccaatcccaggtcctggcctgaatgtaaatgtgatttccaatccaagtttgaatgtctgtgcactcattagtccctagacaaatctggtttttcttgcatgagaatgaaattgaactttcaaacattttcttaagcctgtaggatctacattctcttcattttctaatatacttgtaactttaaattccttattaagcccgaaggatatttcacttcattgtagaaatttaccattgccattggcttctgcaaaacttggcagtgaactttttttaaaaaacgtggccattgagagtggtccccttgatacttgagtgtgtattgtcccaaacattgcctcaataggtagttactgtagaagaaaatgccgtagttttaatggcagccttgaattttctcctctctcctttaatggaaatccattctatacttattaatccactgagcttgtcagtacacatccctgtcatttctcaaaaatgtaaggaaacagcatgtatagaacaagcactggactaaaagtcggaggagcagattttagaccttccttttctaccaattatttggaatgtggcaaatcgctttacttctgtgaacatctagttcatgttttataaagcattgaagtagatcatttctaaggttcttttccaccctatttggtaaattgtctagcatgttctacttcccacttgattaaattactctgcttcattttttttaattttgcaaggaaatactcattacatataaggataggagacttcacttatttccacagatatttattgagcactgactatgtgaaacataattaaagtgtaatgggcatttggaggagggagacattccagaagaggaaactgttatgagtaaagataaagcagtttgaaagtgcactttctaatgagaacctggagattcatggagaatttgcagcgcatggacttgtgagcagttggcgttaaggttgagaagagggcagtgtggactgaatgtggaggcttctacagtgtgtactatttataatcacgcacacacagacacacacagacaaacacacacatacaaacacacacactcatcccttttcagggtctcctgacgacctatactgcctgttgctctttttacctcagccagcaaagagataaattgtcaagattaagtagatctgaacatttgagaaggagttccataaaaaagacaatgaaaatcaagtgtaccagcatctttgattcatacaaggatcattttcagtttaacagtttatctccgttgttggttgtgacttcctgcaggacgtgacttttgatatattcattcttgaacttccaccaagcacagtttcaccatagttgatgctcagtaatagatccttatttgttggactgaattgctgcctactgaagtcaatcctagaaaggagagaagatagcttttttacatagaataactaggaggggttttcttcttttgaatgagctaccaataacaaaataaaactgcaatgaaagaattgacagcctggatctgtaatctgcctgacctgataattgtaaaaactgattactgtgtcagcctgccagatggatcttctccttgaaatgtaacgtgcggcacttctgaatgtgattcaagtgcaagcttccttttctctccccttcatgtttgttagtttgggaaagaagcagttttatttgaactgaacccactcattttaagtgtgtttaatgacagcagtatgtgacagataaaataaaatcctacggcctcgtttgatgtttagtttcagaccttagtgaaaggaaataggataaaacaatgttgttcaaagggagaagttgaaaacaaatgatttgttattacacacttagccatatctctccagggaaatttgggaagtcaaataatataaacggtaataatagtagtacttgagatttgtggagtgcctagcagtttgtcgagtggctttatgttcattatcacatcaagtctaggaggttgcctggccagaaatcatcatcccactattacacacacggttgagtgagttacgctaaatactacttctaaaatggtagaactgagcctcactcttggtcctgttgattttgaatggaatagttcctctaattctctgtgctggctcaccaaccaaacatgtgtgcagtacattggaccacgttgtggaaccagcctgttccttaactttactgaagcatatatatgctggcaatatacaaataaattatcacaacggatttcagcagtgagaagtatatgaagttgaacataacagccctccctcagtacccattcattttctcccctgccaaccccaactctttttccaaagagtaatcaccattgtctttttgttgtgcatctttccaagcatgtatctatacatttatgtatacatttacatatatgtgtgtgtgtgtgtgtgtgtgtgtgtttgtgtgtgtgtggtatattatctattttttttcagttcttttcctctggatcttttcatgtcagtaaaaaggatttgccatactatttttaattctgtatagtgctccatagtgtaagggttcatcactgagtctcttttatagtggagagcttcagcttttctttattacaaacaatgttaagatgagcttccttgcatatgtatctttgtgtacatgtgaatccagaattggaattgcttgttttttttttgtttttttttttgtttttttgagattatcaaaattcagtgtgggccatcatcgcaaatgttagaatcctcatcttagctcatgttatcgacctgggtttccacttagttgcttggggatgtgttgttcagaccaagccagacacttctctaaacagacacttgtggccaagagagtaaatgttggggaagttattttccatggcactgtggtttgaatacaggcactcaccatggaagaagagtagggtattcttgtaacagtcttgtttacttaaaacagccacgactcttcgctgagatagaataaggtacttaacgcaataaaaatatctaccataatttaaaaatgcaaatgtagcaatgcactaaaaaatacctttagcttattttttgttaagaaacaagtgttttgcataatcaggctttaaaaaatataattgaattctctatactgattctatgataggaaggtccagagtcaggtccaccttccatgccatactccttctttccaccattcgcagctggtcctactgagggtaattagtaggggataatatctgaaaatgtaggtatgtaagagaatagagctaatctgcctagcttttatgatattacagatcgcagaggagcatcctcacggataattcccaaatcacagataatgtgttgttgtgctttataagcagagagacacaaaataaactctctcccctatccttctcttttatttatttattttccttctgttaatagatttagtcattttttaaaaccataatataccaggatgagccagaattatgtgtgtctaagttcttttaaaataaagaaatcgtttcttgggtctgttttagttaggtcctttcaggttgcaggaaccaagatgtgcttaaagttacctcagatgactttagatgatgggaatttatggtaatatacagggagaaggaaggaagtccaaaaacccatgtcagcaactagacaaccaagcctcatggagacttggaatatcattgaggacacaacagcagctgattttgtcattcctcagaaataaacatccagtgtttccttgtccggtgggtctttgttggacaaggacttagctttcttcaattttccttctgttttctgtggcagctcctgttagtgattctgtttagtcttcttctgaacactaggatgttcgttatatgatgtcctgctgcctcatggcctcctcatcctacgccgtgtgtctctggcttttgctccattccatctctgctcccagcttttctttttctgtatccttacactgaaaagcctgaaccaacaggaccattattttagctggttcttctccagtacacatggaggaggaattcttcctccaacacagctcctgggtatctagtctggtttgggttcaatgtctgatccaactagctgtggccagagtgcagaattacctgttacaaaactgtggcaatgtagttattaaaacaagcaactttttgagggttttgcttaaacagagtggttggtgtggtagagacaacattgtatgtacttctctatcacagagagaaatttataaagtcaaggcaaaccaaatatctgaggctgggacttcaccccagatgtttgcaagtaaacaagttgtggaccttagagatccgctcctctcactttctgactgcctcttgctttggtctgtagaccaatgttccactagtatttagttttcattctggttttaaaacggtttatctgtaaacctgtaatttaaacttctgataagcaaaactaacatagtaatgagcccattagaaagcaatcgtgagatactattagactttgataactttcaagaagctttattctatttttgcccattcaaagctaacatttttggcagttttaaaactgaatggggtttttgttttttcctaaatatgtttgtctgatgtatattatatcttattatggcaaagaaacttaaagtaccaaatagaatgaagacatatttgatattaaaataatgaaaaacattcaatatttgataacttcagagagactttgactaagcttcaaggttatttttataaacatgtactactggacaatgtatagaagtttcttagctcacagattttcactttggtagatgaggactaatgtgtttgccagaatgtgcacctcttctctatttaccgtaaagagaggtgtgggtaggagattgcacagtgtcacttagggcttagaggtgagggattttggaatagcttttagtttaacctgcgtgtgagaaaagaaggtttcatcgtgtggttaataggaattttcatatgataggaaaaggattaacaagatttaactttatattctcaataacttcccaattaaccagtgtctttgatgaggaaaaatttgaaaattatacagttgtgtttcttttcaatcttcccttgcacgattacaagacgatggaaaagtgcttacactttgattgctgttcctaataaccatgttagaatttcacaggtgatctggaatatcatatcttgactttcatatgtgggagcaagagtcagcaaacaacctttctgtgcttagagatgattttatacataaaataatattgttttgaaaatgaacattgatgggaactgtgtcatattttctgtatcatatttcatgttagctttattagttagctctcattacctcaccaaataactcagatttaaaaatatgtatcttaactgtgatcagcctaaggactctattcgatgatcaagtcatagtcaaatcacagtctcatctcttaatgtgttcctttgatcctcctcccaactctccctccaacattcataccaaatccttggatgtttctgcttagttcaaaaagccatgttctctcactatgtaaattataccaagaataccactaatcatatacgagaagctaacaatctatgcttgagttgtgtgttttttaatatcatgctttgggatatgatgccaaattggatctccaatttgcctttaattagtcagcaacacttatttaatgcccactaagctcagagcaaggcttggagggtggagaaggggagtaaggagatcgaaaaacaaatacactatcatttccagaatagttacagtatctttatgcatacagaaaacagataaatgaaaggatttagaaaacttaaaagcaaaatccaaatgagtgcaaattggtctgatacaaactgagctatataaatgcaaagaggatgcaaattataaaaacttgaagagtttaaaattgctatctttctacttttattttcataatactttgccatgagaattcttagatctcaggacaccatacccttcagtgaggaaagtttactggttcaattgtatgatttagagaaacaaacctaattcttagcattttatgggcttctgagagatgacgctgtaaaactttttgagtctctgttaaacttttctcgtcattaaagcttttatgtaaccttgaacaagttccttaacctctctgcgcctcaacttccacatcattaaaatggggatgataataggacccatctcataggattgttaggactattaaatgtattatactctattacttgtatcctataaaatatctttctcacagtttaatttcttgaaaattgaaacacatcctatgattgatgtggtaagaaaccattgtaacacatattaagtgacacctgttggttctttgttagtaggttagtagggaaaaaaaaagatgcagtttatagtcaaagccgtgtgtaaagtgtgtctaaagtgcttaaaacaaagcctgtcatacagttggtcttatagaatgatgctgttatcatcattgcctgaataccatatttgtggtatgtaaaatatttgtctccaatttcactggcttctgtcctatgaagcagatatacttatagttcctggtctttgagtaaatagagcctagaaggattatcagatattacacaactgccaaataatgacttacatcaaaccaagagtttattcctcttctcatgcatatcaacacctgtttaatctgatcatgttttcaaaaacccactagtgatctatttatttctagctatagctttcatcacctgtatttggtgatttgttgctggcagagtccatactcataacactaaatctgactactgtgattacaacagtctttctaagttagataccactaatgatattgattagggagaaggcattctttgtgatcctatttgcacgatctcgggtaattcacttactggacccaattgttagttgtgaaatgtgaatgttgaaagcagtgaatcttccagctgcttgatttgtgatatcactatcaatttacctactgaggagcttcatataaattggtcatttgtagaaagtagttcagtggctgagaatctggcataatattttatttttatgaaatttcagtaaacattattgagcaacttgtaggtttcaggctccacgatagggatgcaagcatgtaagacctctgtccagcaactgagaggtaaaactacaatgagaaagatagactggtaattcagatttatttttaaataatagctttttgagatataatatacttacccttcaatccactgactctggttttaaaggagatgattaatacattcactcaaccgatattgagcatctgatatgtgccagagacttcctatgtgctagggttatggagattgacaatagttatacaaaactgagcctgtcacaaaatgtgtatcgacagacagtcttccatttggtgctatagaccagtactcagggtcagcagagggtactctggaagcatattcagggacaaagcaaacctagtcttggaagatctgaggaagtttcctatgatcatgtctgtctcctgccataacaccctgaatgcatccgatctgaactaaactgaggtctgacaaacttgtaggagtttgcgaggtgagtggcttggggaaagtagagaggaagaagtttttctggaagagaaaagaaaatatgctgtggctctgaggtgaatcacatataatgcacaatagcttagtattgtgataacatttgggactgtgtgggcagacagtggctgcagggcctgaagggtggagagggggaacttacgcttcagtaggggtgtatatgtcttattatgaggtcacaatgaagattgaggtcagctagaggatgtgacattcgagttgggtcacaaaggatgtacaggagtttttcaaggctgaccacagtctaggcagaagaaattgcaattgtgaaaggaagatttgcgtgaaagaatggtgtttttggctgagtgaggaatttgaagtatctggaaaatggagtaagtggcacagagaaagaaaacagccaaataataataataataataaattggtgagggttcggagagccgcttacaattggattcggtgcaatgcaatgactttatatgttctgtaccttgtccttgtaggcagttgcaggcactagggacaggagtctggggggaagacaggagcattgaaagtttgaggaaaaaatgagaagcatgctttagaaagataatctgaatatacttgaattggaggggccctggattgtgaatgaaaattagaagtatgtcatctgtattgtgtaggatagtgcttatctacaaagaattttatgtagaattccccatcagattaaccctttgcagcaatagccaattatttctgatattaaaaattataattaaataaaagatatggattggtaactaaacatttattgagaagttactgtatcacttccacaaatcaattcacttatttttcttagtaatccaatgatgtagcctgtcatttctcccatttttcagcagaggaaattgtggcccagaaggttgtatgtaactcatcgaggcactaagtggcagaggtcatgtttcagcctcggccatctggctccaaagcctaaatgtatgaattggccactaaaggcacaactgaaaatactaacagtccctgtgttagtgaagagggatatttggcaaaaagtttttattttgcttttttacaattcagtgatttgtaatttatttacagagtcatgcaatcattacctcaatttaattttagaacatttaaaaagtccatgctcatttgcttcccattctcactctaaccctagataacctcaaatctactttagtggtagtcagtttgtatgaatggcaacttcagtttaatggcttttttttttttttgagtagtcacaatctgatagccttaatcactaattcaggagaataacattgtttgaccatatcatttctaacttctgcatgcaattagtgtactctattcataatttgatgcagagaagggtaaaagtgacaggccttgtggcagtcattggtcaaaggcatatgagtaagactgcctgagaccctaccctggagttctgtcttgcaggtaaggcacatagacaaactattaagcaatattggagaaagaaattattgtagaaatcctgatgtttttggtgaatggcttatgttaaacttctctctcctggaagtcattgaattgtttttaaaaacttagtatgtatgaagcatttggaatgcttggcattttgagaataaaatccacatcaatttaaaataaaataaaactccccatccagaatagagtagtaattgcaaggcataaaatagcccagctgtggagtggcttaaaggacaattggtctcaggcagagagtaccagataggacacgctacacaaaggactgtaatgtctcaattagtgtacctattgggtagcacatatatctgaaatggcttaaaataaaaattgcaaatgcaccagatttaatcaatcttagtatttccttctcttatgctctcagtccttagttaaaaataaaatttgcctgcctcattctcctgtgtgctagctagtaggattaactggagttctcaacaggaaagcaatagatctagtagacgacattgtatggtgggtgaaagcccgctagagataattatacagtcactcccactatattacccttcaaagaaactgagcctaatattctcctcctaagcaatttaaccaacttctaaaaaaaagtataagatattatttagagaatgaaatagctactgtatataatcaggaggaagaattatagcaaattatactcatttgataagtgtataaagagctacgctcaaagctttgtattgtacctcccaagtaattgttcagttgtgctaactgtccttaaaaaaggagaagagataaagaactgctaaagaaaaaaaaatcaatcattatacttgttcaggaagattttccttctgggcaaagattaagtcttatttcatgctccatgaggatcaagcacacatttggccctcccatgtttagtagtggtgatttctttgcctttctcacattcatgttcatgtataaacatagacaccaatataaaactaaatgcaataaaagtgtgttttaagatctaccacatgtatgtcctagtaggtatagatagatgttatatatctgtgttcactgcacttacatcccaatattttcagaagataggactgtatgcaaatgtttccaatatctctttctaggatcacaaaaaaaaaagagcccctgaggtctttctacttgtttcaaaaatgagctggtagtaatattagagccaatttccttttggtttgctttaaacaaaataaacagcccattatgtaaactgtataagacttaagtgtttgagcacttcccttagagtttgtaagtcttatgcccccaccatcaaaaagtaaacaaataaataataaaaagccaatctaattgttattatgagaagtcatacagcgtatttgctaagagcagctcctctaaagatgtcagactgccttagatggaacactctgtatcctccgcttgccagctgggtaacattcaacaggaagcttaatctctccatgcctcaattcctgacttcaaaattattgtagtaatacaatgcctacttcatacagttgcggagacatcagttaggcgctgttcctctcacatatgtcatcaattctgagaccgattcacatgcttaatatttctgactaattactgttacgtggtaatcatgacatagcggccattgtctgtacttgtacatcaaaatctgctgtctatggagattagtgacttggaagaaaatcctggagtcaatagtggaccccttttttattaagactcttgatggcccagaggtcagtataatgaggaaaacatagaacttccatgattttgacttgaaaagtaattcaaagggttgaaatttaaacgtaaagaaatttttggaatgctttcatttgttgcacttatattttgctttttatgtatgtagaggggtgacatatgataaaaaaactatggataattttaagccatttatttcaacaaacatgtaatatatattctaacgacaaagccctatgttataatttaaatggtagtaatttttgtttccggttttgtaatagctaatggtgtattttataatcagtagcatctttgatttgatggggtagtgtagtaagaactcaataaatgttagactcctcattaggatttgggtagaggttaatgtcggtagatacattattagagttaagggtcctaaggctttttaatgtgagcagagtgcaatgaaagaatattttggattgaccaaaagtctagagaacctgatttgtaactgtatcattatgacttactgaatttcattcagtaaatattgcatgaaattgagctgaaattcatgtctgctaaatatgtgtactctgcccttttctcttcattatgaggattaaattgaatgataggggtgtaagcactttgtaaatccaagtaagaattattagttaggatagttcaggtagtgctgtagtaacaaatacttaccaaatctcggtactgaaaacaagggtttatttcttacttatgctacttgttcatcataggacagaaggagttctttgcagactaatagttgtcatttccaacacttttgacctccatgccagagtaaaagagctctgagggtctcaaactggcaattccacactttgacctggatgtaatacatgtcacttcttatatagctccttagccaaaactattcacatggccctacctagccatagggttgccacagagcagagagctggaaatatgtggagaacagtgtcaataagtttgtaatagtaataatggttgacaatcattgtgtgcttcttagtaccaggcactgttgtaagtgctttagatgggtagagtcctttagtactcatcaagtgggtatgatcatgattcccattgtacagatgacaacccaaggcacaaaagggtagaccaacctgcacagaagagacagagcagggattttgcttgtgtgacattgatgtgtgtctcaaactataatggatttgaatgcattttttaaaatgtaaaaggaagatacaaatatagttgagaatcttctgttctgaaaaataagagatgaggtttggtgatccccaagcctccctaaaatttcacctggatcagccccaaatgacctacacttacaatgactgctgtgttcttttggcgcctcatcttcagaaaccaggggccctctcctggccactgacttacgtcgtagcttagcagaggggcattgtcccagcgtttcggtagatacttcctcctttgacttatttaacctttctattttgggagttttctaacgtgtagaagaacagtagagtggccacagtctactccattatcaatgatcaatacacaattaccaatacattctcaatcttgcttaatttcactttgcaagttaatctggctgcttgtcaagctgagctgtgaacacaaactgtgttcttggggttgcggggtatagagctcctaaaacaggaagccagtgaccaggggagggccagagaggacatgtggaggacagaattgaagggcttcaactggaaaagagggcgtctctaatcaatagtttagacaagtttgcaagtggaagataaatgatatgacaatatttaatcattcataggacattcttgtaatgtaagggggaaaaggagaaatatgttgttaatagggagccagaattattacctttctccgtagctccaactgtaatcttgcctgctattgaggtagttaataaaccaaagcctgtgagctctgttcaatgggacagcaaccagagaggcttctttccaagccctcccaccaggccaagaagcagctgagctggatagaaagcatgccttcagcaccctgggtttcctcttcagtggcatccagaggaccctgggtcacttcacctctctgtctctttctgaaaaacgtatataataaccgtctgggtgactcacaaatctattatagcatttaattaacaaatgttcctcaagtgctttgagctccctgtttggatagatgtgactgaaatgtaaaatacctttcactgccttatttattgctccagcgaacacgctatatgctggcaccatttatcttcattttaattttatctcccacaaatataggcattaatttaaatcacatacagaacataacagtttttatagaggcaaacttattccagtgtgctgcattttaatatcgcactttaccatcttttctcacttgattcaagaatagtatctcttcctgcctcagcatttaatcttaggacaacagaaacttttttgtgtgtgcatgttcttgctctcaaactttgtttctcactgctttgctgcttgttgcctgaaagttgttctgtcagtgtgagcacaggtgtaagtaattccatttctcttttgccagcttaatttcctgtgtgtgtgtgtgttgtgggggctaaggggggtgtgtaacatgatggattttacagctgaagcttatactcattcatcttcagatatcttttctaatagaaataaagacaataaaagtgataccctcctcctgaaatttacacattaaagaccccttcaaactgctcactttttttctgtcttttttttcattcagaggcaaaatttccccctttttttcatcactgttacgtttgcggcagatgagtctcttccttgaggggaatcgtggtaaatgggcctgctgtatttacagctatgaaacattccagttggctgtcacaccctaagcaaggaaggtttccccatccttaatttgcggcctgaaaagctgtggctctcctcaattaagactttccaaattgcctctgacatggcagcatattcccaggagtcaggtcctgggaggcagtaataacatgagcactgctgtataacaacgtagttttacaagccattttgtgctcttttcagaagctttcaggatgctttttctctgaagttgcaaattaaaaagaaaacaaaacttattttgattttttgtttttagttttcctagtctctgaatgtctaggtttagggacatctgtcatagtcttatttatttattttacgtttagtctggatttaaaatgtacaaattaatgtttaagttctctgttttattcctgtaacaatcctacaagaacaggttccattattgtgttcatcttgcagatgaggaaacaaggcctagagaagttaaatatttttttctgaaatggtacagctagtacgtggcagggctcagattttggatccggtccaccttaactaaatatgcttttgatgtagctctcttcaggctgaattcttgacctctcatttgatgctgactcttctcaaacccttagtctttgtgctactaggtagattttatctgtggcaagaacacggttaccctggaaacccactagctagaatggcaagccaattatagcaccaccgctttttttaaattaaattagcgctgctgatgacgtggacttcttgattgaagcatgctgagaaatgggttctcaccagttgttcctgcctcttaggatcatgtgggatcattctcatctattctatcaagccaaacaagaaaatgcctctatgtgattgactggatttgaggaataaaatgtgatgatcttttaggaccctgagctttcagtagtgagtagacatgcatggaaatgtttggaaagaagccctattggagaagaagcctgtcatctggatactttccacccccaagcacacaaggtccactgatttaaagccctgctcttaactactgaggctaatgttctctattttagtatttcttattttatttaaggccattggtttaaatccagacttgattcaggaaaggttgtagccctttgatattctttggtctttgcacacttctaatagggcaggaatttgctttagttcaaaccaattggtgcatttcctttaagtacacagaatttaaacaattgaattgatatggccactgttgaactgagtggtaccaggttggaggaaaggacattcattatatgttagtgggttgtgggctcactctctgagatggtaaacggtaggctggtagaatgttgagtagttcattctgcataacacacatggcgccaggcacattacctagtacctctatgattttcatccgctttattttctgttttgtagagtaggtaaaggtaaggagacgggcttgctcatttgcaaggctattctgtgatgcagggttctgagtacaggattccttatttgcagtccagtgctcttcactttataccaccaagtcaccagagtctcagggcctgtcttctgtatcgcagaaaacaaatcaaggattagcaacactgaatcttaattcttgaagttctaacaggaaaattatgttagtcttgctacatatcgtaggcatattttgtccaaaatgagagtaatcagggaggagaagaggctgcatcttactgtgtcctgatgggtgatacttccgtgactatctccatcaccagtgagcagatttccagaagtcatagttcaaaacgatgaagagaattacacattttcagaaaacattgtacattctttgttaacttttccacttgtaaaataatttgttttcagacatccaggtcctttctccatgatttactgcgttggtgacattaatcagcgtggttatcttggagcctcatttccccttgggtaaaatggaaggataacattggcaatcatacagacgtgttgtgtagaaaggagtaagaagcattttggaagtggcaaagtggcaataatcccctgtaagacagtagctgtttttaagatcactgagctctcaaacactggctttttctgcctcacactttctagatttgtaagacttaatctgaaaatatctttgctattcattatgtataattgtagggctttggatttaaaaaatcctaattctgttatttccctgacaatagcaaattattctcatctaattttctcttatgtgaaataagacatacaccctagttacttccatgcctaatatgattgacaaatctatatgttatctgaattgtgaatatattttcatacatatagaagtacatgtgtgtatttcttgaaatctaatggtcaatatacactaaccagttatttctgggattttgggaacaggcttctttctatacttctctacttatctttaaattttctctaatgagcctactttgcttttgttttacatacagtaattaatatatttataaatgtatgtatactatatattttaataaatttatataagtatatgtatgtatatacatatgttttgcaagtaaaaaaactttagtaataaatatctacaaaggcaatgagagctcgtccaaannnnnnnnnnnnnnnnnnnnttccttcttccttcttgccctttctttctctctctctcttttcctctcccccttctgtcttcctctccccacctccatctccctctctctctcctccctccctgccgccttccttctttccagaaagtcactaaccagaatctttcacagaataaactgtgaaacctagatcttaaatgtactacagtagaaaaagagatgagatttttgaaagatgatggcttgtccttgtctctgtacttgaatctatctcaaaacaaagatataactattgtttttaataataatttcaatatagagtgaccatccttgcctactaccctgaagagagagagcatttacacataagactggtggttgcagtaaacccctttcaagtggagtggccactatggtccttcctcttcccttccttcctttcattcccttgccctttccccactttccttctcttcctttccttttttcttttaaggttcataaaatcttgattggcctccttcctagcagccaggagtttgggtccctaatagctaaagcttatatactttattttcttctttctccagatggctgtggctatgaattttactccccatcccaggactacccctgctatactgacactaattttcattttataatactgtcttcatcagtccatgctatgctactagttttagttattataatattaacttaatccacaatgaaggcgacaggtttttttgtgtgtcttactttttaaaggggaaatattatctctcactttaaggaaactaactttagcaactcattccctcactttttttttttctttcaacttgatttgttcaactaaggagaccacatttagtacttgctagctgagacttctgttctacaattctgagttagttcctcatccgtccgaccctctctccccgtggtgcactgagtcacaatgtgatcaccagctgcatgtgctgctattacacacaacacattggctagcagaggagccaggattcagccttggaagtactttcaggcaaaggtgaagaccctttccccactctaagcatctttcagtagtttagtgtagctgatattaatgttataaatggtcattcctaatcctgtctcagttccagcccagatggagttttgattttagaaaatcattcagtgaaatgtatttcctgtgcctggtagtcattgatcacttaccaaaaaaaaagggggtagtgggagactaaaaataaacttatgataattcacatacacttaacctttactgactaataccaaaaagggaatgaagcaggctctgctgaccagcacttgcagatggattccaggaacgtggctagagctgccaaagccatcgctgaatcctgccaaaagcatcccaggggattttactaagggtggggagagcagggaacatggaggtgtgtgtgtgaatttgttttaaaactctcttactcaacactgagcagtgggaagaacactgggaaaaaaggtcggaaagtgacattctagactgggttccacccaatctctatgacactggaaaagtaatgtgtcctctttggaacttcaggtatcatgtgaacaataagggtgtcatattaaggtcttaacatgttgaaatgttaaaaacattctgtaattacttaaattatttcaaaacagaaagatcatacatgttcatcatgtttctgtgttaactggacaaaactacactaaaattaaagagcaataaaagcaatcgtgttaaaattttatttttaaatatagtacttctagtaactgaatatctaactttattaacaattctaaatctcgctttttttttttttaaaccccagtgaggctgggcaccgtggctcacacctgtaatctgagctctttgggatgctgaggcggtatgatcccatgagcacaggagtttgagaccagcctgggcaacatagtcagatcctgtctctacaaaaagttttttaaatagccaggattagccaggcatgatggcatgcacttgttgtgtcagccactgctcattgggggttgggggggttgggggtgggcctgaggtaggaggcttgcttgagcccaggaggtaggaggtcaaggctacagtgagccatgactgtatcactgcactccagcctgagcgacagagcaagaccctgcctctaattaaataagcaaatacacacacacaacacacatatataaaataaaataaaaaccccaatgtgttaagatctcaggtttaaacctcggcttatacaaaccatagtactaccgtgcaataactgaattgacaaggtaccaacacctattttaaccagaaaaataacataattgtgttatattttccatgagagtcatactcttgaaattaagtattttctcaatagaattgtttctcaattaaaaaaaaaaacttactcaaaacatttagtatttaattataattataggcagataaaatttataaaagattatcagtaagatcaagaacctctgcctctttaatcatgtttttctctaccttttgctggtctcttcctgattttgatgacctcattgtctatacgagtattaagacatttggggtagctttttatgttgtgtactttctttccttctccttatgagatggctgacaccttctaaaggattcagagagtttccatcttattgaaaggtccttatgaaaattcactggtagtgttctcagcttatactaggaaggcatgtttcttcagaagcagtatttgttgtatttagggtgggaatcattatgtagcaagagtggtctacatattggtcttgcagcaacatcagcaccccttatgaatggtttgtttcccaccaaaagtcaaagattagcctatatgatggatgatggctacagaaaatagtgccagaaaaacagaatcagtagaagatatatattaagacattaattgggaaggagtagcttgcatgattttgtgggctggctaggcaatctaacatctacagattaggcaattaggaagggcaggctgtaactccgtggcatgagatgaagctactcgccacaatgagaattccttcttctttaaggaatcctcagctctacttccaagacctttcaactgattgaatcaggctcaaccaggttatctagtgtactcttcattacttaaaaatcaactgattagaggctttaatcacatgtacaaaacaccttcccagccacatctagattggagtttgattgaataaatggagactttagcctgaaaaaattaacacacaaatggaccatcacaggagggtagtctttttctacagaatttaaatctgtggtagagaagcaacagatacctcagggcaaaaaaagtccaggaagagcataaaggttcaagcagaaccatgagaatgccagcattgtcgttggagatggtgactggaagtgatgataggtctagggaacagtaaatgtggacagactggcattttacctcgggcacacttggacctggataggctccaccagtctgccctggaaacagaaccacagtgggtcagacagtcttttgtattagttttaaatacagagttgattgtctctcttgcattcttaacttgcaatttagtactgtttatattctgcttgaaggttagagacattcgactaaatggtcttttctccacattgctgtcattcattaatgtcctggtcctggactttactcattgaccacaggacaagtggctcaactctctcctgccactacccaggctgttagtcctgttgggaggctcagggcccaactcactcatctgtaactctcatctccattcagctgcagcctctacagcccctggttataccctggatcttatcattgcttcgctctattttacctcctaaatcgtaaaaattaaaaccagcctcggaacacaacccctcattcttccagcactctctctcattcaggtaactcctattctacttttcttcagcatatttaccttctattacctttctttttcctcaccagtctcttatatttcctttattatccaacttacagtctgtggttcaatacttcagccgactcttccaacacatgaccttctttcggtaggcttttttcagagtttcccttttgtacttgcccttatgtaaatctgtggcacagtcaggccatcttgccaacttttcacagttattgcacaccacactctgttggttttcttcctaccattctgaacaatttcacttcagggctctccttagtggctcttcgtctccctctccttgaatgtcgttttacctttttctttttcttttttttttttttttttttttttgagacagactctcattctgtcacccaggctggagtgcagtggcgcaatttcagctcactgcaacctctgcctaccaggttcaaacgattctcttgcctcagcctcccgagtagctgtgtctacaggtgtgcaccatgcctggctaatttttttttcttttttcttttttctgttttctttttattagagatggggtttcaccacgttggccagtcttgtctcgaactcctgacctcaactgatccacccacctcggcctcccaaagtgctgggattacaggcatgagccaccgtgcctgggcttgaatgttgttttcctttggtggggcttggggaggggtgtctttcctagggcctgctcttgtttcacttcccacatttggttaagagagcctttaactactatggcctcaactatcagctctacaatatgatataaatttgtttcagtaaacttgctcttcagattcaattgtttctaactgcttatcgctcaggtgcatttggatgtattgcagaaatctcagcctcaatgttttcaaaataaactcatccacttctctcaggaattttttccactccaatgttgttcggtatgtggcatcaccatctaaccagtttcctaagccagaagtttaggtattatttctaagccctctctttcccttattatcaattttacctcctaaatatttcacaatctttctacttctcctcatttctgctgcggtacgtgatttcagatcagcatcatctttcatggaccattggtgatatccccctaacgggtttccttgtatccatttccccaccatcgccccaatctatccaccaaggctttcctaaaatgcaagtctgactgtattactttcctgtctaatatgttatctccttattcctgtagtataagacagtgattaggaaaacaggctctgaagtcaaatagaaatgagtttgaatctcatataactatgtgatcttggacaaaataaccttttttggtttgttttccacgtgcgaaataggaacagtaattgaacttttctttttagatgttgcatacctctctggtatacatgaagaagatgtgtagtatctcattcccaccccgcttatgcaccatgctatagtcacacactgcctttgctctgatccccagagacattgagccaccactggagagtcacatgatattgtttttagcctggaacattgttcactacctcagtcttttattgccttgtctcaacatagacgccatttcccttaagacattttcagcacactcctctggtataatttagtttaaatgtccttgctgtgttctcctgtgtttttctccttgaacttcctaatccttacaccttccaccctgcaaatgatcattatctcactgcctctcccaaatgataacctctttccacccattttaagttccatgaggacgatgaccattgacccggaccgcgttgttaaacttcttagtctcagctgccaagagcttagcacagtgtctagcagagatcggacactcagtaaatatttgatgaatgtttatagtgtgactgtctcgccagtgcacatacaacaaagtgatcccatctttccttctgtatcataaaatagaattttcttacctctgtaatttctccctaggaaccagactgcttctagagagcttcttcacaaaatcaaattaattggtattttacaaggagggaaagccccaggacaagtcccttctcttgaccacaaagttctgtgtttctcatctttcctcttgatgtcttggtttcagcaaagcaacatttctatccctgccccctgctcccccataatcctacaaatgtactatagatatgtgtaagtactacatccccaatcaagtacagcgtttggcctcgggtgggagtcaaacagcaagctgatttttaacattacttggaagaaattttctaggtatataactgacaaacattcatggagagctacttcatttttctgtcaagcttttgggggattttttttaatagttctgcactttgaaagaaagttcacaatttttaaaaggaaatgtggcccttttcattagctccttttacctcatgctgagtcatggatgagagagaatttgtaggcgggtgagctgcaggaaaagtaatactgtcatttacacttgcaggctgttatgctttccagaaaactttttccgtaggttgcgaaagtgattaatctgctgttaaaactgacaaagaaggttctctgataagagaaagaattaaatgaggaatttttctttaaaaagtaagcgcttctttcccattttagattagaaaaataagtttaaatgtttcttttaattttagtcgtgtgtgtgtgtgtgtgtgtgtgtgtgtgtgtgtgtgaagttggccatgacttaatacaatctcaagccattttctatttaaattatgtttttttacttattggcatggcttattcctcatgctgtatatctaaattattcatttctacatcctgttcccttgcttgtctctctttcttcttctttttttttcctttcattttctttatttgggtcttttcaatactttcaacatcatcttacttcggagccccagatctcttcttttctaccaaccttttttgaaacattaaaactggtgaagatggcctgagttctctctgtgatataaatttatccctccctgaaaaattccattcatgtaacatttttataacactttttaaaacttggatgaaagttttttcatgtagttgaaatgaagcatcactgcctaaagcgtttagaaatttttttactgttggttttaagaaattactctaggatttccactgaggactggcaagtattggtgaagtttgatctctcagagctcatgtttcagatggcaacttaaagggacaaataaataagtcaatcacacggcataatctaactttaatatgattctgcagagaaccagtgactcatttagagaaatcagagtcctcagaaaggtggaaaacatgttagaacttattaagcttgttgcctttagcatgtcaatgccttgtttttataagaagattcaatgggttgttaaaatgcactgtcttaaccctctcccctttgtatttttctactcttaagatgcatcattttatgttgggatctatcagtttattttacttgtttttccttcttcctctccttattttgaaggctgacttctgagcttgagccatatccttggcaactgaatgaattcatggggagtatagtagaaaagattttctcacaactctgacagcactgccccctagtaaaaaagggaagagacaaagagaaatggtcccttctgcaactgaagggaccagcacaggggacttggcattcttcttttagtcctaaagcttagacatacatactgctttcgcccctgggctacaaatacatgttttaaaattctgaagttgaaaacgtcaaaaccatttacaattaaaaacctgctattactgtatatttatacaggtatttcataagggaaaaagtagaaaacatgtaaatgtatttgttttatgtctgaagttccaagattatttctgtttctttactgaatgtgtttgaaatatatgcaaacacacatgtaaacatacctgtatatttatgtacagatataagtctacatggagaccagcatttttagataacactgttttacaggctgtgcatccatctttaaggtgctatagcataaggtctatgactgcattttgtaataaaagatggcaggctttctggaaagggtctctttggggcaggaagaggtgtgaagatcttttgcattctacttttaaagtacaacaagttaaattgctaccagatacattagctttatggaggtttgtttccatttttatagcaaaatcaaataacttttaaatcagaggaaaaaaatattcttttgttgtttttatttttgttgttgagattgcctgttttacgttgagtgcagtgtttttcaggtggaaacatattggtttgacattttaagaggaaaatgttctatatgtaatatgaaagagtctttttcttaactaaatgccagcaacaaaatttaaaccaaaaaatgtagtaatgaaacaatggtaatgagatatgattatggtttagtgagagaaaaaagccctgcagggaacagtacaagcacagtaaattatgaattgctactaaataggcctcattagtccactgtggaccatgtttaattgatattagaaaggagtctggaaaactttggaaagtacatgtaagacaacttgctgttaaactaataaaagtcgttagagtgtctgtttcaaaaattagtaattattaattgtgtgtgagggtcctcaggcagcacccattttactaaaacatgcttagagaaaagatatttctatgagaaatgaaactgcagaatgctgagcagtgcaatatgtgacagttccctgggagtttctcccctcctcgtaggtatttttagcaaaatagtccttaaacattgttttttttttttttttaagttggagtctcgctctgtcgccaggctggagtgcagtggcccgatcttggctcactgcaacctccacctcctgggttccagcaattctcctgcctcagcctcccgagtagctgggactacaggcacgcaccatcaggcccagctaatttttgtattttttagtagagacgggggtttccaccatattggccaggctggtcttgaacacctgacctcgtgatcctcccacctctgcctcccaaagtgttgggattacagacgtgagccaccgcgcttgccccttaagtgttgttttaaagaaagttggcgctctactgaagactggagcccaagaagacatttatagggattgtttattttcatgttgttactacactccatggtctgcaaaaccagagtgccagatgttaaattctatcagcataatgcatctttaattaaatattatatacgccatacaattaataatgtggtctgtttccaaaactttattaagaaattaccataattttgtataataggctaataaaaaggcactgtactttgaaacagcctttcataaagtggttatatgatttgtatctgttgaatttggaatttagattaagagattgtgggccagaattatctgatgcaatgtactcaggactttaaataagttgcgaatcttgtagggtctactattatttggcttcctttaaaataaaataggtttcttatttgtcgatgagctcactctttaagaggtttagggaataacttacctactcgctttgtgtcccccaaccctactttgtaaaaacctcaaacaatacaaaacatgataattccaaatatacagtacattgggctatgatatttcttaatgaatggaaagtcatgcatctggttctgtggtcatcattgatgttttaattttcacaatgtgttaacctgatacttaaattcccctagttgtcctgtgaagaaagaattttaaattcacatttcacatgcagacaaactctgatatttaaaaataatagttatcttttaaactgagatcctatgtggatatggaatagcgtatacagctctgacaatagggcttcagtaaaataacattttgcaagctgtgtttttcaagacaaaatgtcaccctcagctaaacagaagtaatttgcatcagaggtgtgtgtgtccttactcttaatgaaaaaacggtcccctctcttcagaaagtatttgctatctctacaatgtattattttcatcactgtgtccctcccctgcccttcttatgccctaatatttgtcccttaattctattaaattagttgtcaactaaaattaaaggtagatgttatccttcacaatctgtcctggtctaatttttcagtcttgattcgtcttctttactttatggagtgtagaggtggctaacagaacaactctggagccacaatgtgtagattcagataccaacagtagcttatgctgaaacctgggtcaaattacttaagctcacatacctcagtttcctcatctacaaaatgaggataataataggttcttcctcacttatatgtaaagcatttaaataaggactagtagatcgtatgtactagctgttattaaattctgccacatttgtttgttctccatacacaccttagccttttgtctatgtctctgttcacattgtttgctggaaacaggatccacccttctcctccaaggccagtgtatgtgtgtccacaaacacacagccatccatgtgttgtgattccacgcacctccgaagatacggctcagagagccaccctctgcttgccagattgagcatagttcatctggaactttcatacacttctctgtcttacttagcatttgcaactatactttatagttattttcaagtttattttgcctcttttgctggtgtgtgaacttcttgagtccatggacttcctgtgataaatttctccctactacaaaaagctcagtgccttgtgctgagctgctgtgcttagtaatagataggggagagggtgtttttttatatctatatacatatatatgtacatatatatgtacacataatttgatatacttttgagtgtacatgatgtggttccttatttttgcattaagcctatcacttccgggcattggcaaagatctgaaaattaaaaggaacacaaataagaaatgcatttagtccatttaagcaacatgtgagttcctcttactgagtttcttccctaatttagatctcaagttttgcaaaagaatgacaaattcctttatttaaagaaaaatgaaagcagatctgttaccttctgtcctatgaatgccaattctctatcctggataattagataaataagatatttataagcgtatggtttatgcacatagacatgaagctctcaatgcctgcatgattttcctgtcatgctcatgtgggttaaagcccaatagatgtattttgaaaactcgaatgccagtatgtctttaaaaagattatatcctgaaataaagttttaacatcctgtatcctatgataaaagttattttgcatttttttctttaccactgaaaacttgcgaggctcaaagtagtttaatttttatatattgaagctactcatttgccatattttaaaaacaaatcataaaacatggtaattggtaatttcacaaattttatcagggaatattttattattacatttttaaaataaaacctgtagatttatttaaaaagcatattttgaactaaagacctgaaatgtgtagcttgtgtagctccatttgaaaagatgaaggttttgctattgtttgcaacagttttgcctgatttttgttttccccttttgctctgtttttgtagttcagtttgttgcagcattgttgtcatgtctaatttttgtttacgttgcactgcacagcactctttcgtatacttaagtaacctttcttgttctgcactgctgaatgacagctcatttattctagggtggtaattgcagtgtagcagacccaggtgagcaatgtaaaaagttgaagcagataaaatgtatgatttcttttataatggtattgtgtgctgtgttctcctcatatagatgctttttgtttacatagagaatatctaggaacaatctacatgttcttcaagatcttttaaaataaatactctttcatttttaaaaaagatgtattcttggccaggcgctgtggctcatgcctgtaatcccagtactttgggaggccgaggcgggtggatcacttgaggtcaggagtttgcgaccagcctggccaacatggtgaaaccctgcctctactaaaaaatacaaaaattagccgggcatagtggcacatgtttgtaatcccaggtactcaggaggttgaggcaggagaatcgcttgaacctggcaagcagaggttgcagcgagctgagatcgcgtcactgcaatccatcctagacaacacagcaaggctgtgtttaaaaaaataaaaagacataattgcaaaagaagtatttcacttcaccctttattataggacagaccacagtgcaagcaagaagataaatggttaacttacaactgacctctgattggagaatactagagagtggtgaagactgtggcaagcaggagggctcaccaacctcccagatttaacccaggctgcatgtaggaatgcagacccagtgttgctaggtctctggaattaagttatatttaactagcctgtgatctctaaggccttcaattatgaggttcagcaccactggaaaactgagtcagtttagtgctttatttcacaaaggcaaattgatggtcctttctgaccctaaattcccagttttacttaaactatttagacaaatctaagaagtgtgtgaaataaatacagtggagcttgaggatttttgttgttgatttctggtccttttatatttcctccttccctctgagggttcacataggagcctccacagccagaggattactttcagaatggaggcaagattatttcttggaattttggtctgaggaaaaattatttaggtcacttggacacttatgttgtgctttcccacaaaattgtctagcattttctttaagacatatgcatgaccactgcccaaacgaaataaatcaccctttctcttaaaggatccagactattaaatatgaagaacatcaactaatttgactagcagaatgtaggccttcagtgttaacatagcctttttctgttattgcatttatctgcctttgttctgaagccccagtctagtacctttcttaatgcagatctctttgagcataatgtttccattaaaccagccagtggatctcatttgctccatacatattcatattaggaaatattattgtacaaagtaaaagatgctagtaaaagatatgctggaacaacatttctgacagtatttgttctgtagttaatgctctgggagcctttttccttcaaactctctattcctagttagggcctcatcatttcttgcctggattattgcagtagcttccaggctggcttcctttatgcccttcataagcatatggctgccagattaatatttttttcaacacagccctgatcctgtcattctacaattgagttcctcacagtctacctgatacagagacagaaggaatgtgataatacaaataataatggtactcacaacaacaataaatgactggtctttgatatttaatctctaatatcaattgtcttgagacaacaaggctttttgaattcaatatcagagggtttaactgtgaggtacttggcatgggtctgaattgcatgtatattgtatgactgattgaaagaagattatctgatacacatgagaagtgtggaggtgggagctgacattttgttagaagtgcatgcctggcattttgatatactattgcacctcctcaaatctttttaacagaaacaaactactttgtgatgatagaatagcataatacaggacagcggaaaaatcttagtgctttttgttctggttttgattttgcaactaaatatgtatgataaataggaaattagtgcattggagcatatgcatctgttaaagcagattgactgcttggttatcacactataaacaacatttttgaagaattttaaaatttataatctctgatataatgttaaatgaaaaataagatacaaagccacacataaagagggttcacatttaagcaccatcacctatacaaaacacacacgcacacagtcacacacacacacatacacacagtcacacacacacttacacacagatacaagtatacatagaaatacaaaccatgaaaataaagttaccaaaacagttgttatcactaaagttttgaatgagtgttttttatttctttattaaccttgttattacttctcatattttctacaatgagtatcactgtttttagttttgtttttgttttttaaatggagtctcactctttctcccaggctggagtgcagtggggctatcttagctcactgcaacctccacctctcgggttcaagcaattctgcctcagcctcctgagtagctgggatgacaggtgcccaccaccacgcctggctaatttttatatttttagtagagacagggtttcactatgttggccaggctgatcttgaactcctaaccaggtgatctgcctgccttggcctcccaaagcgctggtattacaggtgtcagccactgtacccggcgtatcattgttttaatgaatacactgtcttacacgagggcttgcctagctctctcaaaagtctaagaaacaatgaataatattattttatttaaacattatttaaaaacatgaaaacagtgaatacaaagttgaactctcctcttacaataataaaaattcttcttgaataattctgtatcctaccattccatgaattgtatccatggaaaagtgtatgtttttctgattcatttatttatttgcttctaggttattggatgaagaaatctaggaatagaatgaataactgtatagattacacctctgatgcctggtgtgtgtgtgtgtgtgtgtgtgtgtgtgtgtgtttcttcccttgtgattttctctccttttcctgcctaataatgatgtagctgatctgcttatcatgttcctttatttctataattccaattgttgtagatcccatagaggtgttcactcttgctctctctctctcttctctctccctctcacacacacacagattaaatagagaaaattaagtaaagagaggaaaatgaggaataatttcatactttaatatattcattcattcattgctctttgataatttttttcttttttaattttatttttccctaagttattggggtataggtggtatttggttacattagtaagttctttaacggacatttgtgagatcctggtgcacccatcacctgagcagtatacactgcaccatatttgttgtcttttttcccatgctcccctcccactctttccctcaagtccccaaactccattgtatcattcttatgcctttgcgtcctcatagcttagctcccacatatcagtgagaacatacgatgttcggtttcccattcctgagttacttcacttagaataatagtctctaatctcatccaggtcattgcaaatgctgttaattcattcatttttatggctgagcagtattccactgtatatgtatacaccgtagtttctttatccactcattgattgatgggcatttgggttggttccacgatttgctactgtgaattgtgctgctataaacacacgtgtgcaagtatcattttcgaataatgacttcttttcctctgggtagatacccagtagtgggattgctggatcaaatggtaagtagagctctatgatgttttgatactcttctatggcatagacttagtgctcccatgttctaagtgttatgaaaggctgaagataggaatattagaacatggcccccttcctgagttatatagcttagaacaatggtactcaaacttaagaatgtgtaagaattacctaggccatagcacttacacatggaatatcaagagggagaacagactaggagaagacgtttgaattcagctgcccatgtaaagtataaagaattatttttacccagaatcttgaaggggaaggaactgagtcacacagacaagaatgtgcctaaagcaattcagcagttcagagtggaatgaaaaggaccctggttccctgctcttaagccagtgttctttagctggctagaactcagctctctgtttaaaaaatgaatgggttgcagtggagcgctgtgttccaagtaggatttgtaagacttctggaattctgaaaaaattctactggttttctgcctgtttctctgtctatacttgaattcactgaggccaaaaatggtaactttttacccagtagctggcaacattcctggtaattagaaagtgatcagtaaatgctcaatgactatctgaatgattgcatttttcaaaaagaaatctgaagtctaaattttgagccaactaaacatcatatttctttggttttgggtggtttgggaaaaatccaatgtgttctctgaaaggaaaacatatttggagatatgattatttttttctgtaaataaagttactttgttgtaaatataaatatacatgctcattttataaaagaaaatgaaaggagaaaaaagagcaaaatatctgtattgacaccactcataattaccactcataatttttgttttgtttttcttattcacatataggacttttatcatgatatatgtatgaatttatatcctgttatttttctgaaacattatagcataacaggattaagtatcctattacctctacagttcctgatatttataaagataaattatgaaaataatgtttgaatgagaaggtttttctgtttatatgctgttccaaagaaccttaggtatcagaatttatctgagcccaaaaacgtcccttaggtaccttaagctacccaaattctttgaattctttcaatcaaatcccctaattttataaagaggaaattgaaacccaagaaacaatataagtgaatttgtttgaacccaggaatttcagtacttgttgtcctaatttaaaattgtgtcccaaagaatatttatctttgaatttgttgatgtttgctcttttaaaaaggaaagaagaataataaactaattcctcgttttacctttaaaaggaagtttcactggaggaataagacccaaatgaatgaacccccatcagtcattcgtatcccccagctgatgaggatttcagcagttgtgctgacaccttgatcttgggctagccaccctccccttgctctgccatggagcttggtcaccttgtaccatggtcaaaataatggtgctctctttcaaaagccatccttagatttccagctaatagtgtgtagaaaagagaaaacataattttttagtaccccaaattctaggttatctactgcactgaatgatctaaaatatcaagtaggcgctttcagcaaagctgttagaaatataaatagaaaaaataggaaagattatttgtgggaccattcaaactaagactgttgttgttctcattattattgttgtttttaaaggacactgtccatatattgcaagacatgttgcccactgcccttcacctatgggattatataaacgcaatcctattttttaaatagttgtgcagaaaatcgagaagggagctaccttaactgtgtattcagttcttgagtgacaaagacaggcgtgagagagagagtcccttgcttccaaatcacccctcctttgcctcacccttttcaggacaaaccgactaccagaaatgaatctaacccatgtggtcactacaggatttatctgggcatttgctgaacctgctcgcaatttatttttatttcttccgatagacatggatttggcacaggggagtgaattctttttgaagcagcagatgtgcctggtacacccgtttgctgtaaccatttgtgctgtggttgaaaaaaatttttttaagagtgcagaattgttgaagggggagggttaaaaaaccagagccattttagtgattatgcaaagttagaatgtgagtaattttgctgcagttagtcattatgtgctttcatagcttgttttacagggataaagggatgtgtacaggtttggtgaatagagctcttatttgttcctaatagtcactcttcatgaaaacattttctacccttcctcctactctgtggcaaaagtgctctctccttggaaattatacctttctgggatccattccttttatccatctacaatcagtggacagacaactccattttgaagaacaaatacgttagaagaagaatttttttctcctatacaatctacagtgtaactgatacacattcaaatcatcgtaatacagtgatcattataaaatgagagtgttttctgcaaagaggaaaaaaaaaactgagcaaacatctagtgactttgttaggagcttaatgtgctctaaatatgatgtccttcaaatattttatttgaaatatttgataggtcttagaaaattttgctcatggaattctctgagaactgtaacacaccacctattcctttttcgctttgctttcggtcacccaaatttttttagaaatatgtgaacgagggtctgtttgtttccactgaagcaaatatagccacttgctcacactggtggcttcttttactgaagtccgtgaatatgttagaaactcttgtatgaaaatacagcaacccaatttgtccctattgagcctactttgtgatttccatgccctgctgcctggtgtgtatacactgagatccactttgttaaagaacaaaactgggtttgttacttttttgtaggcttattattaagtctgagcattctggtgtgaggttaggaacgctggtttcagactctggaaaacagagttctaatcctgaccctctgaagaccttctcactttgggcaaatctttcctgagccttgtttccttgaggaaaatgtagagatgtgtgatattcacatttcttacgccctacagttatgtgaggaatactgtatgtttcagttatgcacagataaattagttatttcttctcaaagaatcctctgttaaaaattattccccaaatagctctttttcgacacttgtctcaaggtggtcacattttaatttctgccactgatacacaaatttcagtgataagaaacccctgaatgacttgagagtttcctgagagatgggatcccacctattttattatcttttgtctttttatggcttccgagtagcagtaaaagataggaatggttggttctattacagtagttgattataaccaaaaactagtgaaccacactctccaaatgtcctgctacctacagctaagaaacccaatgtttataaactaactcagaacttttaaaattagattgaactacagaaccctctatcatacttaaatcttcttagatgaatggtgcacaaaactgatgggggatgggaagtgtgggcaattctgttaccgaactatttcccttattgtttcatttgattaaacacttctctcttgtatggaatttgccaataatacattattgaaaaaactgatttcaataatatgttattgaaaaaactaatttattgaataaaaacatatggaaaaatctctttgctagaccctaaggatggaaagcccaaatttctacccacatggagtttagagaggaaaggaacactaaataagtaattgcaaaacaagacgtaagggttatcataaggataatgcaaactattaaagagacattaatggtgggcaccttgtctaattttggaggttccagattggcttcctaaaggaggcatcatttcgtttgaaatctgaaggatgaataaccagttagaagttgcgagatggaagcaggttggaaagtgttcaaatcagggcaaccacaggatagctggagtgttgactcctgtgtagaggaaagtaagagaggaggctaagaagataaacagtagttctatcaggaaagaatttggacttcatggtaagagcaatgagaactcttgagagattttaatacaggaaggcaatgatcatatttgagttcttaaaatttgattttagaatagagtacgtactagaggacaataagcagtcagtttctttaaaaatacacatatacgtgtgtatgtgtttgttgcagtaagctaggtcactaatcatagtggactggactagggcaccaataagttaatagaagtagaaacattgacggtaactagtagagagaattaacaagctttactgcatcaagaggagaaaaaaaattgtgatcacgtttataacatataatcacattgctaaaatctttaaaatatctgttaaccttgaaacataactgatttatatagtttttgtcaatatacatatgaaccattatcttacttttcttttaaactggtatttcgaattaatgttttctggctttccagctgcataccattccattagctcaatgttctaggattttctcaaccatcctctgatttttcctttaatataaacaagtaaaatcacttatgtgcgttttaatagctcttcattgcaagtttgtccaccaaaagaatcatttcaattttcagtgctaccagtcatataaaaacgcacctgtaatattcccactgggattgagttttattatttcttgcctaattggttgaactcacagtatttttcactaaacccctggcctgattggagaaaagtgtctggtcccttgaggagatgcttcagcaaacgaggtcgcttgttatggaaataggctcttctctcactacatttctagatgatagaacacactcagattgatttcaccttcatcacaatggcattttatccagtgctggacacatgcatgctaagaactgagtgtactgtatgggtatttataatacccatattcattctaggaaataattatacatggctgggtatttacataaacaggagccttggagacctctcaagttcaaaaccgatggcattctatctcatttgaaagtcattggggtgggagaggacactccttaaaatattggatttcttagttttaatctgatgatatgctagctttatgaagatgtgagtgcaggccctcacctggatcgttgcttctctttttaataggaactagaaaatgaagattttcaaggtagcatctgggtgctcctaattgacttgattttatgtttgagaaaactaccttgacataccaacattggggtctctagaagtccagggagatgtttttcttcacagtgtcatataccctatcataagtgttgtgaggattaaatggaaaagcttctgggacaaaaactgctctgaagtgccacaccagactatactgttttaactatttctggctctgaagctattaagaataacccgtcactagcagagcacaaggctgtgaaatgaataagtgctgatacatttcaaagaagtaagatatttatgtgtgcatctctctggcaaaaactatcggggactcgttaggggtgtgtgtgtgtgtgtgtgtgtgtgtgtgtgtgtgtgtggtgtgtgctttatgtgttcattgaggactaaaaattagtattagtagtatattggcagcaatgttttgaactcggtggcaccaactaaaattgtgtgatttttatttcgtgcataatatttgagattattttaactcatcaccagatttcagctactatttatcctcatttataaggttactttttttctttaatgtggaaaataaacaaaaacataaaatggagaacaaaattttctcttaactgcctcacctagtgtaaaactgtaaccttttaaaatacattgaaaccatttttaattttctgctatgcttcttcctttttttgtatgtacatacacatggacattggaataccacaatattttagagtgtgtttgcttggtttttaaaataatgtatatatttctgatatatattatgttaaatatatatttatttttatacatttatatataagaaatgtataatatatactatgcctatataatatatatttcttcctttgagtgaaaaagtaatatgtggtagacacttagcaaaataggaaaagtatatagaatagccaaaaataacccctttaaaataaccaatgttatcagttgggaatagatccttctagccatatatgtatgcatatgtatatatgagatatagatagatgcattacttatcaacaggtataaaacaatattttctaactgaattttaaaacaaagaaaaattttgatacatattattatttttattatatagtggtaaaatatacataatacagaatttcacattctaaccaattttaagcgtataattcactggcactaagtacatttacattgttgtgcaaccatcaccagcagaactgtatctattcaaactgaaatgacatatccattaaacaataatgcactagctacattcttccttctcccatcccatggcaatcaccattctgctttctagctttataaatttgactcttctaggggcctcctatatgtagaaccatatggtatttgttttttgttttttgtttttgtaactggcttgtttcttcaagcttcaagcttaatctcttcaagcttcatctatgttgtagcatgtatcagaattttcttattacattgtgtgtgtgtatatatatgtatagatatatagatagatatagatgtgtgtgtgtatatatatatatcacattttatttatccattcatccatcagtggacacttgaattgcttcttcctttggctattgtgaataatactgctatgaacatattaccatgattgtacaaatagctgcattcctgcttttagttattttaggtatctacccagaagttgaattgccagattattgatatattttgaaatatttttatggcattgttttaatgactgtgtagtattctattatatgactatactgtaatgtatataaacaatcctcatgtattgattatttaaattttccattatcttttagttttataaagtacactattaacacggagcttcttgaaactaaacatttatgctctctggtcatttccataggctaaattttaagaaatgaaactatgggtttaaaaagtataaactttattagggcttttgttacatatcaccaaattacaccactgatttcccataaaaattttatagaaacaaacattaacttcgtccctaaatctaaattatataatcagttttccttctaagacaagtggagtcacaccattatgtcactcatagcccctaactccaagtgggatttcctgttcggctttagcaacagtatctaaaagtagttttgaactctggttttaactgacaatcacctgccccttcccttttgaatttccagatttcactctgttgagtgggtttatctacaataacttgcatttaaaaagccctaaatgattctgttgtgcagtcagatttaagaaatgcttttctaaatgtgtggtattatgtttatatatcgcactcttggccaggtgtggtggctcacgcctgtaatcccaacattttgggaggccaaggcagatggatcacttgaggtcaggagttccagaccagcctggacaacacagtgaaaaccccatctttactaaaaacacaaaatgagctggcgtggtggtgggtgcctataatcccagctatttgagaggctttgacacaagaattccttgaacacgcgaggcagaggttgcagtgagctgagatagtgccactgcactccagcctgggtgacagagcaagactctatctcaaatatatatatatatatatacacacacatatacatatacacacacacacatatatatagcattcttaatctcatatatatataatatatataaaatatatatatataatatatatatatgacattcttaatctgttaggttgttttccaactcatggggtcatctatcaagtggatagtgtaagtggcctggttggatgaggaatggagatatgggtacttaccctgaattatggaagataattagtgagatgactcaagaaagcaaatttagttattcttctagtcatggttaggataaaatgatgatgtaatttttgcatagagccaaaagaagcagcaaattagggatttcattataactgaaataggttagctgtgtttccatttttgctcattgtacaaactcagaaaccaattatatttatttatccagccattatttattaagtgcctacctgatatgaatccctaataatgagaccaagctcttcttgggcaataaaactctgaatattgcacatttactcttggaatcactggatttttgagagtcagagtatcttcttttataggtacctcgaccccagtgaagctctttttttttctcctgagtgatatagaaatatttttttatttgaagagaaagattatttattaaaaaaaaaaaaaaggagaagagtaacttagcatttcccctcctttgttgttcagatgaagagtcagtctagagaagtcacgtgactttcccaatgtcactaaattctaaacagtggtaaagctggcactttttttctcggtctcccaagttccagtgcacaactcttcaattgcatgcttcctagtgatacttacatttgccagtatccataacttcaactgggaattgtaaagtgcacctcatgcactacaggtgacctgcagaaattgttttatttctcttccttgtgtttgaaataataataataataataataataataataataataataataatgaacacagctttaaagtcagaagagtaatattggatttatattccacatgtcagcagtgagctggcatgggatagcagctgcctttttaacagagtaaactcttcagctttatagttcacatcactttgttgtttcctagacactggcattctcattttctgttcattctccaatttattcaatttttcttctaggagagagaaagattttccagtgtctacattttgatcacttatctcttaaaaataggaaaactacggatagactgataaagaattttgtggttttttttttttaacatgtcaactattatatttcactgttttattacctgagagaggtggatggtttttaaaaccccaaactatgcagccagatgacccaggcttgaaccttcgatctgccacctactagtgatgtgtccttgggcagttacttaatctctcgtcaatatcttcttctggaaaatgaggattggtttccgtctcaggagtaactgtgaggattatatataaattatgttcaacacaaaatgtttgcaccaggtaatttctatataaatgtttgctattattacacatttttggggttaccaataggtattttagcttgtgttttctgccacagggatgtccagacaaagtagataactgaaagtgaaaagcacttgaggtattcttcaaataactcaaataattgtcatgaaaatataattgaaatggaaatattcatcatcttaatcttctagcaagtcaaccatcccccttttgatattttgtatattccttggccatatgaaaatatcattctctatggcctcaattgtattgtacaaatgaattcacatcatgtgtttttcatttaaaatttacatttaaatcttaagcagtttcccatgtcatgtagctgaaattaaaatgtaataaaatgattttgaatttcgtgctgctgtttaaacgttgaccttttgctactgtctattttctccttctgttacattggaaaattttctaagtagaaatcacttttactcatcacactaaattttgccccaaatattctgtaactaagaactttctgagtgcaatgagtgtgactttctttgtctcatagtgaatctagtaagcagctcaatgcctgttacatagtagactttcaataaatttctattgaataaataatttggattgaatttctgggatttgtggtattgtgtttacttggcagtaaattcagaatgtactttgttttagtacatgttgttaaatactatttttaaatgcattcgtctctttcctttcttagtaagtttatttaaaaattgccctttatttccagaggggatttgagtcagcatcaagtaaaacttacacatatagtatggccataaaaatgaaaacaagtacctcaaagtcttcctggaaaaataatagtatcaatacattccaaattaaaatcattaaactatttagaggtggaggggcactaatgagatgactgtaattaggcacacattacatattttacagaatttcttgattgtcaagtcaataaggaaaataagatagttcatattttttcatggtcagttataatctgaccaaagaaatgcatttttcttgggatattaaccttcattcattcatcaaatatttgttaaatgccagcttatgggctatgatatgatgaagcataatgaggaagcagcagggaataaaaaggacagtctctactagtatagaagcagacatatgcacatgtgatatgtacagggagggagaagtaaagagcacccactgtgctggaggattcaggcaaagtttcacggaggaacctgacattcagcttgagatgtaagacattcctaggaatcagctagataattcaaagacaatggagaagtgcattggtgtaggtatcattgttgagatgtgagagagcttggcacaatagacatgaaagaaggtcaatgtatctcaaagagaggtagaagaggtggatttgcatccatcattcccctaacctgttgaagatttttgagcaggaaagcaatatgattagatttgcatttgcaataaatcactctggctaccaaatgaaggactcattgaaaaacagtcgtggacattgggagaccagtttggatgtttttagagaattcataatgaaaaatggtggaatcttggcatgggattgtagtagtggaaatggtaaaatgtggacatatttgtgagttatggaattccctatttagagagtaggagcaacaggatttagttcttgaatggaaagtaggcagtctcagaaatgattcccagtgttctcctttgagcaacaactgggtggatgagaaaaccaaatgaaaagcagatcagggtggatgatgaaatctgtttttaatatattgagtctgaaaagcatatgagacattcaagcagacacatgaaatagacagttgaggatttgggcttagtattcagaatacagatgaattctggagacagaaattctaaagtcttcataacatagaaggtatatcacgttgtggccatggtcctggagacaatcgagagacaaaagcagagatctggtgtcaaataaagggaatcattattcagcggctattgagcaatatattgggtattgtcattagtaacaatttcacagaaagatttaagaagcattttatttttcgtaagataatattccatttgatgcagatagatagctttctggtaaactaggttgatccagagataaagattaaaaaattcccagggacatttggttaacattttacttccaatggttctcaactagagaggaaaccacctcctgatggggagtttggaaatgaatgggcacatttttataaactgtcacaatgactggaggacactgttatcatttatcgggtagggagcaaaatacattactgtcaaactcaagaagaccatagtactctgttgagagacactgataaactcttgtgccacatatgtttctctggcttgctgattgtgaagttccgagctgactgtcaagaacggtcacagaccttctctagattttcacctccacagtactctctttgtcctgaacctagaggagatgacggctctgcctctgctagttccatattatttccctgtccttcgtgactcctctgcaattacatggggccatgtacataatacctgtgtaaatcagatccttgagaagacctagttggtgtgtgctgtcatttttatttgaatcctgactcttatggctatcttttccacatatcatttgtctcaaatatagtttcctagggatctcatagttccagatttagcttcctgttaagttacaagaagctggatagagtggtatctttttgtttggttggtttttgtgttttgttttgttctgtttttttggatattcgtctttaaaagggtaaacttgtcatttacttttgtaatttaagcagcctggatattcttgtcttgttggtggaggggctttacctttctgcttgaaggtggtcccaatagtactaaatagaaacatagtttcctcattaagcaatttattaaaatatgtatgttcaagacattcctaaaaaatactcagttaagactccaacattctattacagaggacgtggaaaaggcgttttgaacctagaaaaaatttaaggtcagatttttctcgtcaataatgccagtcataaaaaagtcagcgtagatgggcattgaatgaaagagggaataaagctttgcttttctttgatgactcaagatcagcagaaacccagagttcctattttgaacactttacaaacccaactataaatggagacagtgactgagcaactgggctgatgacaggcatgctctctgctgcagctgtaaagtctgccccaagaaagcagttcaaaatttgcatagtttgaaattgaaaaccaataacattcattaacaaaaaagaatatagacctaactccttaaaagtaactttttttttataagtttcttctttcagtctctttcttggtgaagacacacacacacacacacacacacacacacacacacacacacacacacactatttaaacatcctgaagtttttgaattaaagcaacagggcacaatttcaggcagccattgctttcttctaggaaatacctcactattagagctctctttggagatgagaagatttttctcacctttattatgaatcccattgtgtatgtgtgagcacgtttctgaatattttacatattataactgtatgtttgaaaatagaagatatatatatatatatatatatatatatatatatatatatatatataatttttttttcctttgcagttttacgtgccttacatcacgggagctggaaggggtagagaataggaataattttaaagcatatttatttatgttcttcatggttaaagaaaactatgccaacattcttctggcccacatattcaattaaatacatagtgaatcttttctacttactggattatttggtgcttccaagcatttatttttggcatttcatttcgtttttgtttttgcaggaatttttgaagttttattatgatttaacatttttattttgaaaatcgagcacattttaaaaattactctgctgtagctgtagtctgcccccaaaaacagatacttcaaaattcacctattttgaaaataaaaatgcaggtatagaaatttacatatacagattacttatttatctatgatttgttatgtgtatataaatctatttatacaatcatctataaatacagatatgcaaatatgttattttttgagacttaaatgtctgtagcaatcctttttttatgtggtatttttccattagtcattttctaagcctcttcaacatgtaaagctctgtgaggttaatggggggagagtggtgtcctaggatgatgaatagtgtgtctctccctgtcccccagtctggtagagaagctgtgcacaatagattagaccaaatagatttctacattttcaatcagaattagctgtggccaggagataagaacagacaaggtgcacccctgtgtgtctgccttctctcttggagcaggccctccacttccccttttgtttaagttcagataacatgttacattgtttatgtcactattcttcatgaccaattgtcacaaaacttttcctctatgttacttcttttagaagttttagtttcaggcctttctcatctttaaatcattaacccagttttagttaatgatgtcagataagggtccaatatcattcttttgtatgtgtatttctagtttccctaacatcatctattgaagaaattttctttacctatcatctattctttgccccctcatcaaaaatcaattgactgtatacacgtggatatatttccgggctctctgttctgttctgttggtctgtatatcttgtttttcatgccagtaccatactgttttgattactatagctttgtaatatattttgaaattaggaattgtaatgcctccggctttgttcttggcttcaagattgataaggctttttgtggtcttttgtggttccatgtgagttttagaattgttttttctatgtatgtaaaacttcattttggtatttagatagggatctcactgcatctatagataactttgggtaggatatacattctaacaatatcaagtctttcaacctatgaacacagatgtttatccgtttgtttgtgtcttgtataatttctttcaccgatgtttaatagttttcagtatataatctttctcctccttagataacttttttccaagttttttatgctactgtaagtagaattttttcctttctttccttttctgctattcgtcggcagtgcacagatatacaactgatttttgtgttcatctgtgaacactttgaaggcaagattatgccttatttgtgttctacatagtaataaataataattagcagttattaatatttttcatttattcatttttattgagtttcgttggcagtaatttttgctttctttctttcttttttttcctattctttttagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgatcctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaaggtaagaaactcagtaacataaggaggagaatacaggggtgcctatcttagtctgccttccccaggaagcgaagcctaaggcaaaagtgtgtgtgttacttttatttcactgacaaatacaatcccagggaaggatgagtgaagccagagaggagagagagactacttagtatgttactaatatggccactgtttagtatcaaatggaattgcttgctcaatctcagagaatcatcttccaaagcccacagacaccatagcatctgaggacaaagtgttctgatggagaaagagaaaataatttatttttcacatccttccctatattggttaaagcttccctctgttgtgcagaaacttcctctacaccttgcatttgcttggacattaaacaggtctgtagtatctcaagcctcagcaagggtagtgatctatgggtgagacatgtggagggcaaaactgagtgaactgctgtcaggctgtggccctgtgaaggcgattataactcccgcaatgttggtaccacagcggttgctgggccagaacaagtggccaaggacccaggaaatgggtgaggccaagcaggtctaagataatgcaaatgccttggacagtttctcctttgagaaggggctgcagtataatgcagcttgtttgtgaccccttgtttattcattttactaatcctccagaaagaatcttattcttcagcctttagcactattaagcaatgtttaaaaactccttatgagtgacagttacttcttatttgatttaattgtccatatgtggaccttttaagttaacactctctgttacttcgtctgaataggtaaggtgtaatactacacatgcccactcaccacaacttggatttttcattagtactggaaccaacacgatgttgattcctcccattatgactagaggaaccaataagaataacttggaatcggtgaaaatagaggaactgagccagtttccagccacttgggttggaagagtgcccttgcttcttttcagttagaactgtgagaaatcagaaatttgagagccctcaattagctagaagttcaatggtagttttgggggatggattgggtagaagtttggactgtatttttaaaaattctttccacatttttacaagattgtccatttcaagacagatctattcacatattcaacattgtatcaaaaatttccttatagggtatttactaaactgtttttcttatatgaaagcgtctgccatattaatggtgtcctatgtgaatttcacattctataggggaatagagctcttcctgacagtggggactgtgaagagctggagaaatcctatagccttatgtgtgaccactatatgaaattggccagccatgatccctttccgatagatagattccaaattagaattttaaatgattttaaacatgactcagtttcttaagtctctctatgaaaagaaatgttattacagttttttatttctttttaaaatgaatttgtccataatagccaatctggacagccttgctctttgttaatgtcgcagtatatttgcaccagtgcctcctggcccagtcaaggggagtctattttcaaaacaaccagttcagagaaacagattattcaacttaaccacagtttttgttttcaacaattgcaacagatttacccagggaagattacagtaaaataaaattttaggtcagaacaactgctgtcaaggtttaagttcaactagacagacaatttagccctgcccaaaacagggtgactgaaaggatggctgagtgatgttcctgaaggaatgacatggtgtctgccttgttggaggattgtgttatcccacataggaaccagacatgagagaaagcaaaactatgtgtcttgatgagactcacctggtgagaggtactgagctagtcttcagatgttgttttctcactaagtcactgggcactctggccagcctctcttcagcatttggaacccatccattggtgtaggaaaaagaatcagcccccactgctagaactggatctaaagtgctgggtccagccacatccctaacatttggcctgtcctcaccaactgacacagggagatggaatgaatttttataaaccactcatcagaaaacatggaactttattttacttcttatttgagcaaggtggttattcaagatgatctattagatgattacagattttggatgtcagtagatttcatgttatttttaaaatttttgatatatttgtttttcaacagtttcatgtgttttcacatcatattcggctgtgcattgaaaaaatgaaaatcaaaccatgtacttttcactctgattattaagagtggttagaggttgatatttagccatctgtcctgtctgtgctttgggaaagggggaagaggctgatgaagttatggataaattctgggcgcgttgtgagggcattggctgatgaaagggtgggttccttcacagttggcctttgagcaaaacactactgtattctactgcacctgtgcacagaggaccttattgtccttatattgactgtttggcttaattatgtgactacgggcatgagaaatgagctccgaattcttatcccagttctttccttgacattcctcttccagtttgaggaaaacctctagacctctttatgtcatgcttcaaacctcagtaaagtagaacaccatctttactaattaattaatgattgcaaaaggcttggaaatttccaaaggctgaataattgccaagtgaagactattcagctttccactcgctttcatttatttttaattttttttagtcactgatggaaaacttaccctcatgtctgaaaacaattatactttattacattgagtgcttctggggagtttggcatttaacccattaaggaaaaagtttaaaagatgaaataaataaatctcccttatatttgagatgagctgctttagttttcctatatcaggatagtataaaaagaggaatatgatatagtaaaaaagaggagagacaggatggggaaaaggagaaaggaaagaaaaaatgaaaaggaaaaaatgaagaaaggaaagaggcagaatgagaacctgcaaggcttaggggatcatgattatgtttatgttcccataatgtgctaagcagtgaatttgcatgctacagtgggccatactgtatttcctataccatctgagcagagttccttgaaaaatagtgttataaataagtctttataaggtagaaatgttctcttctcactggaaatcctcttaaagatgcagtggaatctcttctctttgctgatttataaaagctaatgtcagctacatcttgccatgtagttcacagaactcgtgtcctgtgcattttatatatctatatctatacctatatctatatctatatctatatctatatctatatctatatctatatctatatatatcgctgtgagttgggagccacgttttctccagtatttagataaggtggctcagcttgaaagttccagtgctaggacctggaagctagtcacaactctcaagtctaaagtgaccaggcaactttagcctccaattatcataaaaactcatctccgtcagcctcagctattaaagggacaggtatttgctacataatgtgtagaagtgctggggctgtgcattccagggaagttggagaatcttgtcccaattagtgtagaggttatgttaaattctgaaaccatctactattaaaattttcttggaaaatatttcaggaagatgagaccttggaggtcaactaaccatctttcagtaaatctaaaagtttttcttttccagaattagaacagattgttgcttttcatttggatttcgagtttggggcatattttatgggtcagagaagagtgtagaggtaatgaactgttgtggtcagtgttgaaggactttaagatctgtaatttctgttaagattaaggaaacagagaatgttcatacactaccactttgaacattccagtagtatgagaatatttaaattaattttatttatttatttatttatttatttatttatttattttttgagagggagtcccattctgtcacccaggctggggtgcaatgacgtgatctcggctcactgcaacctccacctcccgggttcaagtgattctcctgcctcagcctgccaagtagctgggattacaggctcccgccaccacgcctggctaactttttatatttttagtagagacagggtttcaccatgttggccaggctggtctcaaactcctgacctcacgtaatctacccatctcgacctcccaaagtgctgggattacaggtgtgatcccaccatgcccagcctgttttaatttttgaaaagagaaagttatatacattgattgcactctaaagaattgttggcatttggagagagttatccgtatggtaatccctgtgttaattatgtctcaattctaggatcagagaaacaaaatggaagagatgattagggtgggcagaggaatgaatgcagatagatccctcaagtcagtagctaacactagaatacatgtgaagatgagaatggtagatattgcttgaggccagtgactgtaatattagtaattcctctttgtacagactttttagtttccaaagcactttgtggagctcacaaaatccatgatcattaagcccaagtagaggtctttgtctttctttttctgatgagggttcaaaagcccagtgatgagagccactcacttaacgtcatatgtcaaattcatcggacagccacagctccaagtcaggtcttctaaagattgttcccatgctttgaccgtggcaagtgactgaatgttggcatgctttggatggcaggagctcctcatcagcgccagtgtacatggctccactgtgacccatgttacctgcagagattaaagtgggcttaggcagtcatcatggcctttggataaaatcagcggttggaggggaagcacccattaaatccctgcctggcacccaggcctggtgccttagagctatacttccccatccccatcagtcacataaaatttgtcccgaggttctttctaccttcactaagtacttaatatggagttcagtcatccccatttctcacttgaaccattgaaatggcctcttacttagggtttcctctggcagtcatctctgtacccatacatcctacatgtaataccagattaatctttctatggtaccttatcattaattgccttttgcaaaaaccttaataagttcccaaccagttgcagaatacattgaaatcccaaactggatttctagttttatctctccccagtatcctggattccagctgatatgttacatttttagttaattctcacctctatggctttgctcaccaagttccttcttcccagtccttccccaaataaaatctacacatctaaaagtgacccattaagatccagctacagtgttaatttctcccataaggttttctcctcttcctaaaagctagttgtgtgttatttcaccctctcttttagatgttttcactcttttactgtactggagtcatttgtgttcctgtcttctatcaacctatatccaagcatatattagactaagttttaggagaatatcctatgtttctagaaacatatgtatgtagtaactatatgcttagttatttagcagaggtttattgaacattgtgttcactttgaagaattttggtagacactctgtagggccctattagtgtttaagacattgtacagctcaggtgcattttcctttaaggatgcatttaacctgctagatgtcatctcatttttaagaccagagaaaaagagagcagcatctgttgtttcttgactttttaataatagccattctgactggtgtgagagatggtatctcattgttgttttgatttgcattcctctaatgatcagtgatgttgaactttttttcatatgtttgttgaccgcataaatgtcttattttgggaggtggctgctcataccctttgtccactttttgatgaggttgtttgtttttctcttgtaaatttgtttaagttccttgtatattctcgatattagacctgtgtcagatgggtagattgcaaaaattttctcccattctgtaggttgcctattcactctgatgatagtttcttttgcaaaagctctttagtttagttacatcccatttgtcaattttggcttttgttgcaattgcttttggcgttttcatcatgaagccgttgcccatgcctgtgtcctgaatggtactgcctaggttttctcctagggtttttatgcttgcttttgggttttacatttaagtatttaatccatcttgagttaatttttgtataaggtgtaaggaagtagtccagttttagttttctgcatacagctagccagtttttctagcaccatttattgagtaggaaatcctttccccattgcttgtttttgtcaggtttgtcgaagatcagatggttgtagatgtgtggtgtaatttctgaggtctctgttctgtttcattggtctatatgtctgtttcagtaccagtaccatgttgttttggttactgtagccttgtagtatagtttgaagtcaggtagcatgatgcctccagctttgttctttttgcttgggattgccttgtctgtacaggctctttttcatttctatgggtttttttcatttccgtatacgttttagcatcagtttgttgttgtccacaaaataggctgctatgatttggagattaccttgaatctttagatcaatttgaaaagagccgatacgttaacaatactgggtttttcaatccatgaagatggcctatctcttaatttatgtatgtcttctctaatttctctcatctacatatcatagttttgcatatattttggtaaacttgtccttaagcacttcaaatattggatgctattgtaaatggtattttaaaatttgtttataatcatttgttattagcatatagaaatagcaatagatttttatatactccctttgtatcctataacttgttaaatgtaatagttgtactagcttctttaataagacttcttaggcaattctacctgatcattttatctgaaaattgttgatgcaattgtttatttcctttatggataagcctattcatcaacattttatgtttgaaagatttgcttgctgattgaaaaagaaacagcgtgatacaactttaaaggaaataagttggaaaaaataagaacctttcctctccacttccataggctagcctacgtaaaccatcagacatagaagcgattttcagaatcataagtcttaaccccttacatttacagatgagaaaactgaggcctgaagagttacagtgactttcagagttatgtggttagtaaatgacctcatgtgaatgcaaaatgtaactcttctattctgcagttcttctctacattggttaaggatagttcaagacagaggaggtcagaagtaagtgacctttaaaaggtgtaataataactattgtcaggatgatcttatttcctatctttagaaccccatcatcagttttgtaaggccactgaataatagaaaatggttccgattctggtgctccctattctgtctcacagctgctcctgtgaaaacactcgttcatgggctctgtgtaattttgactcagtccataatctctctatcctgattttaaaagttatcatcagaatggatgtgctggtatactaagaaatgtctgtgaatattatttatttattttacttatctaatcattttcatagatttggttgtttaaaaataccccaggtctcaaatccctttggaaagttcagcaaatcattttaacaggtaattctggcaatatgtaattctttgtgtttacagagtgagagaaattctatttatcagtgttttttctttgttttgttttacttcagttctaagcaaagcagttattttgcttattgacatattgatatattcctttgggaatctcatttctttcttggccagctacaaacactcatactgtccaatttcaacaagagactatggttattctcttcttcaccaaacaaagaaatttgaaccattattgataaataatttctggtgaatattaaagctttgaaatgttttgcacacacagtgttaggaagtgtcttagagtgaaagacactatttttactactatagtatcaaaagtgccattgtcccacatacaaagatttacttgttaccttagttctttgatttttctggagtacagcaaccccaacttttagaagtactcttaacaaatgatacagtgtttgatctgtttcatctttggacttcagagaatgatcttcaaataatacagtttggtttatttcagaaggttgcttccttaaaacaaaattttgaaaatatgagataataacatttaacttctttttcaatcacttataaaatttacgaaacactctcatataagaaaaactctgtaagttgttcagaggcaacttctttagtatcctaccaatactgaatacctaagggagggtaagaactgacgtcgcctcactgccagcccagtgttctttccactctgtgaaacttgcctccatttgtagctgtctgtgtttgtatatattagctctattttgtgtagagttgtccaaacataaaatattcctttggcgcagagtttagagactaaaacttctgagtagtatttccgggacataacatatatttaacattatttgaaacccaagattcagtcaacattgctattaagagttaaggagctgaaactgtgcataccctaagtctgaattcaaggtaagaggtcccttgttattcagtctttataagtgtttggtatatttatgcctcctcaaatatgacaccatctttttttaaattcacatttaaagatgattgtaaaacaagaaggataaggtgtaagtgtggtagttgttttatttatggatttatcagttagctgttacttattttttgtggttcataatgcaattttaacataagtctgaataagtttactatagatgatattagtaggttttaccagaggaaaccatgcttttttattttatttttttctttttctttgagacagagtgtcactcttgtcgcccaggctggagtgcagtggtgcaatctgggctcactgcaacctctgcctcccgggttcaagtgattctcctgcctcagcctcccaagtagctgggattacaggcatctgccaccaggcccagctaatttttgtatttttggtagagacggggttttaccatgttggctaggttggtctcaaactcctgacctcaggtgatccactcaccttggcctcccaaagtgttgggattacaggtgtgagccaccacgcctggacagaaaccatgctttataatcctgctacccaccccatccaaagcacacaaaatattagttaagtaagctactagaagacaactgaggctggtggtctctgcaggggcagaaaaatgggaactggagaggagttcaggaaggcagcccagagaatatgaagcaggacccagcacacaacagcctgtgggccacatgtcacttgccacctgattttgtaaataatgtttgcttgaaatacagccatactcgcttcattccatattatcaatggctgctctcacactataacagcagagctgagaagatgcaacagagaccgtatggcctacagatattaaaacattttctgtatatcattttacagaaaaacattgttgactgctggtcaaaaatatgggaagaacgtcatgaaatttagattcttattaaaagttcttgaacatccctgaactatttaatattatttcttgtccagcagatcctgaatcttaaattagaagttgtgacagtaagtggaaattttcagggaaggaagaacagaatatcaaaatcaaaaattaacatgctatgtgcagagtaggttctatatccctcctttttttcccaccctggtaaactcttatttaaacttcaagatctgtctctaatattaacttcttggagaagtttgaccattcttccagttcccacatattattagcttatctttcctctgattttttctcatagcattttttcattcatttactaaaatatgcactaaaatatgcacctcattcagtatttttatataataacattttaagataatttgcatacagtataattcgcccatttaaattaaatggcgattaaattaatttaatttaacacaattaaattatttttagtatattcacagtatattttactgtattcttaaatatagtatatgtgcaatcattatcacaatcaatttctttacaccaggaagaaatcctctaccaatgagcagtgacttttctttttccccaaaccctctaagtctaggtaaccatgaatttaatatctgtatctacagatttaacaattttggacatttggaataatactatatatagtcttttgttactggattcttagtataatattttcaatttccattcatgttgtagcatatgtgattgctgtattcctttttattgctgaataatattccattgtatgaatacatcacattatatttatattttcatcaattgatgaacatttgaggtttttctatcttttggctattataaataatgcttctatcaatatttgagtagacatatgttttcagttttcttgggtatacacctaaaagtgggattgctgagtcacatggtaatttaatgttcaacattttgaggaactgctgaaatgctttccaatggggctaccccattttccattcccaccagcagggtatgaggatctcattttctctgcaacctcccaccgcatttgattttattcatattatgtgtctatctctcaaatacaaatccatgttcttcaagagtggaaaccatgtctgtttcagttttgtttctgtatgcctaatatagtacattgcatgtatcaggcactcatgaataaatgaaagagtcaaccaacaagtgaaataacacctactgaattgacatggaaccacatagagttcctattatcaagagttgttgggttgatgggtgcagaaaaccaccatggcatgtgtatacctgtgttaagaaacctgcacattctgcacgtgtaccccagaacttaaattttttgaaaaaagcaattttattccaaaaaaaaaaaagagtcgtttatgtgggcttaaatagctgtgcttttataaatgttcttttttttaatttcagcttttattttagatacaggggatacgtgtgtgggattactacatgggtaattggacccaggtggtaagcatagtatccaataggtaatttttcagactgtgccctctcccttcctccccgtctggtagtctgtggtgtctgttattctcaagtttatgtccatgtgtgctcagtgtttagctcccactcataagtgagaatatgtggtatttggctttctgtccctgcatcaatttgcttaggattatggcctctagctccatctatgttgctgcaaaggacatgatttcatgattttttttgactgcacagtatttcatagtttatatgtaccacatttttttaaatctagtctaccatttccagctatgttcttcatctttctaccattcacatcctagtgcgtgtaaccgataaattagtattcatttagatggactccattttattttattttattttattttgagatggggtctcattctgtcgcccaggctggattgcagtggtgcagtcttggcttactataacctccgcctctgggttcaagtgattctcctgcctcagcctcctgagtagctgggattacaggcatgcaccaccacgcccagctactttttgtatgtttagtagagatggggtttcgcattgttagccaggctggtctcaaactcctgacctcaggtgatccacccactctggccacccgaagtgctgggattacaggctgggattacaccactattttttaatggcattttagcagttaaaaactgaatgctctaaaagtcagggatggcatgggcacaggtgaaagatgaaagttttgtctatttctatttctatgatgaaatcagttgggttaacaagagcattcttctaagcagctagagattctgttggtctcatccagccatcacccagatggcaatacaaccagtaaaaggcagataatggtatctgtttttgcagactttatgttcacaccagtgtcactcatcttaacctggactcttgtcatcagcttgatatttcctcactttcctctttctccccttttcaagttatagctgtgccttgacatgacttacccaatactctgtattctcttcgtgttcattaataggctcattttccagaactaacattggggcatttcaaggactttttacgtagcacatgagctgcttacaacgtaattctgtctagttgggacatatgtcatttagccagattgtttatggcattaccacagccaagcatatattagtttcatagtaatttctagggaaaaaaatgtggaggaaatatgtggtttttgttatacttgcaatgttactatattactgcttttttttaagttttgatttcaataaatacctagcatatattttcagatgccaaaggacatacaatgatgaacaaaaactcagctcgtcctcaaaatcgatatgtattattggtgatgctggactccacccactcatagatgtttctcattattgtgaaacattactttttggaaaaagagagctgggccaggcacagtggctcacacctgtaatcccagcactttgggagaccgaggcaggcagatcatgaggtcaggagttcgataccagcctgaccaacatggtgaaaccctgtctctactaaaaatacaaaaattagccaggcgtggtggcgcatgcctgtaattccagctactcaggaggctgaggcaggggaatcgctcgaacctgagaggtggaggctgcagtaagcccagatcacaccactgcactccagcctgggtgacagagagagactccatcttaaaaaaaaaaaaaaagagagagctaacatcttcactttttaaggaaatagacattgcccccatgattagatacgtatggatgactagatcatttaaaacaaaaattacataagggcttaaagagtggctcttaagtgtaaatgctaggaagcacccaattagttattatttcctgtatgtgttgccttcatggacattggttcatatagcctcaaaaagtctatgaagatacttttttttttttttttttgaaagagagcgtcactctatctcccaggctagggtgcagtggcacaatctcagctcacttcaacctccgcctcccaggttcaggtgattctcccgcctcagcctccagagtaggtgggattacaagcatgcgccaccataatcagctaatttttgtatttttaatagagacagggtttcactatgttggccaggcaggtctcaaactcctaacctcaagtggcccacccgccttggccccccaaagtcctgggattacaggcatgagccaccgtgcccggctgaagatactataaacatcttgattttttactgagtcagaaactgagaaagggaaaaaattatttgctgaagactgcatgcctcaagtttatacccattatactacactgcctgcttgcgaaagtatgttttaaaaaattgtcactgctgtgcagcaactcaaattgtcactgctgtgcagcaactcaactttaagtcttaaacctagttatcttttatcttgagcaggacatatatgttaagctgctgaggatgctccttaacatgaggccattgggcgggtgtgtgccagacaatcctcctagttgtttctctaatacagagcttcaggtcgtctcttcctttttcatcttctagcctgccctggccaagtacctatgaatcaaccggcaaggcgaggggtgtatttggtgggctatagagtggaattaagcagaatatcaaaaattttagccaataacattgaacctcaaagaggaaagtactgctgagttctgatagatgcaagacaagctaaagacctccttagctccattgttctgcatcagcacaatatgtcctagtgagaaggaaagacatagcaaaactaaaaatgacctgtttttcaagagcaatgtcttttcacccaaacttgtgaactgcttgccaaaagtcaggactaacattgttttgtacatttgcattaaaagaaattatatcaccgttgaagagctgatcagagaaagggtataggaaaaaggaaatgttaaaataagctgtaaaatccagcccatttatatctggagtttagaggcagtctaacaaaatgaatgttccatttactaatcacatttgccatttattcaaaacaaacacggcttgagagaggattaaataaacatccaaaaactgtcgttcttgaaacctttggatagaacattgagttgcattcctgcaggagaaatgccaagtgagtgagcctagtccaagtttgtttagaaagccatatttgggagaaccatggaagtgcgaacctgatcatgtgaaaagcccaggactgttcagccttctgtggcagttctgtgagttctagtaccagactattaatagggagtcaagtagaaatatccttccttcccctccctccctccttcccttcccttccttccttttccctttcccttcccctttccctttccctttcccttcccttcccttctccttctccttccttccttccttccttccttccttccttccttccttccttccttccttctctctctttctctcttctttggtgtgctgagaataatctgcagacagtgactctacagataagattgcaaatattttcccttccttcattccttccttctttcctctcttccttccttctttccttcttccttttttttcttttttaaccacatgatttctatttcctttagcaagatgttatcatgtgagggaagtcttaggtttctatatccctttattcttagtgttagcatttcttattaaagacagatgtctagttttctattttaagggttatctaatttcagtcataaaaatgtcctataaattaagacataactttgtcaatactcttctagaacataatagctaccccaaaatatttgttcaatgatgggaaattcattgatatttagaccttcagagatgaaataaatatgttgcctttgcttttcaaagatgccatcttgcccattcataagaaaactaagacccacagaatgactacccaaggcctcacagtataattaggactttaacaaaaatccataaaacctctggtattgggatatttaagataatacattgatatatactttatcactgtctttgataaaataacagtaaaaccattttaatgggacacatttttataaccattgtgaatttggtcctcaaaaaagaactcactgagatgatgagataatgcatattcatcctcttttacagatgatgaaacatttcggagaaggcaagtcagttttccaatttttcatactatatagatcattgaatctttgtcccttatatacagaatcaacaatatgaaatatgtggaacttgaaatcatagtttccaacttttctgcctatagaatgcccatttccagttgcttaacatttagattgataaacatgaaattcattaaacaggaaactgaataagagacctggactaatatttaggtattacttagtattccatccaagaagtgtctgcagacagtgactccatagatgataaggttgcacatatttcagaagccaaataaatgttgtgattaaatgattcaagtctgttaaccatttggtagttatgatgtaaatggctgttaaatggaaagcatttgtaaaaatgtatgtgcaaaaagaaaggatttctaacaaaccgaatgggccttacctattttagttaatactctcaataatgagcagtgagattaatttataagtatgtgtgtgtgtgtgttaagatatattcacattttatgaaacctgaagctttgaagcttatcactgtggaaataacttctgtatgcataaaagtattatattatttcggtaggactgctataacaaaatacagtcaggccttcatattcaagtaggctgcattcagaattcaaccaactgccaatggaaagtgtttgtaaaaaataacaagtaacaataaaatattagaaaatactacaaatttcaaaatacaatataacaagtatttacctagcatttacattgtattgggtattttaactaatctagagatgatttaaactatgtaagaggatatgtgtaggttacgtgtatagcatatcatatatataagggatttgagcatccatagagtttggcatctgcatggagtcctagaactgatcccctgcagatatgaagggacaactgtaccacaaactgagtgacataaactacagatttttttttcctcacaattctagaggctagaagtctgagatcaaggtactcacaaggttgctttcctctaagagctttctccttggataaaaatggccaccttctctctgtgtcctcacatggtctttcctctgcttctctgtgtcctagtccctctttttataaggacaactccagtcgtattggattaaggtccaccctagtgctctcattttaacttaatggcctctttaaaggccctttctccaaatacagtcacaatctgatatactaggggttaggacttcaacatattaatttgaagggagacatgactcagctcataacaattatgtaggcaaatgaacatttattttaaatgacagaggaaatgcaacatgttataaattaataaaagctatgaaatacctcaaaaatcacattaataaaagctatgaaatacctcaaaaatcacaaaaatcttgaaaaataacactcttatgaattaaattcctgattactttttcttacatttttagcagcatattcattgattaactaactgtacaacctaatttcataatattttctgcagagagaatacaaagataatttcatgctgagagtttattactaccagtcctgccttacaacaggtccttaagggaatgataagcatgaaagactgttacctacttctacaaggacacctttaagtacatagcctgctaacactataaagcaactatactatcaagtctacataagaaccaggtaacaacatgatggcaagatcaaatgcttatatatcagtattaatcttgaatttatgtgggctaaatgccccacttaaaggacaccgagtgtcaaattggatgaaggagcaaggcccaactctatgctgttttccagagtcccatctcacatgcagtgacacctttaggctcagaataaagggatggagaaagctctatcaagcaaatggaaaacaaaataaagcagaggttgctattctatttcagacaaaacagactgtaaaccaacaatgattcaaaaggacaaaaaaagggcattacataatgataaagggttcaattcaacaagaagacttaacagttctaagtatgtatgcacccaataagggagcacccagatttataaaacaggttattagagaactacaatagtgggagacttgaacactccactgacatttctagagagatcactaaagcagaaaaccaacaaagatatttgggacccaacacttgaccaaatggacctatgagacatctacagaatatttcacccaacaacaacagaataaacattcttctcatctgcacatgacacatactctaagattgactacacacccattcataaagcaattctcaaagaattcaaaataactgacatcataccaaccacattctcagaccacagtgcaataaaaatataaatcaatactaagatctctcaaaaccatgcaattacatggaaattaaacaacttgttcctgaatgacttttgagtaaagaatgaaattaaggcagaaataaaaaaaatcctttgaaactaatgaaaacagatacaacataccagagaacacagctaaagcagtattaagaaaaatgtttgtagagacaaacacctacatctgtaagttagaaaaatctcaacaacctaacatcacacctagaggaactagaaaaacaagaccaaactaattccaaagttgatagaagaaaataaatagttaaaatcagagctgaactgaacaaaattctgatatgaaaaccatacaaaagatcactaaaaccaaaagctgtttttttttgcaagaataaataagattgtcagactactagctagattaataaagaacaaacaaagagaaccaaataaacacactctgaaatgacaaagggtacattaccaccaaccccacagcaatacaaaaaaccctcagcgactcttatgaacagcactgcagacatacattagaaaacctagaagaaatgaataaattcctggaaacataaaacctcacaagattgaagcaggaagacattaaaatcctgaatagaccaataatgagttccaaaattgaatcagttataaaaaacctaccaaccagtaaaagttctggatagaccagatggattcccagctgaattctaccagatgtaataagacttgctggtaccaatcgtactaaatagcttccaaaaatcgaggaggagggactcctccctcaatcattctataacgccagcatcattctgataccaaaacctgacagagatagaacaaccaaaagtgaaaacttcaggccaatatccttgatgaacatagacacaaaaatcttcaacaaaatactagcaaattgaatccagcagcacatcaaagagctaattcaacccaatcaaataggctttagccataggttgcaaaattggttcaccatacacaaatcaatgaatgtgattcatcacataaaagaactaaagacaaaaaaccacatggtcatctcaacagatgcaaaaaagggttttggtaaaattcaacatcgcttcatgttaaaaaccctcaacaacttgaaattgaaggaacatacttcaaaataataagaaccatctatgtcaaaccctcagcctgcatcatactgaacaggaaaagctggaagcactccccttgagaactggaacaagacaaggatgcccacttccaccactcctattcaacatagtactggaaattctagagctccaaatagaaagagagaaagtcaaactatttctgtttgcagatgatgtcatggtatacctagaaaaccccatagactctgcctaaaagctccttgatctgataaacaacttcagcaaagttctagacagaaaatcagtgcacaaaaatcagttgcctttctatataccaataatgtccaaactgagacccaaatcaggaacacaatcccattcacagtagccacagaaagaataagatacctaggaatacagctaaccagggaggtgaaagatctctataatgagaattataaaacacagctgaaataaatcagagatgaaacaaatatatggaaaatcatttcatgttcatagataggaaaaaaatcaatattgttaaaatttggggcagtcatactggccgaagcaatttatagattcagtgatattcctgtcaaactaccaatattatctttcacagaattagaaaaaaaaaatattgtaaaattcatatggaaccacaaagagcccaaataggcaaaacaatgctaagcagaaaggacaaagccagagtcatcacagtacctgacttcaaattaaactgcaagactgcagtaactaaaacttcatggtactgggacaaaaacagacacataaaccaatgaaagaagctagagaaacctagtaatcatgctgcacacctacaaccattgatattcaacatttgtcaactcaagatggattaaaagacttaaacgtaagacctaaatctataaaaatcttagaagaaaacctaggaaattatattctagaaatactattctaggccttggcaaaaatttcatatgaggtctccgaaagcaattgcaacaaaaacaaaaattgacaagtgagacctaattaaagagcttctgcagcacagcaaaacaaactatcaacagagtaaacagacagcctatagaaagagagaaaatatttgcaaactatgcatctgacagaagtctgatattgagaatctatatggaactcaaacaaatcagcaagcaaaaagcatccccatttaaaaatgggcaaaggacatgaacagacatttctaaaagatgtgcaattaaccaacaagcatatgaaaaaatgctcaacatcagtaatcattagacaaatgcaaatcaaaaacacaatgagattccttctgacaccactcagaatggctattattaaaaagtcaaaattaatagatgttggcaaggttgtggtgaaaagggaatgcttgtgcactcctgttgggaatgtaaattagttcagtctcactgtggaaagcagttcagggatttctcaaagaatgtaaactagaactaccatttgacctagcaatcccattactgggtatatacctaaaggaatataaattgttctattaagttggtgcaaaagtaattgtggtttctgccattaaaagtaatggcagaaacctaatgaaaagacaaatgcacttgtatgttcattgcagcactattcaaaatagcaaagacctgggatcaacctaaatgcccatcaataatagactgggtaaagaaaatatggtatgtatgcaccatggaatactgtgcagccatgaaaagagcgagatcatgtcctttgcagggacatggatggagctggaggccattattcttagcaaactaacatgaacggaaaaccaaataccacatgttttcacttgtaagtgggagctaaacactgaatacacatggtcaccaagaggggaacaatagacactaggacatacttggtgtagaggctaggagaagggtgagggtcgaaaaactatctattgggtactgtgatcactacctgggtgatgaaatagtttgtacaccaaacccctgggacacacaacttactgatgtaacaaacctgcacatgtatcccctgaaacaaaaataaaagttgaaaaagaaagaaaataatgtttatacttagaaaaaaaattatctttcttctagcctgagtgataaacattttttattattatagtttttaaaagtttggaaaactgcctttaatctgcacaacttttattagtattgttgtttgaaatttaagataatcaaatttggggacactcctattaagtttcttttatttgtgagctattacaacacccttactcttactgcagattcatagctgatgagttctattttgtgcaattagcatcaaaaagaaaaatcaagtcagccgtgcatttataattgtgttcagtgcattactaagcacattcctaaagagaaagtatctccatttgcatcatcgaaaaccaagtagtactccacatgtatacttttacacatctgactattggttgaatttccagcagactcaatttctgtctctatgcattttactcctgtttgtctcctctactagtctaatttccatgctgggtgttataggacacattaatgacacgtgacttctggtcccacaaatctgtgtcacagagctaggacagtaatgggcccaggcacattgaagcattccaggaactcattcctatacaatgacgatgggtgatgacttaagcacacaccatagtgactgcagaccatgtaaatatatcccatgacactcagctaaatgtctccctgactcaacctttcttaaccaatctcaaaggtcacatgttgattctaacatttccctacatgagcgtacacagaagacagagtagaagaaccatagtgaacatacagcttggtcccctcccaagaccttagtaggggccagtgtacatgagggcccctgaagcttcatttccttcctcgtcaaagcatgtttatttaaaagtatttattttactctggatacttcctcagaaatagttattcctttccttttttccctccctctctccttacctctgtcttttcctcaaacatttatttagtgtatactatattctagacccatgttaagaataagatacatatgctgattctacagcactgcatagaaagtaatgggtaacctaagtggttacaaataaaatctactagctatcctggtgatttaaaggccaccttcagctgaatgttcaggaaaacctttatgaggaagtagcatttgatctaacctataggaccggtaggatagggcctgggtggggagactgggagatggaaaggcattccagtgtgctggtgctgcacatggtgggacttctatcacatgtattctctatctgtaacagttaaagttttttggttacttggcctgggtaatggcaaagcaaatgtactaaaagaaactctggttttgtggccacctcagttcctttggagaatgtcctctctcagctgaagctgagaacatccagtcacatttctgttctggaaccccttaagctgtttctgtgacaacatctgaaagaattaagctttatccaagtcaccagaaaagggcttacgttaactgttttcactaagactctacgtttcaatactaacacttacggacaagtggaaggtattcttcagttgtatttggtagttcttctgtagcgccccttttgtcttcctccatttctctcttgctagccctcaactctaccccacgttcgttttcattatcttttttctcatcccccatttcctgcttatttgtttattctggtggctcttctctctctcatagacgacatagaagcatggccttctttctgaactttccttgacccagagggagaaaagtctaacatactatcttatttatgcaatctgaggaaagttgttggccagccatcacccagtgtgacctagtgacagaaccagtagggatatctgagtgttcagtctttgaatgattcttccaagtcatatagatgtgttgattacttcaatcttgaacaagatatgttgtcactatcatactgggctatgagtacttgagaacagggaactgtgtagtaaaattcaccacatatgctggtagcacacaggcatcaaccagtctaaacagaacccacccgggtcacctcccacgtcactgctaagacacagttctttacacagaccatgtaaatgctgttgtgttgttttgtcaaagcttctatcactcttcttgctgtaatttgagaagcaaaagcattaataaccagttacttacataactggtattgtaaggcttactggtggcagacagcattcctgtgagcagtattagcacacctctcgatgagaatggctgtgaactacattctttggagtaacaataagaaagactatacaaaccctggtcctctgtctacagtgaatgaacacgctcatcttttcttcccacagtgatttttttccagataacatattctaatggcatgagtatattaaaataaagtcagatagggtgaggaggggcatgctaacaaaaataatctgtcactcttgccaaatggaggtaatacagtcacaatatttacaagtaaaatggcagggatgtaattgaaagtacatctatatatcatctatatatcattcatatcattcttcaagctgttatcacagttccatctttgactgatgcctcttcaatatgttgtataatgtactatagagttattcctttttactcttttgctcatggaaataatttgaaggcttttaaccttctgatctcatttttcactttgttccagacatggcttactctctctgccatggaactatcagataaaatgcataatttgattagaccaaaactgtactaccatcagtctgtcggtcaacacaagatatattttaaggggatctacacaaaagtctgcatgaaaatattccatataaagaatagttacataaaccttaataaaaagaaaatactgggaagcacttagtgtctcagattctggaatcaaagctctctttcttttcgtttcttttctcagcgattcaaatgaccactctgatattttctttgccaaattaactttagcattggaggggcgtttatatagtatctggcttaaagctattatttttctcatttgctctgcagacatttattgatcacttactgtgtgccaggccctgtgataggaatggaggtagagaagacacaatcccttgccctcaaaggtttcagtgacagaagaaatagatgaagagaatgaggcctgaagtcatttgctcatggtcctacaggcacagagcaggggtgcccaacccccgggccatggacctctaccagtccgtgacctgttggaaccaggctgcacagcaggtggtcagtggcgggcaagtgggcgaagcttcatctgtatttacagccactccccattactcacattactgcctgaacttcacctcctgtcagattgcagcggtattggattctcataggagcgtgaaccctattgtgaactgcacatgcgagggatatattttgcgtgctccttatgagaatctaatgcctgatgatctgtcactgtctcccatcatccccagatgggaccatctagttttgggaaaacaagctcagggctcccactgattccactgatggtgagttgtataattacttcattatatattacaatgtaatagtaatagaaatagcatgaacaataaatgtaaagtacttgaatcaacctgaaactatccccatgccccaatccatggaaaaattggagaccacagaactggtccctgatgccaaaaaggttggggaccactggcatcgaggatagaatagggaccagaaagagattgtgcagccgtccttctagatctggttcttgtcaaccactccatctccctaatgtgggacatggcagaagagttacaactagagtaaaataattcttgttgtgagttgcaaactttatgggctccatgtttaaattatattattaaaatatgtattttgtgtttgatattaatctcatagacatttaggagaacgattagatttctgatgcctctaggcattcagaagtctctaactcacatgctgcattgtctgaaaggttctattttgtgatagtgcttcttgggcatcagtggggacagcttagaaagcttgtcgttgcatctaaataaatactgagagtttggatatgtttctaagttcctttcctttgaactgtggggcataaatctcacgagacagcttgttctcaagaggttaccagtacgtttggttctagtctgtccacaaatattgtgagaacaggcttattcagattattttgacatgctcagacaaggcgttccgaaccatgtgagaaatgaacgtgtgtgtgcaagggaaatacacacaatgctactgagcctctaagaggctccattcctcgtgttttgaggagtggaaattgtctcaaaaaatcagcatctcagctctcattcctaatgtatcagaatctagaagttctggttttggaatctgatatagtgagaaatcagaagatgtcctggggtgtgggagaatgatatgttctttagtcgagtttaaatgagtttattccttaacttagcacttccccagtggcacaataagcactcagtaaatgtttattgaagtgaattccaattcctgatttgaatttagtgttggagaaattccagtcaccgggctgataaaaagtggtgtcagattactggaaaaaggactatgtggagaagctgcttgcaagtaataaactctttgtgttagagtcacctgttttacccaatgcctagcctagatcgttgaaaaggaaattgaaggatggtattcagattaagaaacagatccctggattatgtttaagaatttctgggaggagccaagatggccgaataggaacagctccggtctacagctcccagcctgagcgacgcagaaggcgggtgatttctgcatttccatctgaggtaccgggttcatctcactaggcagtgccagacagtgggcgcaggtcagtgggtgcgcgcaccgtgtgcgagccgaagcagggcgaggcattgcctcactcgggaagcgcaaggggtcagggagttccctttcctaaccaaagaaaggggtgacagacggcacctggaaaatcgggtcactcccacccgaatactgcgcttttccgacgggcttaaaaaacggtgcaccacgagattatatcccgcaccttgctcggagggtcctaccccatggagtctcgctgattcctagcacagcagtctgagatcaaactgcaaggctgcagcaagactgggggaggggcgcccaccattgcccagacttgcttaggtaaacaaagcagccaggaagctcgaactggggggagcccaccacagctcaaggaagcctgcctgcctctgtaggctccagctctgggggcccagggcacagacaaacaaaaagacagcagtaacctctgcagacttaaatgtccctgtctgacagctttgaagagagcagtggttctcccagcacgcagctggagatctgagaatgggcagactgcctcctcaagtgggtccctgacccctgacccccgagcagcctaactgggaggcacccccctgcaggggcacgctgacacctcacacggcagggtattccaacagacctgcagctgagggtcctgtctgttagaaggaaaactaacaaacagaaaggacatccacaccaaaaacccatctgtacatcaccatcatcaaagaccaaaagaccaacattagacagatcaacgagacagaaagtcaacaaggatacccaggaattgaactcagctctgcaccaagtggacctaatagacatctgcagaactctccacccgaaatcaacagaatatacatttttttcagcaccacaccacacctattccaaaattgaccacatacttggaagtaaagttctcttcagcaaacgtaaaagaacagaaattataacaaactatctctcagaccacagtgcaatcaaactagaactcaggattaagaatctcactcaaaaccactcaactacatggaaactgaccaacctgctcctgaatgactactgggtatataacgaaatgaaggcagaaataaagatgttctttgaaaccaatgagaacaaaggcacaacataccagagtctctgggacgcattcaaaacagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagatacataaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccaccaatcccacagaaatacaaactaccatcagagaaacctacaaacacctctacgcaaataaactagaaaatctagaagaaatggataaattccttgatacgtacatgctcccaagactaaaccaggaagaagttgaatctctgaatagaccaataacaggatctgaaattgtggcaataatcaatagcttaccaaccaaaaagagtccaggaccagatggattcacagccgaattctaccaaaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaaacgaatccagcagcacatcaaaaaacttatccaccatgatcaagtgggcttcatccctgggatgcaaggctggttcaatatatgcaaatcaataaatgtaatccagcatataaacagagccaaagacaaaaaccacatgattatctcaatagatgcagaaaaggcctttgacaaaattcaacagcccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcagttaggcaggagaaggaaataaagggtattcaattaggaaaagaggaagtcaaattgtccctgtttgcagatgacatgattgtatatctagaaaaccccattgcctcagcccaaaatctccttcagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatggataagaagaatcaatattgtgaaaatggccatactgcccaaggtaatttatagattcaatgccatccccatcaagctaccaatgcctttcttcacagaattggaaaaaactactttaaagttcatatggaaccaaaaaagagcccgcatcaccaagtcaatcctaagccaaaagaacaaagctggaggcatcacgctacctgacttcaaactatactacaaggctacggtaaccaaaacagcatggtactggtaccaaaacagtgatatagatcaatggaacagaacagagtcctcagaaataacgccgcatatctacaaccatctgatctttgacaaacctgagaaaaacaaagcatgggggaaaggattccctatttaataaatggtgctgggaaaactggctagccatatgtagaaagctgaaactggatcccttccttacgccttatacaaaaatcaattcaagatggattaaagacttaaatgttagacctaaaaccataaaaaccctagaagaaaacctaggcattaccattcaggacataggcacgggcaaggacttcatgtctaaaacaccaaaagcaatggcaacaaaggacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaaacacatgaaaaaatgctcatcattactggccatcagagaaatgcaaatcaaaactacaatgagataccatctcacaccagttggaatggcaatcattaaaaagtcaggaaactacaggtgctggagaggatgtggagaaataggaacacttttacactgttggtgggactgtaaactagttcaaccattgtggaagtcagtgtggcaatacctcagggatctagaactagaaataccatttgacccagccatcccattactgggtatatacccaaaggactacaaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaagctatcgcaagaacaaaaaaccaaacaccacatattctcacttataggtgggaattgaacaatgagatcacatggacacaggaaggggaacatcacactctggggactgttgtggggtggggggaggggggagggatagcattgggagatatacctaatgctagatgacgagttagtgggtgcagcgcaccagcatggcacatgtatacgtatgtaagtaacctgcacaatgtgcacatgtaccctaaaacttaaagtataataataataataataataataaaagtttgggacgaaaaaaaaaaaagaaacagatccctcatggtatcccataaaagttaccttaatttatgaaaatccaacctgtgcaatatgggtatcttttttacaatagaagtgatttatatgggctactcttcccatagcaagagtctcattgccttaccatatagctcttttggaattttttttttttaaacttgaatatatcagaatgatagtaactggccactggagaaaaagctctgacctcaagccaaagagcaatctgtctacatgtctataccatggcagtgattattgataacacaactgattattgtaatcacaacttcccatacagaaattactatttgtattattctccaaaaaataaggccaaatgccataatgtgttttttcagaaacagtagaacatactcttagaatgatgtgagtgcacactcactctcattctagtttattctaaacgagaatctgagatgaatgttccaaatctctccaatcacaagggaggagggtacatttgcagtggatttttctcagaaggttaaatctaaagaagtaattaaggctccacatttctgatttgcaggaaactgcgttatgcatttcccttggatgaaaataagtaaagaggataaaggaagactctcaaattgcagtctgtgtgacctgtttttgaataaacataatcatattccacagtcaattatctccaaagtacagtgtgttctccagccagagcgagagagtgagaggaagaatgtcagttagaagtggttagagaagaggacacatgcatagaagtgtacatctttctattgtcctctgaaaatttttatacgatttgggaggggttagtggggaggattatacagtatttttatgtgatttcataaatgtcaaatttcagtcatcagtaagagaggcaagcacaggtaggaaaacaaaatgagatatgttatgttcagcacagtaataaggctcctaataccaaaggaaaaacaagtcagtagttacaactattgaatagaagtggtctaatcggagcagcaggatgcgtatcccattttattatggcttcattatgtgttttgcaaggctctttggcttgccattaaaataattttgtgcagcagcactgtgaggactcagaatccaggagcgtaactattattttcttttcttctttgttttctttttgaggtaaagttggcagcaaaggaaggtttcggatggaccaagtatagacacaacacttctgttaattcacatggggactaggcagcctcccacaatggctgtgacattcatcctgttctgatagaaactccctgctttctgtgtggcctgggatttgaatctggaggtctttgatccttagcctctcccgtggctggttaccggatggaacggacctgatctttcatttcccaaagaaggcctattaccatcagaagcaaaccgcatccttgcttttatagcagttgcgcttgataattattggtgatactgacatctgcccatgcttacttcatattcatgagcctgaagtggaattttttttttaagctaacatccccagttttggggaatagagtatttcctccaaagttaaaccctgaggtttatttcagaaaaccagtagtcaagtacccttcttctcactgagctaagaaatcctcataaattatttatttcccattttagacattggacagtgactcagtgtgccctggaaatattatcactgtattaattttctcatgtggctcagcataatgttagagaaatggatagttacaggtccagacactataaagatggagctaaatattcttctaaaaataggatgtttggttaacgtttagtagtcaacaactttcctgaagccacacacagtgccggactaagaaatggaataaatgtcctcatacagtatttggtgaagtctccctttaggagattaagcttttaatgttaaagattcagagtattttagctttatccctgagacttattatttgacgtgatgacatctttaactcaagaggtcaacaattgggataaaatgccatgctgtgggtgatggacgccataaaagtaacctgataatcggtcgggtgcggtggctcacacttgtaatcccagcattttgggaggccgaggcaggcagatcacctgaggtcgggagtttgagaccagcctgaccaacatagagaaaccctgtctctactaaaaatacaaaattagctgggtgtggtggcacatgcctgtaatcccagctactcgggaagctgaagcaggagaattgcttgaacccgggatgcagaggttgcggtaagctgagatcgcaccattgcactctagcctgggcaacaagagcaaaactccatctcagggaaaaaaaaaaaattaacctgataattgagttttagttataaaagtgccaaaatgctaaaagaatttacagtttctgaccactgaaatattttgctctagcctgggtacaagaagaagcgagtttgagactaggaatgaatgagaggaaacttttgattcttactacataggttccttttagaattttgaatgtttagagctagaaattgaatattcattattctagcccagacattttacagaggagaaagtcaaagtttcagagatgaaagttgtacccagggccacacagttaggttgctgcaaatattaagagaacttacttcacttaatttggtgcatttttattcttctatttatagacgagtaaaatgtgctgagaccagtgcattttaagctccaagactgtcacttcttcatttgtcttaggcttttagattcaattaaataagtaatgcacctaaagattcatcagctgggaatactgtctcaccactgaatgacttaagagagataatattgccttgctgaagacatattataaaaatctgagaatgagcatgtgtgaagctctctgatactcttacaagaagtgaagtataagtagttgtggattccttcaaatgaaacaaaatttttctggacgcctttttagatagagtatatgcaacccaggagtatagatgtgatgtctcctgtcctgtgcaggagtataaatgtgatgtctcctgtcctgtgctcaggcaggttaggattctggcagaccatgagacacccctgagccatcactttaaaatgccccgtatttcagtagcgtctatgtgctaggatttctgtttgggagtacaaaaagcaatgagattgtttttcttgagtaacctgaagtctactgggaagaacccagtggtaacccaaatagctatgacacaaggtagaaaatagtaccaaggtagatagagataaaacctttgatacttaaaggaagacagaaatactgctgactgggaattttagaggaattttcatgaacaaagatcagtaacatcatccactatccatgaaatattgaactataaggcagttttagtactgggaaagaaaaactacatcatacctaccagtaagaatctcatgatcatcatattttaataaaagatgaagaggtaagatcgcttattctgtgttccaaagaaattcctggaggagaagggatctgagctagactttcataaatagagatgatttggatagaagaacaatttagagcatcctggtttgaaagaacaaaaggatctaaggcagtagccctgggaatgtacttcacaagttcaggatcaatgagtatccagtttagctaaagaaaacaattctagtgaaagaagtaaacaaacgtttggtaggatgaaatggttccatcttatggagaagcttaaatattgatccaagaattttgaacaccctagtggacttcaggagaaccttgtgactctgagcaaagataaaaataaattgatatgggaaatgatgttcctttcagattagagaaactcctgaattaatctcaaatttggaggccgcttagtataacaaaaaagtatattttcaatattgctgatatgtaatctaagaatggttctctcttcctgtcactgaaattcatctattatttattccaagctttaaaaaaaaagtactaaaataaaattgtgtgattgagcattgcaaaagagtgggtttttataatgtggaagccaaaattttttatcagaaaagaaaagagaaaaaagaatctatgctgagaggagatggccaactactacatagatttattaactcaacaaaagggtgaccagttcttccaaacctggtatttgttggtcgtatctattacaaggtagctgtggcttggtgcagggtgcagacaagagagggaacaggaagaaagagattagtgtaaactgtgaaatcaggcaaagctagactcaaattttgtctctgttttctagtaactatgtgtgaccttgaattattgaagctctctaaacttccactttcttgtttgcaaaatggtacgatggcatctacatatagaattatagtaaagagtaaatgagaaatacatgtgaatacctagccgcttctggaaaatagtatgtactcagttactggttatttttattatcgttgtaattactatttccagtgatgtgatgcttattaccttccaaagcaagtacttttatatttgaataagtgaaagctctttcccattatttctaaacccttgtcctacttctcagttctagaactttttttttttttccttaatggaaggaaagaaataaggaagggttggagagagagagagaggaaaagcacctttgtttgtatgctttctttagatacgttgaagacaatactcacaaatctcttcagtcgtctctccatttggatggccatcctcagtgcttaagcacttcttcataaatatgattttcagaagcatctgaagcatctgtattcggggtcctgtcctcatccctgttaagaaatataaggctcaaaatcagatgttgttatgtgaggtgtggtctcgtgcatggagtacaaggtcacttttcattaggagacaaatgcgcagtaatacctacagtgtgggaacgtggatcccttctctttaatatcagttttgccagtgccctcctttgtaacccagagtagcttcagataaacctactgagcccttcttttcttgttcataggaaaatatttttaaagggatagtgcatttataagaaaatttttatatacttcttttaccctgagaggattgcaaagtttgtcatgccctgattgacaaatataagttcaaaaaaaaaaacagaaaataaattccttaaataatttatatcagacaaatggatctgaatctaagcaaaattttcaggaaaaaaaatgtttataatcattaggtaaaagtagaattctgaccttatctttatattttctttatattttaaagctttgcctacatattccaagacttggctttcagttttcctaaatctaaacagagaaataaatgaaatcatgtctaagatttcttccgattttgacattgttatatgtccttacctgtaaaatgaagaaaatattttttctttttatcagggttgttgttaggaagaaatgatattatggatattgtgtttcagcctgctagggacagatactttcatagcttcattcattcaccctagggtaaaagtatcagtgttttcttctttttccttcaggatttattccttagtcagggagtgaccaaggatggtcagccagaacctcagctggtcacctggagcataatatggtaaacagaaccatacccaaagttctgtttacggaggcagtcctggctaccagtgaatgatcaggaaccctataagctagcccctggaagaacaatgatgctgattttatctgtaaaataattctttgcatacaaagtactataaactcagttggttctccctgcatatttttgaatgattgtaggcagagtttttgttatctgttttactaatgatgcaactgaggcccgcaggagtcaggttgcctataaaggcaaggatgtgcatatagaattacccaaagcaaattggtattttgtggggcacaacctcaaaaccactgatatcttgctacatttaagtacaaaaagctcctatatgccacagaattagaacattaccagatcttaaatgttccttagaaatcacctcaactgatgccccacatttggcagaaagccaaaaagtttctcagctaggaacaaaacacaagttccctttctatcacatggtgctgaagcttagatgcataaaccgaacaaatcatcaggaagctataaaaggaacaaacaaatacagtctctggaatcattgcaacctcaatacacatctcattgccacttcctggacatttgtgtctagctaggttgcttcccctgcctgagccttactgtgaatatgtgccaagcagagtgttgctgttaattgagctagataacatgccagtgtctggcctagttcttggcccataataggtattcaactaatatttacttcttttcatccactcacccttcttcttaacagttggaacccctgttttgaactgttcacttctactctggatttccctgtgtaagctcacttgcagaagagggtggaggtgaacacactgcatttcccaccatccagctctgacctgggcccaccctgtgcaggactctgctgactttgggatgccagctgtggtcctcacacagggctcactgtatccgggggcctggcttgatccggtaaagagcgtctgctgcggtgcctgatggaaagtgcccgcttaattgggagatagggcttcatgaatggatctttcattagttgaaaaaaaaaaatatttgcctgcaaggactgtaaacagaagacttgattcacttgttccttttctcctgccctctcttgggttttgtttgacttagcgtgtttatacctcaggacacagctggtactaatgcctttccaaggttaagaaagctttccctgccattccctatggtcccctttgtgtactttcaagagacaataaaggaggtgtggatgtgagacagagagtgcattcacattagtcctggctattatggggacctcagaacaagcatcacctccaccctgtctgcatggatttaagagagagcatctgagcacctgagcttacctcaaacacgttctttgaagaagagtcactgccggtcatttctgtaatgtatcacagctgtcctgacctgatccttctctgctctatcgtggctactttagcatatttttctcaaaaagtgttcctctttcataattaaaggtgagggaagactggatgaaaaaagctgtgggatatggtcagcacataaggcctgtggtcaaagatgggtcttcagttacatcgtttggtcttactaagcctcaatgttctcatttgtaaatctggaataatcattagacctttttcactctgcttgttgtgaggttcaaacatgagactcaatgaaaaagtactttttggacaatagaacactacataaataggaaaattttaatggaaccttcctcatattccattaatatgttggtgctctgcattatagtagtactttagttgacttgagcacatgatgtagttgactttagattaaactttcactaagtattacttagaaaaaacgagccatcatgtgattctacagtctttatgggctacatagggatggtgaattcttttcaccactagcaaaggctcctaaaggatcatgccttactcccactccatagatgaagaccttaggcccctgggaatccattgagctcacagaggtttacataatgccaaatcaggatgggaagttagatcctgcttagtgctcataactggcttatgaggtttccatttcagacaatgaatactcatcaaggaggattggtggggaaccatgagctgttcatgtgtactgctgcactcacgtcgtatccagacacccagatatcatctctggcccactgcagtaagatctctgtcttctgtcctgtttgtctctccttcattcattccttcatttgctctatctagccttcatacttcttgaatcactttgagtatggtacccttattttaaataaatagtaccctcatttgggtatttgtttccagtgttcctgaggctggggaatttctccagagtttaatgatgactctggtgctcaagcaccaagaaaatttccacttgagatggatctggcactggaggtttattttttcccctttctattttattgttggccagtttgggccagcatgttgctaggttgtattggtttcttagctcttgtaaccaagctaagatgcacatgtcaaaaaatattttttcttcctctctaaaaaggtttttcctcttttctgtaatgcttcaggaagggaaaagagtgtttgcttgattctaattctggcatatgaagtgtttgctacaaaatgtttttatcactgtgttatcttgtcaaagtgctatcgtcattgtcattttcagtttaatagcaggaatgttccattttcacaaaggatattccatattttaagtaaactcaacaaaggaaatttcaaatgcaaaaaaatattgatagtgagaagctaattagtttttttatttctcaaagccctacatttaaaatagctttaagtttccagtatgtcatgctctgacagtagcatttacaggtaaaggatgatgcttaactaggattatggttacattgtaaacactcaagccaaagaaaaatatatccttggacaaaggggttaggatgatttgccagagtggcctccagtgtttggatgacagctacatcactgtgatttaatgcacctttagtttcaggagttgtatccagactagtcctcatctcagcctcaccaaaggggactggacttaaccacaatagaactcagagctcctgcagtgaaacccagtccctttccatgcgggaagtgataaccgcaggtgaaactctgagctagggaaataccatcttggtagtcctgaagtgatagcacttacattcttttgccaggcatccaaaatcctttattcttcaaatagttgtgaaggttttttttattattatataaagccttgcagtgagtcatagaagaaatgcattggggtctgagacagagagagagagatgaaacaactataattcctgagtcaactatgattcctgtcttcaagagtctcatgattaagaaatggagacaaagcagaaataactaattccaacttcctaagctaaatgtcataatgaacaaggaaccaaggaagcacatagaaggcttaggtaaattcttcctgagggaattcctctgttataggtaataattattaagcttccaccttgtcttgtttctatgtctctattattatttaatatttacagctaaagctatctatctatctatccatctgtctgtctagagttcctacctaatggtatgtttcagattaggatagatttctcacttgaaacagtctgtctgatgttttgcatccatccatccattcattctacaaactgttatgccctctatatggcaagcattttgctatatccttactacagaattcacttaggcactaatacctattttaattatggagacaaaaacagctaagaaaatgttatcactccatagatgagttaaagaaaaaaaacagggagaatttcttgaaggtgatgtcaatattatcataaactcaggcagtccatgctgaaaatgatttttttgtgagccagaatcccctgtactcatcatttattccctgatttactgcgttttattctgtatcagatgatgtgctagcataaagcggggacataacatcttctgatatcatgagacattgtttctaaacctcttttcttggtgattagacctatgcttgtgcccatcagagtcaagggttgtggacacttgctccgctgcttgttttttctgctatcttctgtccttgttggttgcattctaatggacctataccaagtgctgtcagaagatgagagactacaaatcagattccacaaggatgttcacaaataataagcatttggttgcaatttaaaattggttggcagagcaatagggcatttgattattaggattttacattatctgagtgacttggaaatagaaaagaagggacttgtattatatgtccagaaaaaaagtccagcaaactataatccataggcaaaatccagtgcactgctgtgtttgtaaataaagttttattggaattcagtcacgcccatttgcttatgtgttgtctatgtctgatttctgtctacttggtggcattgactagttttgagaaaccaaatgacccacaaactttgcaatatttaccgtctctttattgaaaaggcttgaccctctataaaaacgaattaatcctgaaggagaagaaaaaataaatagggaccctaatcatatttttaaatttatacagcatgcagttttgaaacactcagtcaatgatgtagaacaattaaaaagaaaaaataaaacctgggctaagatgatagacaaattccctttcaacttcaaccagtttgttctgaggatattgtgtgcttcaggaatttctgccatatgctgggatattcagacatatataacgcagtctgccttccaggaacccttagtctgttagtggagatggacatagaaagcagcaaatactcctttgtgtaactcatgctgtatatgagataagataatgaggcagagaagagttggagagtagagatggcctggcttttgggaatttggggaagatatcataaaacagtagaaacttaaactatgtttgaaagcatgaactcatgatagacgggcaagggtagaaacaatcgttttatttctagaagcttcaactctatcttgaaatagtttgttgtgtatattagtccgttttcacgctgctgataaagacatacctgagactggacaatttacaaaataaagaagtttcaatggacttatggttccacatggctggggaggtctcacagtcatggcagaaggtgaaaagcacatctcacatggcaacagacaagagaagagagcttgtgcaggaaaactcccattttcaaaaccatgggatctcacgagacttatttactatcatgagaacagcacgggaaaggcctgcccccatgattcagttacctcccaccaagtccttcccacaacacatgggaattaaagatgagatttggatggggacacagccaaaccttatcagtgtgtttataatggcaccacagtttctaaagtattatccattatctttttggtctttataacagaggttggttgtaatcattatctccattttattagtatttcttaaaaggcttcatcaaagcagttaaatgactttttcagggtttcactgcttataagtggtaaaagttacctgaccctacctctgactctaaagccacaggactgtccccttaaatcaaactttctggcctaagtctacaggtattccccagaatttctaattgacatgaaatgcaagagaaaagagtctttgaattttcctgcactggagcaacctgccttattccagacattgccaagaaattgtttttgccactgacattattgcgcatgctgccagtggaagtaatagtgatctggacttcatatgctttcaccgaacatgcatatggctcttcttattagactgtcatagggctcccttactttcaactttccttggaggtttctctattttctgtcctcttttcctttccttgtttctgataccagcctatagaccctctgtcaccagttgggtttcttcatcacatggttttctccttctcaggtggagttttggccagagggaggagaatctgttcaattaaacagattctgtacaacagattctgtataatgcaaaacagaaccgattctgtaaaatgcaaaaaaaacccttttctcttgcatttcagatcaattctaaattctggggaatatctgtagacttaggccagaaagtttgacttgaggggacagccctgtggctttagagtcagaagtagggtcaggtaagttttaccatttataagcagtgaaaccttgaacaagtcatttaactgccttgatgaagcctttaagaaataataattaaacatcccctggtatttgagaaaagaggtatcccaagtcccaccgtttaccaggtcctattactcacaatgctggtaaccataggtctccatcccttatgctcactcctcttaccacgccctgtctaggagctacttctacatttatgtgctcagtcttctatccagaaccctacccccaaatgtctaagctcctcacacctcagttctctgtcttgggccatggaacctctaacactggtttggaagtgtgtgtctttttcctcaggcagctggagcagagactgattccactgccaattcttgcctcaagaagagttgtcttgagacaataggttgaagctttcactacatgttcttttagcaaaaaattataaagcatagaggttgagatgggctctggaatcagactacaaagattctgatcttaatgcttcagttataagctctggatgttgagcacctctcctaatctccccaagcatcatctactgaaagggggcatcacaggacttccctcattgagctgttgtaaggattaaatgagcacatgttaagtttctggctgtgtaagtttttgttattacttttcttttgtacttgaacttgtcataccatgtttctattttgggttcagaaaatatggttaacataattataggtgtaatagaaattttggattagcctgtgaacataacacacaattatagcactgttttttttaatgagagaatgaattcctgagttctaaacagatgagttacaaagaaactcttggactgaagtcatccatatataatagatggtccagtttggagtagaagactgactgtgaaagataattgaaagtctgcaaaaatattttttactaaatgcactgtctttttgagcttgcattcataggcacatctaacgcacctgccccaatgtaaccaatcaacatcacatacagccctcagttactaagtttatgaggtaaatttattttccttcttggtttttgtttctttgcattttgatctttttatgtctttgtttattaaataagaaattagaatctctgatcagtagattggctaggatctgcttatgagtcttagatgcaaaactgacaaatctttaattggttgtgccatcgtatctgtcctcaggcttgttagctaaagctcagttagtgatttgccaccactgccattgcttggtggtagaatagggtaaaggattatcatgccagcatcccttgtccgctgtgaccttagtcttagtgaacaaattttcttgtgtgctttctaaaatgcccatgacccttatttcatacttaggaaatagaagtcacaaagatttcctgaggacctcatcattatgtggagctaggaaaagtactgtggtttatagctctgtggtttacacaaagggaaatccaattgatttgcacaaatacacaaaacaaaatatatttaagtgccatgaagagaaacgatgttctttaggaattaagaggaggttcagaaggaaaatggtgttgattgaatctggccaactgagcttggacaatcagtgacctcagggaaaggagtgttaggaaagagacattcctgacagaggaaataacataagtagacagggagatagaacattctggaaattgaatctgtgttaaaatgccttaaaaatggtgcatcatacgaatttagcgacatttcacttcaagattcttacataccttagggtgaaaatcaacaaagaccttaaaatgcagacaattaactctttttctctgtgttgtgtgtgtgtgtgtgtgtatgcgtacacacatatactccacatatctccacaaatcaatgacaatatcaaatggagcaattttccacaattttctccaagaaactgcatgcttaagcactgcactcagcaaaatgttgtaagtccatcaatatttctcagtcttgctgagtttctgcatgacccccaatagcttacccagtctcttcctctataagtaatgatcgcagattctacatctgcaagtacaagaatcctttcacaaataaattccagaggactccaacctgcagtgtctttagtgagtcagaaattaggaagatagcttcaatttggttatacccagcaggaaggaaacaatcctaatcatactaataccaatggaatattgtagtccaggagtttgatggagtttgaccagcatcctttagaaaggaaaactgcataaattaaataatttatatggaacaaacatatgtgtaatatgcatgtaaaataaaatggcaccagttattaatcaggtgaatgcatatatatcatagagaagtcaactatgaccagaagatacaaaatgaactgttctttaggctcatgttttgttttgcaatacagggcaggatattctctcttcctttagccttaactgatctgcttccatgttctagtcacttgaacattgatatgcatgtaaaataggcccctgttcttccattaactagaaaataaaaaagtgcccagaagggaagtttccatttctagcagcacgtagaaaagtgccagagtttgatcaggaagtggtatcagggtcaagatgagggaaaggacatcagaaaaaaaagtagaattatcctgttcacttcaaggaagacacacagcataaggcgggttttagaaaaggattaagagaaaattggcagacagaattagggagattgcttaatcaatatcacaatataacgatgctgggtagaagatgcatggaagaagcatggattatctcaatgacgattttattttgaagatagtgtgattatcacccctggggatgctggaacattacactggggatttagtcaccaactgaagcagatctctgggttgaatagatcaccatgaaggttgtttccaaccttaagttttcttaaatttcagaagttcaatgagttcttctccaaggatcaaggaggatatctactagaaatctactatagaatagagagaattggtctatacacaagtttatttaaattaaataatcctgataccattttgaacttttcagtcaaaacctaccatatgcacctcttaccagtgacttcagtgcttccttatacaaggtgcaagcggttctaatctcacattaaaaaaacactttgggccagttgcggtggctcacaactgtaatcccagcactttgggaggccaaggtgggtggattacctgaggtcaggagtttgagaccagcctgaccaacacggtgaaaccccgtctctactaataatacaaaaaaaatagccaggcatggtggtgcatgcctgtaatcccagctactcaggaggctgagacaggagaattgcttgaacccaggaggtggaggttgcagtgagccgaggtcacgccattccactccagcctgggcaacaatagcgaaactcagtctccaaaaggaaaaaaaaaaaaaaaacactttgattttagaaagaaggtctgtgcccaggcgctcccaggtgctgccaggcctcagaggaagggttctgaagacaaacctgactgcctccttccacatgctatgtctgcaaatattggctgccttcaagctcacagcctgtgacagcaagttggtttcatttcttaaagttgatcttcaaagccgtgaagcaatcgcaaactgtttgagatcccaaatcaaagaacagattgtgtagactcaaaaaaagcaaacaaacaattacatttaaaaacaaagtgttggaaaaaaccagcaacaacctttctgctcacctgccaaggccttgtggctaagcttctgtttttgccaaattgtagcaaatcacatcagacagtgtccttcttgtactactgacaggtgacccatttcctggtggttaaatctggagggatttgggagttcttgctcttaacatgactttcccactgactggatttgtgattgtaagcacatcacactcatttcctccatttgaaatgcaggttctctgaagccttctggcttgaaggaataatagtgagtaatacctaacattggtattgcacagcatgccactgagggctgcccaatagctctgtgaaagagatgaggaaacaggattagagaagggaccagctcacagtcacaggactagtaaattatgaagtgagaattcaagctttccaatatcccttgttcttcctactacatgataccacttctagctaaccactcattcagtagctcttgaaaaggatattctgttacctcctttgaagataatatttgatccctactttctcacagggctttccaaatagagtccacattggcccatttccatggaacattttgctggtctttaggtattttattaattgctgaattgtttaggggttttaagttgtctaaggagactatatctgaattcaattatttttttcctctttcccctcgagcatgcacattctttgtaatactgtagtgatgtataagttttcaagagctgtcaaggtgtatatatatatatatatatatatttccaaaagcagatagtatagtacatttactacagttgtttcactttgatatggataaaaaatgtataaaaaaggcaaagaattctgtgagtgtcattacaactttaatttcaaaatttttgcccttatgttatttgctatacttggctttcctcgacattataaatcattgatcacaggctggtataaatttagcattaccagtggattctgcgtatttgatatgctctttttattttggttttgtcagtttgctactcgtgagtttatctttgaacagcttcccatggctatgggattaggtctgtactccagagcctgatatctatgggcctttttttcttagcctttctagtctttttaccccatatttcttcatgatatccatagtttgtccaacctaaacaaagagctagtccccaagcacactaacccgttacattcatccctctgcttttaatacaattgtttctctatagagaatacctttaaaaatatatataagttggctaagctcaaaaacaccacttctatgataatactcttacagattcttccatttgtaaatatgcatgctcatagtactcttacagcgttggtcctctcttataacattgttagagtagatactgtaaactgaaaagtgacacataaaaatacataatggtgcagctcaggtatgtgtcatcttaatattcctattaaccttagaactttgtgactgtgttgggattacttgacatatttgtttatcaatcaacacagtgacagtgacgacgaatgagtaaccagtgttttgtttttgaaacatttgaagaagtgttccatatttctgaagttattagtttagtttagtttagtttagtttagtttagtttagtttagtttagtttagtttagttttaacgacagagtcttgctctgttgcccaggctggagtgcaacagcgtgatctcagctcactgcaacctctgcctcccgggttcaagcaattctccctgcctcagcctcccaagtagctgggattacaggcacctgccaccacacccagctaattttttgtatttttagtagagatagagtttcggcatattggccaggctggtctcaaactcctgacctcaggtggtctgcctgccttggcctcctaactgaagttatttttttaaattaaactaatacatgcaactggcttaacaaactaataggactaatgagtctaaaacaaacgacataccctccgtgcttctcctctctccactctctcaatcctacttcacgaaagacactcttggctgcttcttcctggcatttgcacagcttcatgtctaaaacagaaatgcatttctatctttggaggcataaatcttagacattatctgtggattaataacacaaaagacacggatatgccatccatataaatgtttgactgtttagagcttcctactctgggaaggattgacccatctccctccaaaattgagaaaagggactttcactggacattatcttcaagtccttgcagtgttccagaaggtgtgacaatctggtcctttggctggctgcattactgacctgctgacctgctgttttaggttgattatatttgcctttgagccaaaagagttacttgatgatactccagagccccatttccacacaacacttaggtttaaaagctgcaaaaatggatttaatgaaataatgatggagtgatttgaagatttttcatgtctttcaggaaacacaaggtgctcttagtgaccacagagctagcagcctcccctgcatctcaactttatgtttccaaatatagtctagatgcttagtaagtgttaaaaaataatagtgcatcttgatgcattctttatggtgtaaaataacctgttaggtatcagggataatttttcttcagcattagatggctgtttatgtatgatatatttctctgtgtccctgggacctaatgatcgttgaatacaggtgaatagaatgttatacagtagatggaacatgattatcaaagtcaggagacctagactcagttgctttctagcaaggcagtcattaattacatgttacgtcttttatcagaacctcagtttggatctataaaataggattactcatttccaccttggaactgtttttatgtaaccatcaagtaagccggtaaatatagttatctgtgtagttaactagctgctaacaaaggaatccagggtggcctttaatatatgttcggaatatatttattcaacaaatgtttcttcaattgttttccaagttagatttataaaaaatgagagcctggcaggcaagcaggcaagttggtagcttgggatgggatccactacagcacagaagtgcagccagagacttgctcctaactccccacggattgctacaaatccttgctccaactcgcagcttggcaagggatcttgctatcagccttctctcatggaacccattgtgcatatgaatatttgattagcttattccattttcattttatactattagttctccttgtggggttagatcctatgcacacacacacacacacacacacacacacaccatttaagaataggaaactattttgcaatctatatgccctctgcttgtaattgttactgttcccaatccatttcctcctcattctttgtctctcatccaaatggttttcactttatgtgtaacaggagtgagcttattctgaactacattggttaggtcctttaaagcgtaagcacgagagaataaaatgaatggaatggcacagagcacagctcacatatttgttttttagttttaaattctcatttgctttttagttttacacatatttattacccgtatttctcatagatttgctttttggttttacattctctccttacttttgccttggttctcctgatgtgtgaaaatgctcctaaggccaccaatcacaggattgtgactccttccccaactttgtttacctacaataattgcaacagcatgatattgttcaatgttggcatatgcaaacagaaaacctaagatctggggagccaattctttgcagaaggtgcttcaacctatctaaaagcaaaaacattcaataatgtgtacatgctttaaggtgtgtgtaatatttgtgtgttcattatgttattctcatagtcacaaaactcctttcaggtaaatatttgttcccattgtatgcatgtagaaatcaatgtttagaggggttgttaaatagctagttaaaatcagaaccaagaatcaaattcattatttctgtcttaaacttctctttcaactattttaggctgcagtagtaagcatcatatgacttcttgtcatctctagtgtgaaatggttttccaaagatctgtgtgtgtgtgtgtgtgtgtgtgtgttttaaataggcattttacttttaaaaggaaggttcacagtcaaactgagcagaaaatacaagcaagttcccatatacccccatccccacaaatcccacaaatgcatattctttcccactatcaacatctctgacgagagtggcacattagttacaatcgataaacctacattgtcacataattgtcacccaaagtccatagtttacattagcattgactacttggtgttgtacatgttgtgggctttgatgagtgtgtagcatttatttcccgtcatagaatcatgcggaatactttcactgcccctaagaattattcttgctctgcctattattactttctcccccaaccccggtaacccctgaaatttttactggcttcatagttttgccttatcagaaatgtcttatagttgggaccctacaatatgcagcctttccatattgccattttactgaataatatacattcaaggttcatccatgtcttttcatggcttggtaactcatttctttctaatgctggataatattttattatatagatgtccacagtttatttatccattcacctcctaaaggacatcttagttgtttccaagttttggcaattatgaataaagtcgctataaacatccacgtgctggtttctttgtagacatatattttcagctcatttgggtaaataccaaggaatgtgattgccggatcgtatggtaagagtatgtttagttctgtaaaaaactgccaaactgccttccaaagtatctgtaccattttgcggtcccacctgcaatgaatgcgtgttcctgttgctacaacattgtggccagaattttattgtcagtatcagtgttgtcagacttttggattttgcctgtggtagcaggcttatttgcttatttgccatctgtatatcttgtttggtgaggtgtctgttcaggtcttttgcccatttttaatggttgtttttcttactaagttttgagagttctttggatattttcaataataatagtcctttcttaaacgtgttgtttgcaaatactttctcccactctgtggcttgtcttctcataaacgcttgacaaagatgcatttttgacatgcaccctgcctcatctatagcatgtcttcaaataggcttaagcgactaacttgagggaagctgatttatcttggagaactcctaactcatttttctttcattcatttaataggcagcagacttggggatataaaaggaatattctgatgtttagttagtgcttaattattttgcattcttaagtcaagcttttgactgttattgcagtgcacttgcacaaacatgaacatttcaacatctgctgttagtgtgaccagaaagagagagaagagaaaggaaaagaagggagaaatgttgactcaatcctgtccttatgtgaaacaataaaaatattttaaaactttctctcagttatgcgacatagtgcttttctattttttcctaaactggaagctccctaaggggaaaggatgcatctcatagaatctcaaggtgctcagcaggtaatatgcatttgagcaatgtttcttgaattaaacttgctagccttatttatcctgaagtgatataacatcgttgggctgcttcaaactgcctttatcctgatgggttcaactggcacaaacagttattaagatttgggagagtcagaggtcccatagataccatggactttgctgcatctcagttcttccattgcatgcctttggaaatctttcctgctggtgaggttctgtgagggactgtggcctgatagaatttgtttcatttctgtttgtttttattctttagaaaggcagagtagaaaaaacagtttaatgagataacaaatagaggaaaatactttggacttactgtttaaatttaaaggttgactttatggtagctattaatagttccaacatcttgttgaatacccaaagcttaattatgtaaagagcttcttatttcctctctcctgccccttttcttctccatccccttgcaaagcaggcacaaaaattaaagctatttagagatatgtgaatcagcatattgcctatatctaatttatctttgtgcaatgcacacattcgtgaatttctcaaagccatgtgactctccagaaatctttaaatatgtaaataatattataacgtcccttagtgaatagcagatgcaatgcattattccaggtgtctgagtaatgcgaagaaaagatcaaattccctgttgtactacctgtgtcacatgttacattaataaacacagtcagcttgcaagaatagtatgttatctgaatttaatgaacttctgaactgaatggaatgcatctaattgacaaactgtcatcaaagagaacagaagacactacaaagtccaaagggaaagaagaaacaagtggggagaaaaacaaacaaacaaacatgatgaactgtgggggctgggattaaaatcattggaaggcatctctgtgtgaatgtgagcctgtgcagtaacctgcacgtgtgttgatgcctggtggtctttccatgtgagacatcttggatctgattaaagggccttgtggtgtctggcatttacagctttgtatttcccttaattgcatatacagactcaagaaagggatgggggagtgtcacataaaagataatccacagcaaagatctcaagctgttaggtaaatgaaatgtttccacaggagggtttatttttgccttcaaaatctcctggtacctgataaattaaagataaaactctttcaaacaagtttttacttttcttttctccacctcccatgctgtcatattgagtgtcacgtacatcgctacttaaaactccaacgggtagagtggctattaaattcggtctgtatatacatgatatatattatgcatattttcagaacatatgctgtgttaccatcttctgacccaaagagaaaagctgcagtaaggattttttcaggactgtaattgggcaaatgaccttgtaacgcagtggtctccgacctttttggcaccaatgaccacttttctggaagacagtttttccacgaacccagggttggtggggtagggatggcttcagtatgaaactcttccacctcagattatcggcattagagtctcataaggggcatgcaaactaggtcccttacatgcgcagttcacaataaggttcgcacccctatgagaatctaatgccaccaccactgatctgacaggaggcggagctccggctgtaatgctggctcgcctgccactcacctgctaggaacaggccaaggaccactatcagtccatagcctggggactggggacacctgttacagaatttatactgttaaatgtcacttgatatgcacactaaacctattacaaaccacatattgtcacttgtcataattggacagagctgcagtgaggttttggttttaagtgccaactcacctctaagctttttcagatccttgagctaaaagtgtcctctttctgaaatcctattaccatttattgtatatctttaatgaaagttttagtcttttccttcatattaatgttattcacccatttggcttagcacccctcttagagataaagctctgtgaagatgtgtttcttactggttcatttcggcatgccgctaaatgtgtaaaacctagaagatatcccatagccttgtttgaataaataaagttacacatggtgtttcaagttcacctatttctttgactaccaaaagacttctggttttaataaaacaactgtgaagttcaagtcctgtgtattctaacactttgatttactcaatggcctgatagaaactgtttttaaaaattatatttacccttagcattttcctgagtattgtctttagctattggtggggaagatggatatatgtgtatgtgtgtgtgtgtgtctgtgtgtgtgtgtgtgtgtggagagagagagaagagatacatggacccattgccacaatcttttaattatgtgaaacaaaaaatatttaaataacgttgaggttatccatatcttctgtattatattctgtgttactgatttttttggatcaaatagtgatttttcatgagctaggtataaaaatattaccagggactaaaattaggggaaactgggagtaacttagagtgtagccagttgtttttctactggtgctaccggcattgaaagcaagagagttcctccctgtgtggggatggcctgtacatggcaggacctgagtgtgccaggtctccagcctttacactttggtagcatcttccccacacacccagtgtagtacgccctctagagggatccatttcttcagtgaccacgtctttggagagccactgtctagatttttagtgcacaaaaatggagtgtgattaagggttttctgaggatggtgtattgttttatgttttctgttgctccactcaaattcaaattttgctgttagacttatcattataatgaaattgaatgttggtaaatatttttgtaaagtatatgccccttttctgtgttgaatgggctacaggcattcaataccccgtaatacccaaaatatcattaatttccagaaaatataaaattgtcacaaaatctaaaaactggaatattaggaaaaaggaaagaatggtttccataaatcactttgtttaacatagtttctatgtgtttgtctgagtagttgttttattagaaaattgtaatttcctctctaaacagagcaaacatattccctcttcttcttcttttttttttttttttttgagatggagttttgctcttgttgcccaggctggagtgcagtggtacaatctcggctcactgcaacctccaccttccagttttaagcgattctcctgcctcagcctcccgaggagctgggattacaggcacctgtcaccacaccaggctaatttttgtattttttttagtagagttggggtttcaccatgctggccaggctggtctcaaactcctgacctcgtgatctgcctgcctcggcctcccaaagtgctgggattacaggcatgagccacctcgcccggccagctaacatactcttttgttcctaaatacagttttaaaagcacatgtcttgagactaacttgtcctttcctttgtaacatcagtcagttttgttaacaaagtaagtgaggaactataaagtttgcattttaggaaaattttgcatttagtatataattttatcttagcctgtgctttatctggcaggatctgatccatcctataattctacaattagtgttttagtcagaaatgcagtcatttacatttatccctttgacattttgccattcttattcatttatccagtcattcaatttcagaatactaactttgccagatactaatatcaaggactggccaattcattcatgagtagatgaataacataagtgtcctgactcaaggagcttgtaaactaagaattgtaatgttataaactatttatatttctctagtattttacaaattaacaagcaaaattgtgtgattctatttgtagtcaagtgacctcagaagctattcagtcttcaccatttcctaacttatgacttgatctcattctagccagtgacgctctatagtattatatttattatgtcatccttaacggtgtggaagttgaaggaccagaaagattcacacagacttgtctttgttcacaggagtagacccatgcctctagatttaaaaggttcatcaaggcagtataacttagtagaaagaataagaaactgtaagtctggggtgggatctggcctcagtaattctctggctgtgtaaacttaggtaagatgcttaattttaaacacagtatatccttctttgggaaatagaatataccttacggatttctttataacaattatttttcaacaggaaagaaggaaagagaaatgcttgcatggagccatcatttattcaacagtcactcatcaaatacttgttgaatgcttactcggtgccaatcacttgtccacacactggaagtcaggagtaaatacaatcataaaaattcctgccctctgggtgcttacatttctggttgtgttatgctgcagggagaaagaggagattttcaaaggtaatagtacctaataccatctgaaatcctaaaatttctgccttactgtcttccacctaccatccccattggggaaaccttaccttagaggaggccactatatagtggatatataatagtgtttgtattttatatcttttatcactgttttctgcacacagtaaaacagtgataaaagttatcactttcttaagattttgaggttgctgtacattctcatttgtgaacaaaaactttgctctgattacgtaggattcatttaaaatccatggaatcttttgacactgaagttagaagttcattttatcaacaagtgaaatagtctcaggcacaaggtggaaggatgtgagtcctaaaatcttcggtaggagttggctgggcgcaatggctcacgcctgtaatcccagcactttgggaggctgaggcgggcagatcaccaggtcaggagatagagaccatcctggctaacacggtgaaacctcatctccactaaaaatacaaaaaattagccgggcgtggtggtgggcgcctgtagtcccagctacttgggaggctgaggcaggagaatggcgtgaaccccagaggtggagcttgcagtgagccgagatcacaccactgcactccagcctgggtgacagagcgatactctgtctcaaaaaaaaaaaacatctttggtagcagttttacatagattcccttttgacagctcccaccccagcaactctgtaccatagttattggtaagcacatcttccagatgtgggaactgtggcttagaaatgctatgaagccagttagtagaagagctgaaattagaacttggtattctcaacctcaccatctagtgtgctaatcttttttgtttttgtttttcttcctgggacagataccatttgtgacctgttgagtgagactgatttagtccactgtgttaacaggaaagttgttatagtttttttttttcttccgtattgtttttaatggcaatgtaaaacatgtgaatctgaaaagagaggttctgagaaatttgtgcagctcctttttccaaataaaagatagatttctcttgatgaagccttgatggttggaaattaagacaagaactgaaagcaaaacagcctactcaaggttagacagtgactcgagtcattccatgcacttaaacaatatttaggatgaccctatgtaaactcacattatcacttaaaagccagtataaaaatactacccatctgctgtgctagtcctgctgttgcttgccacatttctctgacaagctgttacctcagtatatagagagagtatacattttggaatccggagtttaagtttgaaaaaaaaaaatggtatctggtacatatggactagattctgttcttccaaatgtagatttgtaacctcatttattcttaaagatgatgtgttaagttagctttttttcttgactctgaagattgaagctcttataattttatgcctggacatgaacaatgtacaataggaaatcatttagtttacactcgccatatgatatgcaaagtgggtgttgggaggtgtttatatcaaacaccataactaagttctaaaccgctctctggaagctatgtaacttttcaggtattaaaggtttggaagatttgtaggtgcagtatgtataattgcttccatacaagtaattttttagtgccaaaaaactctaattccataatttccagtgccattataacagccgagatgtaatcttccttcttaataggtatttgagcagaagaggcaagattgaaagttagatcctcaggcttctctgatgcatcaatctgcggataaagcctttagctaggaattacaatctggagcagacgtgcaagatcactgagtcatttgctgtttttccgtgggacaattacttattctttttctgcagatttcctaggaaatactccaaagtaaaaaatatcaggagcagcagtatgtgatcttccttgctgcttattgttcatactctttatcgcttctcagctttttggctaagatcaagtgtattgtttatactgtctccacgattttcctggaaatcctttttggtgaatataaccttgtgcattacttgaaaatgggcattttaatcattttttcattccactaatatttattgaatgatcattatttgtaagatcttaggagacctgtcaaagacaagcacgggctcatcaaaatcttaaacttgtgtatagagtactaaagaaggagcatgtgaacatatgattttcagaaaattgagaagggaagtgagtggggagccctttgagactggacagaaacaagaggaccatgacactgaagaggacatttttaatttcatgttcaccctgagattggtaatcaagagtcttatttactcagagcaagccgcataaatcaaaaccacaatgagataacatctcacaccagttagatcattaaaaagtcagggccgggcatgatggctcacacctgtaatcccagcactttgggaggtcgaggcgggcggatcacgaagtcaggagatcgagaccatcctgactaacatggtgaaaccccgtctctactaaaaatacaaaaaattagctgggcgtggtggcgggcacctgtagtccgagctactcgggaggctgaagcaggagaatggtgtgaacctgggaggcggagcttgcagtgagccgagatcgcaccactgcactccagcctgggtgacagagcaagactccatctcaaaaaaataaaaaataaaagtcaggaaacaacaggtgatgcaggtgatggagatgatgtggagaaatagaaacaattttatactgttggtgggagttcaaccattgtggaagacagtgtggcaattcctcaaggatctagaactagaaataccatttggcccagccatcccattactgggtatacccaaaggattataaatcatgctactataaagacacatgcagacgtatgtttactgcagcactcttcacaatagcaaagacttggaaccaacccaaatgtccatcaatgatagactggattaagaaaatgtggcaaatatacaccgtggaatactaagcagccataaaaaaggatgagttcatgtcctttgtagcgacatggatgaagctggaaaccatcattctgagcaaactatcactaggacagaaaaccaaacaccacatgttctcactcataggtgggaattgaacaatgagaacacttggacacagggtgaggaacttcacacaccagggcctgttgggggttggggagaggagggagggatagcattaggagaaatacctaatgtagctgacgagttaatgggtgcagcacaccaacatggcacatgtatacatatgtaacaaacctgcatgttgtgcatatgtatcctagaacgtaaagtataataataaaaaaataaattaattagttaattaaaatttaaaaagtcacactattaaagttagaagacatgccctgaatcttccagtcaaaattccttgtttacagatgggagaaagagtgaggaagggttttgccaatggtcacatagatgtcaaatatcatttactgagaaaatcagcataagaacccaggtctctctctttttttttttttgtttttttatcactcaagccaatagtttttccacccttttagttctgttatttgtcttctccactgttattcaaggctatctcaggccagaagcagaggtttgaactcttttcagatgagagcatttttgagactgggacctcatgttgaactaaactcacctccacgttggcacgcacgttacttcctcttccactgtataattttgccgttggattaaactcatgtggttggtgctaaggctttgaccacaggcacatttgaagattatacttatttctggatacaacctcctttgcctccaaactgaaaggttggaaggatgacgggaacaaactcaagtcaagggattccaaatggtcacatcttatgaccacaggctttatatttggagcgctaccatgattaatgtgtcctcgttgccatcctaagacttccatcattttcttccattgtctttctgacttcagctccgttgctacttctgggcagttataggtttctaacccaatagggcaatttcagtttcccccgcgttttctacataagttgtcctttctccacatatttgtttatgcagtttaagtcttgccagattgttctctctacgttctaaaatctttccaattttgaaagtcttagatcaagtactacgcagctgaaaatggctctgcctcttttatggcatttaatatctaccttggattatagttattataacgaccatagatactaaaactttgaaaagaataacaatttgaattcctttgtcctatccccataggacctagcattgcctctttcaattaataaatgtgtaaggaataaattattttggcatattatcccttgtcttttaaaagtttcacaggagtccctttgcaatcaagttaaaggctataaaaatttaacatctagttgtgttggcagagttgtcagcatttacttcagtttatcaaacttcaatatttatttaaattgaaaccaatcagccatttttttctatgcaaatcacaaatctcatttattaatgccttcccctccccctttcccttactacatcaataggaagattacatcttgacatgataaaaggagacaagctttcgttaatgttaagaatctgctccatggccccctttgcccagaaagtcatgaattctgataatcaaggggcagttgcctatgttatttttttttaagtttctagttaattatttgctcttccttatttgcattttgagatgtaacagtagagcagtttacccattctctcctgaaaactatgagtctgtttcagacaaattactatactaggcacccaccctcagtggaggtgcaggagactctaggcccggaatgggtgaaataccagaagttgcatttgaatataatattgactaattagtcagccagaaatgagagctctaaacatgctctttttgtgtcatttactgcatttgtggagcatctaattataaagaaaataagtattcttcattggttgctagtaaagctgccactgaagggcaaaaagacatatagcaatcattgtttaaatagaagcgcttgaaaattttccattaattttcgtgtttgcattttgaatgctttcttgctcacacttgaggtatcaaactgaacaagtctgaactgactgcgtaagaatttaaggaagaactgggaggggtagaaatgaggaagctatttgcattcctggaagacaaaactcacgtttataatctttcttgatactaaggcagtttgtttcccaaatgctatttatggtgagctttttgtcttcaaatgtttgttataagactcttttttttttttaatcatccagtgcagaagttcatgaaagaaagtgaaagtgcacccatacccccattcattttccagagcttaccctgtttggtacattatcttgttggctcatgttttgcttggttttgtttatgcaactttttcttattaatttgttgttgtcgttggatggagttagggagggttaaaggactggagtaaaaatgctatttatctttaccccttcttcacttacagtgtgtgtacgttgatggagggggtggtggggatagagggtgattttacctgctccatttttgtttctatttgctgctaccagcttgcttcttaaccctgggcagaggctgccctgcaggcaggagcagaataagctgtctgtgcccttcctcttcctatacctttgaagattggtgcctttcactgttttccaatcgcttgttctttccataagctcgttcccttctctccactgctttgacaacaccttttagagttgctcctggagctgctgccaagacaatagtatgttttctcttttaaaggtctaaaccctgggaggagaggaactggaggaattgagtcaatataatatacgaatcactttatattttactatctataatttagtttttgacttccatttctaaggaaaaaattgttttcttttattgttttttttttttctgtttccattcagcactcgtgtactgagaatccccaagctatattaagtcccatttgggccattaatgtgtgtgcaacatggtctgtctgttccagtagagaaaaaggcatataaataactttcttatcactggttatatgctttgaaggagtacaaattaaacaacctgtggaagttcaagtaaaagaaagcttatttccagtcacgagaagttaaatgtgagctgggcagattcataatagagaagtaccgtttttttgtttgtttgtttgtttttaactctgagggccctgtgagcttggtcaatttacatcatctcatgaatgacatagggccctatatgtggaaacaaataaacaacaacaacaacaaaccactgtagagtcatatcaaagaaaaatgaaggtggtattcatccacatcaatattaagataaattattaaatatttataaaactctttgacagtgtacagcctctataattaatcaatgtagcactttctcaatacttccccattttaattagtaccaacatcaatcataattaggctcatgctttggtctctctgagacttttaaaacatcatgggtagggggcatttttcaggattcaggtatcagctaagagttcatttagccagtagatcgtgaccattcttcctctccctgaagctatgattctggatactgtggctcttcctgctcctccagacatagagaaaatggacaagtttctccttccccattttgagtgcatgaagtgaaaacttagcttgtccagccaaactggaggaaggagaggcgggacttattggagtaactgaaaagagaaaaattggaatatgagcagtaccaatactcagtctcttaaggaagggtagagtccctttctttctctctctgtaatttttttcttttttgttttttttttttcaaagaagattgcataagattctgtctctctaggagatgactgatgaaatataccccctgggtcatttgcatcttactcctttgtagtgtagggaagaacattccaaacccattataagcacttactgttgttgggcatgtcataacaaacacaatacctttctggaatatactgctgagcccttggctttttgctgaatttgcctaaaagcccttctgcctattgagtggccacattctgaactagttatacttggttaagttttcacacagtacactctgggatactagggttgcaacaatttaaaaaagaacatagatggaagctttatatctcaaaagctcctacctttgacttccctgacaatttttccttctcctgctcttcaactctatgtttcccaactttgtttttgtaaacacgaaaagtaaattttttaccattttgtgcctaattcctcttctttctctcttctctttttactcatcacaggaatgtcttagctttccttccttctccaatctgccttgggtatagagtcacgcctttaaatcttttagcataccacaatgtaacttacataaggaaatgtttaatttgggaacctcagttggttttgttaacactgctgcaccgaagctctagctgaattcacataatctcatgattttagtaaaggtaacaaaggaaaactattatgtaagtacctacttttcaacaaacattgggctgggtttcttctttacattttctcatttaatcttcataataaccctgctagataaggtttaccatctcattttgcaatgtggaatctggagcccagagatattaaataccttgtacgagagtaggtgtgcaaagctaaactttgaacctaggcatctctgacttcaaagtctatgctttttccacctcatagaaagaccatccagaagatcaagtgttggaaccttccgaggctgtgacatatttattacttcaaagtttattatcacaggacatgcatgctgctttagcaactagaagtgtgtgaatgaatattactattgtgttgcataagtccttggcaatattactttttaggtgccattctaatcctgccctgtttggaataattgtgattacgagggcataggagtaattcagaaattttttgaagaaatttctccacacagcattagccttagttatgagtataatacaaaagaagaggaccagcactgctggaaggtaaatgaaaagatggaggaattgaacgattacataacagctgttcagacttgtggtactgattagagtcatttgtagagatgaagcagtgtgtctagccagtgtggggtagggtatactgggaaggtctcacagacagagtgaagtgggttacggcaagccctgaggtatggcaaaatctggacagctagcctggatcttcatttttcattagttggcttccttaactgctcaacaagtagaccaaacaaacaaaccacgcatacacacaaagcaaagaagtaaataaagaatggtggggctaagactgtgaatagctcctagcaaattagagaaatagcttcaagtatatgccttctggatgatgtatgtttgtatatgaaggacaacacatcaaggggtgttggtagtaatctgtgctaagcttagaagccagtatatcattgttctagttctatttctactgtcgagtggctttatagccttagacaagtcatgtaaccgttcaggccccaaatgtccttctggaattacagggattgaactggatgaataaaaagttctatttcaactccaacatttaataattctaaagttcttagtgagctctgattgctcatttgcattacataggcatatattaaccattttaatatgtatcagaaaaggtatgttctttttcctcagaaatgttgaagcctgactttgttatagaaagcacccaggaatcatgtcttcagagttcctaatttttagtgttttcttgtactgccccgactgctgcaatcctctctcttacattggaattctgttttaagttttggtgattggaatcctctttttgatttaagagaaagaatcctaggggtgaaagattactatactggaaatgaaagattactagtctctaaatgagaattggctttggtctgtaatagataaaaagatttttaagggaaaaatattagaaaagtgaaaacgtttttaaaaaaaataggtagcagtcaccaccgtattctggtggaatcgaattcttgaagattagatttgtgtattcatggaataatctagacaaaatcctgccttgcacatagtggggagatacactaaaatactgaaacagctacattgtattcaggtgaagctacatagatgtaaataaagggcagccagcgggtacaagctgtcaattaagtgttttcaatagtctactccgtgtcgccacatcttaggtaatttagataggtagaagacaggtcattagcactgaagttgagaacacatttgaactccagaatgggattaatgcatctccaaaaaacgtgtattttctaaccctgtgcaaaaattatatttgaaaagattaaaacaaacaacagttttcttcgttctttgttatatgtctttgtacttgaaaaaggtaaaattctgcattacgttttaaacaaattgtgccagggtaaagggtaaaatctccatcaacatctaaaggtctttcttgttcagaaaatgaaggcccctctcctgcattaaagaccaatgtggccttatagatccttatacagagggaacaaaatgacattagacagactctaaggtgccctcaattattcccacgtggtggtattcatgcctttgtgtaattgcctcccaatgagtgtgggagggacctatgatttctagccaatagaaacagcaaaggtcacatgtagtctttgatgacttgtgtgtgattgtgttatataagactgtaacatttgttctatgaggggactttcacccttgtaggctttaaagaaacaggctgccatgttgtcagctgccacctggagaggtccatgtggtaaagagtgagggcacctagtagctgacaagaaactgaagccatcagtttagcagcctgcaaggaaccgactgttgacgacaatcatgcaaacttgaaagcagatccttccccagtcaatcctcagttgagactgccaccccagcctaactttgcttgtagacaatgagaccctgaggcagaggacccatctaaaccatacctgcacttgtgacccacagaaactgtgggataataaatgtatgttgttttactctgccaagtctttattgttttatagatagctaatacaattatgttacttttagaatctaacattttcttcacctttcgttttctacataatagttactaagtgaatgtgacttgttatccccatcctcaaaatcattaagggtcttttatttaatatttgatttatctgtggctttgtgaaattcataaatctgctcctcagtttctggtatctcttcaggagagatgccctcttactctactgtatatggaagttgaataagattgaaactgatagagaaatacttgttgaatcaagttgaattacatgaaatgggcttctttaaaagctgttattaaatcttcctgtggctgtcctagagatgatataacagaacttctgctgggaaatgggagagggggagggaagcgttccatgagctgctctgtcatttgcatgccagtgaaattaagtttgaatttacattaagaggagttttgaaatttaggatctatcttaccaaatcacaattcagcctaacaaatgttatggaagtacaacaggagcccggactgtccattgtcatctaaatgatggatgtgtttaaggtgtttacatcagtgctgtttctcccacctaccctaggtctgggtggttgcctgggattgtttactcaaagacagtagcttgacaatttggaaatgacagaggacgctgatacttgaaatcaaactgtagccctggaatagcccaaacatggtcccagggtggtcttgcttctgacttatgtggaaacggccaaatcttcaactacattctgtagcttttctttattcacccagccaactggaagatgagtacctatcttggaaatttcccagaagcagcaattcatactttccttataactcttaacacattgctttatagtttctgttccaatgccagcaaagcccctctttgaagactcagtttccgtcatgctgctctcttacaacacgctttcctcaattctgaatgaatgagcagatgaggatgctgaaatgttagcataacaaaccaaagtcttcttctgttgcgggacattacatttaatgtagctttatacagctcagatttatttctataggttaagcattttgttaaactattcctaaaacacttctgaatgggtcaccagaaagaatatggagcaatcaattctactgtaacctagccaggcaaatattgactatttcctgataccagcatatgttgtatatttctgccttactctagtgagcagaaaatctgtgaaggtttttaggaattgcctaaagacacgcagttctcaaatggcaggaaggagagtaaatcctagtctttctgattccaaactttatattttttccattaaatgaatacagcatacttacatacatacataagtaatacatacattcatacatgtattcagctgtgaacattttttgggcaccctcaatggcccattcgctgtgttggatgtgatgagggatatgtagatgaataagacctagatcttgcccttatagggaaaaataagatttaaataggttaaatcctagtcttgtgggaagatagaaaagatgcacaaaacgaaagccagactcaaatgagtaaagttagattataagtctgcagatgtaggtaggtaacctgagctttccaagaactgtctcctcacttgaagaatggcagttaataatctctgctttatagactggttgagtggattgaatgagaacacatgggaagatgctggcatttaataggcaacccataatagaaatgttaacatgtgctctggggtatcttcagaggtattgggagaggagtccctgcctaaggaagaagcagtgctgggcagaggaaggaatgtggacttggattggaactcagtggatctggtctccagtcacccaacaagccatgtgactgtggaccaactactaactgcataggcaccttggattccacaattgtaaaatggacatcactggaaagccttcctcatgaagtgattagaacagatgcagataatagcacaggtgtggttgaaaattgtgaacattcatggaaaagttcacttgttttttttttatttgtttttgttttactgtcaagaatataataggagccactcaatttatgactctgtcctttcacttattattaaaattatggtattccttttgccactcctgtggacaacatagccaagcaaatgagcattttagtctttctcgtcgtcctgtcttagtttgccaaaactttgaatactctgtgtgtgtgtgtgtgtgtgtgtgtgtgtgtgtgtgtgcgcgcgcgcgcatgtttagttgctgttgaaaatatttgaccactatgaggaactggtaaatttgcctgtgctcaggaatacattacatggatgctctggttagtcactttgtactttacatctgacttttcctccatcagagacaaaattaataataaacaatttttaagattttggataaaaaccttattaaaatgcatggcatatttttcttttttcttatggggctattctaagcatttgaaaccttttgatgactcagggtcatcaccatgaccatctattgttatgctctgctgaaactcagtaattttttcctcctatccccccaggctgtcagcggccatctctgctgtcactgtgctgcctttcacagtctttcccactaccttctaaagttcattggttttaatctcctctggtatgaggaagaaacagcaaaattgtcattagaatcattggtgaataggagtcaacaaacattcactagtggcccaaaggagcactcatcagaggaaaaaatgttgttttattttgaaaaattgctattttataaacccagagctgctactcccccttcttttcttctccgttctctttcttcatctttttctttcctttccaaccttcatgaaaactggaaatatggactatgacttcatatgctcttacttaccctctgctgggattttgttctgaaattgtaacaattagaggagtgtttctaaattggatcgcttcagattgtctcagttctctgtgactttaagaacaagctgatttgaagccacatactgttggcagctttcatccatttatttggactatcaagcaagaatgctcacaatctttcatatgaaagaagacatctttatttccagttcacactcttcataataagaagggtatttgaaataaagccaaaaagcataacttacttctctaacttcatatttcagatgcctgcaatagtgggagaacatttttttactaccccaccttaccctcaaatcagtagcagaaaataacagtgatgcattcagacagcaaaaagagaaaataataattttattaagtttacaggaaaggtctcagctttcttaaaagcctatctttaggaagtaagtaactggagctgcacacccaacagaggaagatgactttacttatcatttacttagaaattatctttgaaaggatcattgtgctgttgttagcaaaaaggagcttctgtaaatgtcacctcaaactttgaaatctgggaaagtctcattatgaaacgcaagttttatctttcatactcagcgctggagcactgagtatccttgcattcatgaagactttctggtacagagtaaacggagctgggagcataagtgagaatgcagctccagctgacagacccccagctctatcttcccaggtgcatttcctttttttttttttttttttgtgagacagagtctcgccctgtcaccaggctggagtgcagtggcatgatctctgcttactgcaatcaccgcctcctgggttcaagtgattctcctgcctcagcctctcgagtagctgggactacaggtgcacaccaccatgcccagctacttttgtatttttagtagggatggggtttcaccatgttggccaggatggtctcgatctcttgacctcgtgatccacccaccttggcctcccagagtgttgggattacaggcgtgagccaccgcacccggccgcatttcccttttgtacactaggagctaccgagtaccagaagtctttgttaggatgcacagttctttgctcactctgcctgggacagtggctcaacatctccagtcccctttgagttacctccagaaggttcaggaagagcctttccctccaaaatgttcatagcatttgatctaccttctctaagataagcagcttttgtcacattgtacctagggtaaagatttgtaatgccttaactctatgccatctgtatgcttcctgcggacaggatatgcttctaatttatcagattcccttaagaaactacaccatgatgcacttctcaaagtatgctcttaactaatacttatgggaggaaaaaaggaaggagaaggaaaaggagggaggaaggaaatcgtgtaattgcagaaagtttatgtctgggacccttgtgtaataatgttaaataatactttgacttttacgccatttttctatatacaaaattctttcacatctattttcaccactatcctgatattgtttgcatgatgtgtagtatgtatgtttttaatgtgtgtgcatattgtttgtctctcacacatacagcagccccaacactgacaaatccaaattctatgagtacagggagtttgttgtgttcactgctgtatccccagcaccttgaacagcacctttcaaggaggaagaacctaattcatgtttgttagaagaatgaatgacaatattgtcttatttgatcttcaccataatcccgtgaagtgaataccgtattcatactgtatcctcgtttttttgcagatggcaaaactgaggccttgagacctgctcaggtttgcatagctagtttttggccatggcaagatttgaattcaggtttttctatttccttattctctcctttttgtcttctgggaatttgctatattaatagcaaagcaagaaatgtcacacaaagaaaaattgtttccaattttaaattcatgatgcatatgcaagaaattactgacttttcaatccaatggtaacacagattgtgtgatttttaggaggaagagcctttcttttccatctcttgcgtttattagcatatgtgtcagtgcacacacatctacaccgtgcagctctcaccttgtacttttccagtctgaattcgttttgtaggctgtccctgccctgactatcccaggtgcctatcagggctgtgtcttggtcaggctaaggccaagcaacaggcaccagcatttgttatggttaccttggcaagtgaatggggtttgagggaagctggagagcaggcatttcaggagtagaactaggccagtctgtttttgtaaaaagttgatattcaccctaattgtagctcatgttggcaagcggagtaaacacccatgcaaattactaagttgtactgaatgtccaaggatgtcaataatcatcttgaaatccaaataaatatattttttactgaaacggaagccaggcaccacatgcagtttctctctgtcactggagacagatttggcacatatgcatgagacagagaagggcaactcttcaggccctaatgcacacaggaaactagggatgtgtatatcatacttggcagcaaaatagaggtggggcagccatcactttctgttctcaagcacctctcttttttcctatattttaaaacaggatgaccacaaagaagaataaggtatacagtagcataggatcctaaattaaagcatgagggaaagctagcattagtttttcatctaaagtccatttgggtaggaatgagtcagtgcaaaactgtacaaaggtgatcttaagtcacatgttatgttaccgactctgtggcaatggctgtgagtagtccaggaactctccaaggcctatttttaaattcacttagaccaagcataatgaggtaaagggatgtctatacacattctcaagtttagttctctgaccgtgagtcagactgtgggccatggacctgggcgtctcagtggtagcaggactcattttttccccttttctttctcataaatgacttaggagacacattggagaaccctatgtgctccttttactggaattatcttttaaggaagtactgatttcacctcctgtacatggtttgctgagatggcctattggggtttcccaccagtccacaactggaagtttctatttgcacattttgactgctagttctatatttagtcaaaagcctgccttttgcctggtttcttagggaaatagtctgtaggagttgctgtgtccatttgccttgttcacttgggtatttatttgactgtataccctgattatttcctaaattaacaaaaaggcacagggccccaaatgaaggaagaccccttgtaatttgttaaaaaataagtttatgaaaatgtgtcgtcaggaaatcagagttgtgttgcggggtggggagcatgatatacatttgtgtttgtatgtttctaattgtctacagatttatggcctactgtaacaaagccattgtaagtgtacagtgggagggtcaagaaaccttattctatggattcaaacacattatgcatacaatttacacgtaggcacaaaagtatcccttcaaagaccctccaataagctatggtatagttgaggaaacactagacttgaagtcgggaaaccggagtgttgtcattttaatctcaggctatatctttacatgaacaagagaactttgtgttatttttcatattcgaactctttgtgctgaagattctgcagtcaaactgcaagacacatacgcattggctgatcagaaatgacataaccattcttactgcactgagttgatattcagtcaataaacagtctaatctcggttaaatgtttgcatatttttagacttttaaaaatttgaaatcagcctctcaagttccattagacagttttatcacggacacatcaagttccatgtacaacaggctgagaaccattaagctacaaaatttctaaaattttctccaggttctcagttgctaaattctctcttgaacatttttggggataaaaaactggcagagaaaaagaagaaagtacacctttttacattatgaaacacctatgttcaccttatccatggagttatgccagtgacctaatgcctattaagttcttccatgttccaaaggtctttctgtacttgaaaactcataggtgagtcaggtccttcactgatagcttatagctaaaaaccacttgggagaggggctgtccaggtcttatgtcaaaactttgtcccatacgctgttagtgttagaaatggagccgtcagcaaatagaatctgttgtttcatttaattacttttcaatatgccattaccagaaatttttatgtaaatacatattttattccctgaggcttgtcaatctgagaccaaaattatacaacactgaaaaaaaaaaaaacaaaattttctttttactagttctctccctgtgttactgtgtcatctctcatgcatggtataggatgatgatggtgctcaaacttagccaaagactcttttgttggtattcaattggcagaattaatgaaacaaatattttaagatccctgaatatgtgctaaaagcatataactacactactggctagtcagtaattggtgcctcagaagagttaggtatttattcatttaccaaatacttatatgtcaagcactgttccatgtgttttcttaacccatgtcattgttaaaacaaccctttgaaatgtgggtactgtgattatttccattttgcattgaggaagctgaggcacagagaaagtaaggaacctgcccaaggtcatactatcaattgtagtggtgcaagacagtgggctctgaagtatgttctctctatgacgacactgtgctctgagggagtgagagaaggaggacattgtttggggcccagtgaattaatgaacaagatatctgactaggatctgaagactagcagaattgaccctacagagaatgtttgaccctacagagaatggctggctgttggtgttcacagccgtgagcatagtgtggtccacagcctcggtgtggaaaatggtctctgtggttgaattgagagaagagcaaatgaactggtctggaatagggtgtacacgtaagtagaagataagattgaaaacaaatttagtgccaaaatctgagggaccttgagccccatgccaaagagtctgtataccttatctaatttgtttaatggggccactaggcaattacgggtccgggacccgcatggcaagaatgccttccatccacagcagcccttgatgtgaggtcagaaagctaactgctaaacttgcagtcctgagggaacaccctcaaatggataaacccagctaagcaagctggaccatttccttgggaattattcacctctcaatcaaagaaggaaacttcccaaattcaatccatttgccttaacgtggtgtcccattaccacgaatactgagttgtatacattcttccctagctcccttgaacaagcttctctactacttttcttaaaaaaaaaattacccatttatgacttatttattatttatccccttcctataagggaatgtccactctttgagatcctcattcttcctccatcatgatgatgtgatgatgtaatgatgtagtcaaggcgcttccctggcctaatgtgtatgagggcaggctttgaagtttgacagtcttaaagctagagtggtgtcatgcattgctcacctctctaatcccagatttcctcctctgtataatgggataaatacctttcctatgaacattttcagatttttaaatattaataattcatatgaaatactcagcccagagctctgtacaaaatatattactcaataaatgtagccattgatattattaataatattattaaatattgagaatgaattctaccaaagtgcatggcacttccagtggctgattctgttttatgtagccacaggcctttaccaaaggcaatggcaataaagagagggcacagcaagatctatactcctttaaactaaggtaacccacttcagttagtccccacagcttctcttgcaactcttaccctattagctgtttctggggagaaatttaatgggcatagatactgggtggatagaccataccccagtgatactccagagagtgaaaaagagaagttaacacagggcgtgacttcctatgtttaacttgcagttcttatcttacgttgcccatcagaattatctgtggcatattctaaccatattcttcctaggcctcacccctagagatactgaattaattgttcttgtgggtagagtcactgttatgctttaagcttcccaagtgattctgatgggcagccaagactaagaatctatgatttagatagaagatgggaagccgagggaggccatgggaaagctctgatggtgagtatgggaagaatcaacataaaacaagcactcaacaagtgtgcatctagttgaagccttgcttctcctgcatttgttatctcagtgtgctatttaaaagcagcacaaaaaacaaggagtgaagaccttgatatcaaggatgtgaaagctacttctaatcttcaaacagatattaggcaggggctttaagacttcaacttgagagaaaagctaaggcacctggtatgtgtgtgctcaagtgaaatatttgtgctgactgagggcttcaatgtcaggctgtctgaaaggacacaatatcaacagctttgctgtgcttgtgtatgagtctttaaatgaatatatctggttatagcttatctcttttctccatgctccctcatttccaatttccaggtaatggagatcatctagttcggtttcagctgctttattttgcagatgagcaaacccagtgatgcctgtgatctagatggaggcagatttcctctctcccccaccctggtataccatagtctgttctaatgctgggatcaaggatgaaagtgctaatttgggagtgtcccccactttcttactagctgatatggtttggctttgtccctacccaaacctcatcttgaattgtgatccccacatgtcaagggagggaggtgattggatcgtgggggcccttcccccatgctgttctcttcatagtgagggagttcttatgagatctgagatttttaaggcagttttccttgctcttgctcgcttctccctctgctgccaccttgtgaagaaggtgcctgcttccccttctgccatgattttaagtttcctgaggcctcctctgccatgcggaactgtgagtcagttaaacctctttagaaattacccattctcagggaagttttttatagcagtgtgaaaatggagtaattcaatgaccctttcttactgactcattggtctgatttcttgaccaaagctctgaatattcccatgtcatcctgtctaaccagctgtcttatactctttttttttttttttttgagatgaagtctcgctctgtcgcccaggctggggtgcagtggcacgatctcggctcactgcaacctccacctcccgggttcatgccattctcctgcctcagcctcccgagtagctgggactacaggcgcccatcaccatgcctggctaatttttttgtatttttagtagagacggggtttcaccacgttatcttattcttaacagtgtctgaggtatttttttgaaacacaattcttaccttaactgccccaggcaccacggcagaagaaccatgaccttgctgagaggcactgcatgccaaatgagacttagtttttccaaagtacttgggagaagaaaaacaataatctatatgatgggcttttggcctaaacccatatcctttagatgacggaatttggcacagctcatattctggtttaaagaaaaatgttttgttatgatgtcatttgcctaattaatagcaaaagaggattgaattttccctatgcaatgtcatctagcctttgagattttagagttaatgactcaaatcaattgtcctgtcttctgtgaaaccttcctgatgccttcagttggataaatctacccttggtgttcataaggcattatattgatgcctctgatgttatgcagatatatcccttcttggctttgtttgcccattcaatgaacatttgttgaacaccacctatatgccaagatagttggaagatggaagtgtggtacacagaggatgtggaagggaatcacagaagatgagactatgaaggcaggcccttcaaggactttctaagtagtactcaggagtttgacaaagaggagctagaagaggtttgtgaagtcagatgagtaatataattaggtttgtattttatgaagggcaacatctaaatatggcttgtctattcagcaagcacttattaagtgccttttgcatggtagacaacatgcttgatgctgaagatacaagaaaaaatttaaaatggtccttgccctcaaggagctcacagtctattgagttacctttctgactttcccactagattgtgagctcctggagggcaggcactttcgttcatctgaaaaagagcttaaatttcagtgttaatcctagattacaatcccgcctctattattttaactttgttcacatctgttaactgctctgaaaatcagagctaatactgcctacctcatcagggaaagattaaacgagaaaagaatgagatgtgattgacacagcaggagctctgtgtatgctatttcctcctctatctctgtgcctggtacatggtaaacattcaggacacttctgctgcctgcttggctggagagcctgtctatgcagcctcagtgttgggaggatttgagcctggggtcggcctggcacccagctatggtagttagcaaatctatcctcagctcagtcagtgatcaaatcactggctctaggctgtaaactaacagggccagaattgggttctggactctgaagcccaggcatgcatattgcaaaagtcagaatcgaagtcataggaaaatgatgaaatttcctttctggccagaatgctattatttcaccaagggcaacaaatcttcttggcaggaaaagttgacttgcttgtgctttgtgtaatcaattgtatttgcaagtgatggagtccttctcacagtggcttagaggaggtgttaaccactattctactctctacttccatgagatcaacttttttagattccacacttgagtgagatcatgcaatatttatctttctgtgcctggcttatttcactcaacataatgtcctccaggtttgtttgacatttcattgttttcggagaattttcacagttcattatctcacttcacagttcctaatagtctctctgaggtccatatggtaagaattagtaccctttactatatttgttgaatcacaagtgagcggaggaatgggtatagttgagacccacagaagtgaagtgacttgcccaaatccatatagcttattatgctacctgtttgttagaggtttcctgttgtatcagaaactagtgagataaatattagtaatttttgtcccattgacacatgatggtatatcaggaattctgagctcattttttttttttggctcaataagtgaccttagaaaatccagaatgggatttttaagttgaatatccttctctgacctgtgaaatcactgcatctgtttccctgactttatcacaaggtaacccaagatattgccaatatttacatgtgacaaactctgaaagatgtgcataatgctcccaaaggtcatcatcttcatacctaccttataaagtgcaaatggaattgacctagtctagaataagcaggcgagatgcagagagattatgtgacatagctaggtcatgtgactagtatgcagcaggcttggggcataaatcctagtcctctggctcccgagtccagtgttcattacgctatgtgacatgtcagtattgctgtttgctcggggttaggcttttcctttggaggttagagcttgataactctaaatcgataaacttcttagtatgccacagtaatgctagcagaaagtatttgttgaagcaaaaaatatgttgtttcaaggggtctgctccctgaaagataagtttttttctttatttgtggttttacatctaatttttctaatgtttcaaaaaacattctgtgttcctttaatctacaagttggaatggatacggtgccctaattttcgtgttccctttgagcacaagcaataacacattttaaaggatgataaatagctgtgtaaaatgtagatgggttctataaatacttaccaaaatccctgtagtcagaccctggtagaaggagagaatagtcaaagtgttctctctttccacattcttcttcttcttttaggggtagtttggtagttaagaacacagttgctagacccagacagactcagacttgagtcttgccctacctgtactacctgttagattttagggaactccttaattttcatgggcctctatttgtagaaggatgctaacaatattatgtgtagtttttagaacattcatctagtataatccctatacattttaagtaggtaattatgggttatctctcatgactgtttttatcttcatctgagaccctttctttcttcctttaagatacttctatccatatttttccctagagagaaacagtattagctactcctgcctgtcagtttaagctactgtgtcatgactattttgcatttctaagtttatccttacctttatcatcaaagtgctgactaatgcagtatctgccaccttgtgcctgctcagtaaatacaatttgggttaaactttattcatttttagttatgagtgcaatataatgacatagctaaaagttcgaaagtagagaagggataacaaataggtactgataatgccactcttgtaatactacatgtagctgactggtgaaggccatggactatagagtcatactggaatccaggcttcagtgccttgagtgctctacttagaaatctgtgctttaatttccttagcactgaatgagggcaataaaagtaaccacctaatcaagatgcagggtggatgaaatacatctgaagcatttggagtaaggcctggcccaaaggttagctgtaataataaaaaggtggatggtgacgatgtacatgatgatggtttgtgtgtccctttattcatattgccattcacaaattacttgagtagtcctacttctcctgtttggtttatttgttgcaagaaacatgtgcattagaagattgaagatgattgcgcccacttgaggaaaccggacccagagaggtgaaatgatttcctaaatagcacccagaaagtttatgatagagaggaacatagaactctagcagccaggctgctctattcttattttctctatacttttcttgttggaaaaggacactgttgactcctagttaccatctaacattgtggtccaagctacagagacagtagagcacattaagttctttcagtctggcttttatgctggctttgtgtgatagtgcctcatatccactgaaacgtaagtacttaaggagtggatgggaagtattcctggaaactcacagctaagcttttatgtaaagacagcacataaaaaaaaaaccacttttcataactttatggaacctgcaaaaaaatcttggcttccttcatgatgcttgcccctagagtgtcagcatagcccttgcagagaaaccccaggatacctgtatttctccaccctggccttcctctgagcattgagttgttagcatcaaaaaatcaccacagccacgttgatcctcattttcttcagcctctatagagcctgctatgccagggtcctgggtaatctgcagacagctgctgtcatgcagcctcatatatgggttgactttaccagcaaagaattccctcaccttcgagacatcactgacatcttcatgcacagcacagacaatgaaacaaacaaaaaagaacaaagagggacataaaggttggaggtcatttacatttgcatttacttgaaaggaaacatgctaacttgttgacttgactcacttgatgtactttttcgagatttcacctggaatcttgttcttgctagatctctggatatgcaaatcccatctttgtccaagacctaattcaaatgccaccttttcttgagaatgtcccttcatctcctgagctacaaccatctcccctttctctgtgctctgatagcacatcattaaaacattttacttcggattgatggacatttttgtgtgtctaatattttctactatatcttctagagggcaagacctacttctcaatatctttagcatggcacttactaggcactcagcaagtgccctttgaataaatgtattatttgcaatcatctcttcaggtatatgtagtttttgtgttagaagcttgctaggttgcatcttgcaagagaaacaatgtgatccttcacatgtacttgttcttctccgaatgactttctatgcaagaagcactggaggctgagttcatacgttcagcattgtcagcagaattgagtcctgaatgacctgggtcagtcactacattagatgatttgattagaaaaaagaataaagccagttataacttgttttctgcctattacccaggatatttagaatgatggagatgcagaagcatttagagtttttgatgatactcatggtggtatcatgaaaataacaccttgtgtgtttatggcacataattacatgaaactcattttattctcattagagtgtcaccttgaatcctgttctttttggtcttaatgtttagtgattagaacttgggaagcaatttctagaaccagaatggtcgggtacaaatcctagctccttctcatatcagctctgagaacttgggcaggtaatttaacttcatgatgtctcaatttcctaatctgtacagtggggcagccagagtacttatttcattgtattatttgagaagtgggaggacatagtgcatagtgattctataaatattactattgcaaccaccaggctttgcataaggccctaagtcaagaaaactttcaccgtttaacagagatgtttctctctgaaaggcatgttatttgagaaatagttgttgagatgaaaggggggaggcaagatagaggccagcttgatgagggctttgaactcagccctatcaacaagaagaccatagggctgcatagactgaggagaaacactctttgtttgtcgaggaaaaggaaacttgcaaagggatggcaccagcgcagcccgacagaattctctgtgggccacatctgttcatgccagctgttgtcagtgtgtgtcgcctcgccgagaataacagcaatgattttcactttatagcaacttccatcttgggatctcagaatgctgcataaatgtagattagggctcccaaaatttttgccaagaatgagcatactttacagagcatcaagaatgcgtcactcttctgagtgaatctttattggtgcaaagagaattaaacgaatattgaattagaccttccttcctgatgtgagctttcttcttgattttactccttattttctagatgaccttgaataactcagtttccctccttgacactcagttttcttcttataaatgaagggattcatgtactactaaatggtctccagtgtcttttctgtttctgaaattcacagaaggcagggaatctaaagttgcctcccacattttagaaaggcctaagttgttgtagaattgaatattttcttagcattttattcatgatatggtaagaacccggcagaaaatttttcagtttggtcactggaaaatgacactgtcctttagcttctaatgtgaaagaatatagtattatttacctgtttttccctttgcccacctttaggtacagtactatttattattttattttactattttaagatttaacattaattctctagcttatatctcagattgataagagcagttctacttcttttgatgagtcaagtgaatgaatgaagacattaaaaatgaccatgtcggccgggcatggtggctcatgcctgtaatcccagcactttgggaggcagaggcaggtggatcacctgaggttgggagttggagaccatcctgaccaacatggagaaaccccatctctactaaaaatacaaaattatccgggcatggtggcacatgcctgtaatcccagctactcaggaggctgaggcaggagaatcacttgaacccgggagtcagaggttgcggtgagccgagatgttgccattgcacactgagcaacaagagtgaaactccatctcaaaaaaaaaaaaataaataaaaactaaaaaacaaccatgtctctcaaagccttgtactcagaccacctgcatcagaattagttgggggtacttgtaatatttttggtttccatctttgtgcgcagagagactatatcattaaaaaatgtttgtccttaagaaaggttcttttgatagttcaagactttgtaatgtatgtgaaattccactacaaataagtggatgggttgttaaatctcactggcaaaaggcagatgagttgagagactgaggcacttttgttgcggttaagcatccctttctggaattgatgactggattcaaatcccaggttctccacttattatcacggtaatctttgtactccagctttctcatttgtaaattcagaatagaagccacctaatatggttgcactggtgatgaaataagttactcaatataaaacattttgaacacctactaagcactcagaataccttatttatactcttgtaaattatacataaattaatacataaattaaatactaatgtatttctacctttcagagtttgtgggaatggataaaagattccttcaatatgactactattattttaatcatggtcagtgattgattagaaatattaaatgttgctggtctttagattcactgtcagagcatgatctttcttcccctcggctgcagtgctgacgaataacactgagtcattcatattctctcatccaccttcctgccacatttgaaagacatccatagctcatatttgacagactgtgtgtgagcatttaatacaaataatcgtgcgccactgtcaaatattagcacatgccatgtgtcttcttatgtattactcacagtggctctcagatgaaggcatctacccagctcctctgcctactttcccaactccatttacaggtgaagacgctaaaggggggaacaaaaaacttgtgaaatgttatacaaaactggaggtataatttggcatttgaaccagcttgttctgcctctgaagcccacgctttctccattataccacaatcaatatttctgaaagtaaaaaaggccacattggtctccagcttctggtctaattagcaccatactttaatcagtgagtttgactgtcttgattaacctttacgatagaccatgtaagtttcatatttctaaatgaatatatagagatggctgtaaattagtggaaaaacactaagctggaatcaaaagactcctgcctaactcttggttctgccacttaatatgggtatgattttggctaatcacttaacaaaccactaacttggtttctacagaaagaagaaatgatttcatgcattggacaatattaaataatctagtgtgtgtgtgttgcacccaagtatcttttgactgtaaaagcacatagaaaggtgaaggaattttaatcccatggttgatagagtagaatgccacctcagttcctctgaattctgtccctcattcaagtcctaattcaagctctttaagcacacagtactctctctctctctctctctgtctctcttaatctgtatcatccattgatacacttgaataatatttatacatcatagtatatctttaaggatgatattagtttcttaattggtgtaggctggaccatctcatttaacttatggctcatgcctgtaatcccagcactttgggatgccgaggcgggcagatcacttgaggtcaggagttagagaccagcctgggcaacacggtgaaaccctgtctctactcaaaatacaaaaattagacagagaaattgcttgaacctgggaggcataggatgcaatgagctgagattatgccactgctctccagcctgggcaacagagagagaatccgtctaaaacaacaacaacaactcacaaagtaaattctatttaccccattttatttttgaaataactaataggtagtaaaattcagcatcctgcactggatcatacaattggtaagctgtggatgtgggatttgaacccaagtaagcagaccctagaacctatatatctaaggcatactgattactatcaacgttcaattttttgctttgttcttttatttctccttcatataccttgatttcctgactggattataaattctatgaactggttgcatctcactcattttgatgactgctttaatgcctaattaattactattatttgtggataatttaatatagatttcataggaggctatagtttgctacactgctcgtgtactctagaaacaaggacccttgacttttttctcttctttggctataagcttatcttcttaccatgttgagatactttgatttgattttcactggtcaagcaaaaaaacatgttcttgttattttcacttaggcactttgtctgcctccctgctgaggcccaaaaattcagtgtgatcggtgtgtctgtcagaaggtaggattgcttgcctagggtggcattgttattgaacaaaacacatgccctttctttgcatcctaagtgtcttggattgctgagccagaaccgctctgactcaaatgaaaaccaccttgtgttaggtgaaagatggggagttaaccatttgtttgctggtttgcatttcccacgaaaaactcaaaaacagaaatttacctcgccatggaaagtgatgtgccaagcgtcatatttgcatattaaaaccgaaaactgatttgcatgttatttcagtgtcttgtgtcacgttcaggcatctgtcaagcccactagacagaaacagcttgtacagtaggaaagtgtttttatgcatatcagactgaaaatctaggtgccttatttttatcagcaacttgtccacactttgggctctccaatctctcctaggttcatacctgaaaatactaaagaaaagtctggaaccccatgttttataaagtatgtttcctgttattttctaagagctatccatttttataatattctgtttagataattttaaaattataaagagaaaaactcaaattactcataatatcacaatcctgacataagtcttgttaacatttggatatattcacttctagtagctgtttgataatacttacataggctaacatatactggcccttttgcatatatatttttatacatttgtaattatcagatgtactattttcatatcttcttattttttggcactataatggcaagaattatgacaatccaagtatctaaaataacagattaataaaatcttattttgagcagacaggaaattagaaccagtcagggctggagccgtggcaaccgaaactctgtgccatctttttgatagtgctttattaaaactgtagcttgtaattgaggatagtttttctatgggacaatgcatagaaagctgtgcatggtgataaaacctttttttcccgacattagagcaactagcccattgcattcttccaggcaaccaaatgaagatgaaacgtgtgcctggagtcactgccaggcatgtggggcacagcaaaggccaaaatatggttttagtttgaaaacccaaccttgaataatggttcattctattcatcaaacttttaggtcatgggtcttgcctaggtgaagccatccaatggaaataatgtcttggaattctcttgcctttattatgtcaaatctctaatatataacatccataaagcctaattaatgggaaaaactgagtgtatgttttagccataacattgtggaaataggttcttttagtttcacacaaatagagatcttctcaccccaccgagaaaactcgctttctcctttacggagggcccgcatggaggtttagagggaaggaaccctgaaatgagaactgtgaataaggttggcaggagatctttgacctagattctcctcgactctgaggatttggcgcttctgctctgcgactcgcttttcttacttcttgcctacccggcaggataacatcagtggttgtaccttgtctgccgaagcctaagggaggctgctctgctctaaatagccaagcatgagctttactttactatttgtcttttggtcctaaaggcgagactgtacaagaattaatagttggagaggcagcaaggcatacgttcaccaaatgtcatgaatttcaagatttgtagctaaaaagtactcagagtaattacatcccttgctaaagcaacaattaatgtgaaattcgggtacactacactgaagtcctttatcagcagatggaaaagtggagagttactggagagatctcattctgcaaacattctgcttccaagaagaaaatcatctttgttagtggtttctaagttgtccctcttgataattataactgacatctatttgatatttaatatgttacaaagcttcttcatatgaatcagatattattattctccagtttatatatgagaaaatcaacaatagaaaaagaaatcactggagaacttaagtagtatcttagacatcaggcctaagagccagatgctccaagcccaggcactattatagctgccttgacacgtggagacggagagaggtgggtgtggagagacctcactttcccccagctcagcctagataaaacccttgtgtgcagagaccagggccccctgactggatgcccaggccttttcccagctgcagtaactcttccaacaactcctcctgtctgtaattcagaatcatccatccttggctatgactccaaatttggtttaagaaaaggcattttatgggcatcgatgcatggcatgagaaagggaatatgaggaagtagagattttaagaaaatcaagatttcgaaagttgaagatcaactgggatgagtttcaaagcaagaatcaaacttttaaagtcaaaatttctgggtcttcctctttgtgtccttaaaattcattcttcaataaaatggaacataagaatagaagaaccaagagcatgcttttctaatcccaaggagctgtgaggagtgttcatttagaagatttcaattcagatagtcaggtatccaccttccacttctttccttctctgtggccatcgcttttaacctgaaacagaagaggtatccagcaaatcatctgcccctggccagaaggggttctccttccatttaagcagtgagatgttgagagtagagtataattcagtgagagtcaaaaagtagaagcagccacaggaaattgcaaactgcagacttgacacagctaaatagaaggggggaaaagaacgaaaatatcagaaatatattttttctggcaggctttcagctctaaaacggggctaattctaccttttgaaaagaagataatttcaatgtttcttttttttcaagaacacataattgaagttattttccctctgagggaaggaacctcttgtacatcactacaaatggacaagaaaaatgagcagctctggtacccagagtgatagagtattcattatcatgtaatctttttgaatatcttggctgccttttcccggtgttttatccgcctgagcggtgcttttctggtaaggttcagatttgcagtaaatttgagttatctaacaccatgtaacaaagaaatcaacagcaggtaagcactcaagaaagaaaaatgatcacgccaaggtcagccccagaggaactcagggggctgacattgcgacagatagtgggtatccattttgtaaattggatccttagcacacaggttaaagtaggtaaattgtagtaacaaagatgcaagatggtgtggtgttttcctgggagccatttgcaccttagtgcgggctgtttcccatgcttcctttttcctttagaaaggatgatggatatttttcttctccactcagaaaaggggcagtgggatgataaggtgattaacctttgtgtgttcttgatttcatgccccaagtgtagtgaaagttcagtaggctgcagaaaccctgtgacctgcccattgcttactcagattcagaatgctgaatgaagttctggatgtttcaggggatgctgacaactggcttaagtcctctcataaatggaaatctctgtcataatgaggtttccacttactcagtgtgtctatttttatagactacaaaggatctgtaaatatgaatatctgtgatttcactctaaagattggtaatgatatgtgtcttgcatactatgggcacaaatgggcacaaaaaaatgatagagtagaaccaaaggaagctttgaaaataacatgttacacataaagaaactgaggctcagaaaatggaaatgatttgagcaaaatcactggacaacttaaaggcagaactaagattaaagatattctgaatagtcaggtcttctgtatttatgggtttctatgtaaatgtataatcaaataccatgaagtgttatatgaatatgacagatactgttatgtatgttattcttaatctagtggagtttccttcttcatcaagggtcctattcatgtgtacattttgtttcagaagcaagtcttcattactgcatagtcccacccataatgtttaccagggatttagacccagatttggctgtaaatttggcttcatattaagtattttcttgaatgacaatcacctgggcccctagcaagaaaagaggaatggcaaagaagaaccagttttagataattttcagctgaaaaaaaaaaaatctttattttaagaagggaaaatacagaaacatagaaagaatataaagcattcaatttcccatgactttcaacgattaacctttgagcatattgtattgccgtaaggcaggtcagcctggccagcgagtgacttatctccatgtggtagttcagggcccagtctccatccttcctgtgcctcacaaggccacatctaactgcaaggagcatgggaaatgtagtctagcagtgtgcccagcaagaggaggaaatggattttggtgagcagttagcaggctctgccatgcttagtaaacatcagtcctttttaaagcatattagccactaaattgctcagaatgccacgatatctggctgcgttttttttttttgaaagtgtcagtggtcttggtgttagaagatgtttgccaatacacttacttcagaagcatgactttcataaaaactcagctcccatttttaaatctcataatgacttcccattacttaaaacaggcttggcattgaccatatcttacttctcttttctcatcctagttctgtttttttcccttttttttttttttttttttttttgagacagagtctcgctctgtcgcccaggctggaatgcaatgatgtgatctgggctcactgcaacctctgcctcctgggttcaagcaattcttctgcctcagcctccagagtagctgggactacagacaccaggcacccgccaccatgcccggctaattttttgtatttttagtagaggtgggatttcaccatgttagctaggatggtctcgatttcctgacctcgtgatccgcctccctcagcctcccaaagtgctgggattataggcgtaagccaccacgcccagcctttcctcttaacagttttttagatatacatgttcctcctgaaatgcctttaactttcttccttctttcttttcttcttcttcttcttttttttttttttccggctgttgtacgcaatttattcttcaagatcaaactacaggtcatctttttttggcagccttcttccgtctcagaacactgaattcatacctgtgttttagagcttagactttattgtaattgcctattttcatgtctctttcttcccaaactgtgagttgttagagacaggatctctgaataatttgtctttatacttaaagttcttggcacttggtaatcccgtaggagatttatgttaagacaattttgacggagtcctctaaaatctgtcgctcagtaactcacctgtggatcatataacgttaacttgcctttagtaagagattcgggtatttcagaaacaaacatattagtgattaagattgatacttacaagaatgtctttttttaagagaaaggtttgcttcacaatgtctttgttttgctatttggcagcaaacctccactctgataaaagaaatctttgcttagataatagactcagactaaaatccaaacagccgcacagtaagagaactagaaagtcttggagacaatgatatcaaaaccccgagaggcattgcagtgaagaagtatgcccaactcagcacaccccagtttcaacgttctgctgtttttaagcagcggtacctctacaaggttgctcacttatcttcttaagtctctattttctcatccagaaataggattacatgtcatacagggctgttgtgtaggcatttgagatttcacatctgtgaaagtaggcaccttgaaaagggtcttgcaaacatgaggaattaatatgctacagtgaatatgttgctgatacaactcacacttctacttctgaagaaacgagaaacaaaaataacacaaactattccctttcagcacctcccaccacaaatattcaatcgtgttttattacccatacaatatgctagaagttgcttattaacaaataagttggacacagttgttcatttttcttaggaggtattgagccctaaacactatcgagagagaggtattagagtaggtctctgattatgacagtaagaatagtactggattactgcttctaggctcgaacactgaaagttttaagctgtcttctttggtgtaagagacaactcttaacggaggaaccctgtgtttctccatggtgtattccacaggtgttaagtattctgcactgggttagtgacagccgtggagtggaggtggaggctgttctctagccaaataaacttcagaaatactgaaagaaatggtctctcagaatctttcatcataagaaaaaaacaggaatccataattagcattagataaaagagtagaatctaacagaaaatagcctttccaagtgttatttcagaaacagcatagcaagcaaatagagtattcagagaacaaaaagaatgataacgtttttctcaaaatctgtgaaatattgacaaggtaagtactttgaaattagatttatacttgaaatgtaagtgctaggggtagaatctaaatttctggcttagatttataaaggacaggatcggccttcttgctgccttgtctatattgaaagggaaactgatattaggttgagacaatgataaattgtgtctgttctctgagggtccatcctaagactgaagacaggaattatcaagttttctctaacagtcgtttggcttaattaaaacaacttgcaccattattattagaggtaatattttatacttttctagcactctctgtgggaagcatcgtttgcttggggaaaaaatgcatggcacttggagacaggtgacaccatattttgggctcaaggtctccctgtattgcaagcctggagaaaaggtgtaggtcacttcccaacctcattttcaattccactacctgaactgtaataatccactccctcagaggcagtttgagagattcaaagagatcctctttgttacaattgtctgaaagtagttaaactctatttatcatgaaatgtgggttatctcactttaattcttacagagactgtgaggtaccactggcaagtccattgatagaagagaacctgaagttatgaaaggttgacaagctcacctaaggatgccaagtgaaggtcatagtcaaatctctgtctctaaccttaatgatactgccgtataatgtattcctttatctctggccaccagtatattagataaactcaccatctcatttcagtcttgctgctctcccattcaccctctacttcagcgggaactttctaaatatgattagaacactcttctaaaaacacttaccgtggtttctaatgcctggatgttcctaattgagaacatgcaaatatattccccgtggtctgtgaacttcttgaaattgtaagtaaattttgtgtacactgcagatacctgttttgttgttgttgttgttgttgttgttttgtcaaaagacagtttaacacattagattttgagacttgtccacgttcttacccaaggcctggagcccctagctcaccgagaagccctaaacatctcagcatggcatggaagcagtaattaactgacccttcctatttttccacctgtccagaccgaaatactgaaccacttgtagtttttcccactcacaccaaactacgtctcaactttgaaactgtgctcctctcagggtccttcacttggcctgggttggaagctccaggatagcgggtcatgtctagcatatctttatcacttgaagtcatcatgtttaaaaagatttatattcatggattacaaaagtagaactacttgctgtacaataaagaaacaaatgtagaaagtgaaagtcccctaagattccacctgctagaaagaatctcctttaacatttccgtacctggtctttatatagacctgtaaataaactgtagttactttatcctattctgcagttggatttgttctttatgaaacatgtcttgttcatctttgcaggcttgttccatagatttacaatgtacgtatctgtcattgtctatttaggtgattcttttgctggttagtttaccttgttagtccttgttcctcctctcaaatatggctcctgtgaccaaccttcgtcatttaattttattcacttgtatgagtacttctgtacaattttcctggaagcaagtcacatgtatgcaatttaaagtttaacaatactggcaaccattcatccaatattcatgtttatgcaaatacctatcaatatactatgctatatatatatataattttttttaattttttctttttttgtgtggggggaaaatagaatctccctctgtcaccaaggttggaatgcagtggcacgatcttggctcaaactgtaccaccgggttcaagcgattttcatgccccagcctcctgagtagctgggattacaggcgtgcattatcacacctggctaatttttgtgtttttagtagatacggggtttcacagttttggctaggctggtctcgaacttctggcctcaagtgatctgccagccttgatttcccaagatgctgggattactgatgtaagccactgtgcccgacctgtgctttttataattaatcatttgtgcatgtttcttacccccactagactgcaaaactctcaaaaacaaaggttgtgtgtaatatatcttcatgtccctcctgggttcttacagaaggtacacaaaataaaccctgtaagaatgagtggataaaacaataaacaaaagaataactgaataattcagtagcttctctaatcctcatatgacaggtaatgtttacagttcagaggaggtcctaagtttaacctttaatgtttgctaataaataagtcagtcaaggatgagctcttgtcctgactttatcaaaactagccctccctgatttttggggggctctcagtttccctgtctcacaaagaggagattagcataatggttcttcagatcctggcaagcaactcaattttttttgtctgtaacctgagcatatgccatagtttactcatcactgtctcatctctaatccaaattgttcaacaatgcaataaagtctcaggctaaggttagtgaccagcataaaatatttttggccttttcagccttctgcgtgtctgtacttcaaatgtctgtatattttgggaaaccaaaaaaaatggaaattattttagagaaaaggccaaataggtaccaatcaaccttcttgactatgtttagaagacatttaacgctttagacatcacacaaatgattaatacccatcttggagttgtagtaaatgttgggaatgatagcatgtgttcagagatttgtactttacaggattttcacgtccaagagctcacttggtgtagtgaagataataggagaatgaatatgtagctttcagttttgttgaacttactcttgtaaacattctgaaaagagaaccttttggccaactattttaacaatgcataaatatcaaggcaagagcattcccaacccacatctctgcccattactcatggcagacatcatcatcagttctaaatttaaataatagcatttctgtttttatcacacttttattaagaatgttggggtgagatattagaaatggtcaaatttataggcaatggaaaatgtgataaattcccttttaatcacatagcacaaagctactttaaatctagtatatggcctttattccttttttacatactttttattcttcattgatgatctcaagtactctctcaattgatatttgattctcttgcattgctataattctggctcgcccgcctatttattttttaattttttttttactgcagtatgttttggggtacatgtgagttttggttacatggatgggttctatagtggtgaattctgagattttagtgcacccatcacccaagcagtgtacactgtacccataagggtggaatgaagggggaatagacaaaggccccagtggccctgcatgtcccatatgggtacaggggatgagggataaaagactatacattttatatggagtctttgatccctgcccccctgcccaacctggccgcgccaaagccccaaagtccatcattttgctctgtatgtcttcacatcctcgtagctttgctctcacccacccatttcaacaccaacccagtgtcaatgctactgacttatcatcactatttgaaatctggctgtttgcagtgctggaaaaatgaaattactcaacttccttaactggaacaaaagaactagaaccaaaatgttcgctttctggactcctgtactcgataagatttatctcatttcctatctcaaagtttatatgtggtcccgaagtacacaacttccacaagctctttatgctgcttgacttttttcacctgagtgtgagaaacttctacctgtatgttttctcccttttagctgaataaggcctagcctgctctgctccctctcttcaggaagtccgtcgcgggctatgcgagaggtcccaccttatacccttattttgctcttcctgcagctgtttttctttaattattaatgtgcctgtatctctcacttcactgtaaggttcataagaaagaaagactcaatttatttttctcataaatgtataacagcaaatagtgattacttagcaattgttgaacaaaatagattcttcctattgtaaacatggatttctaaagcctgatagatgactcatctagataaggcaaatgagtaaagagatgtgtccaaggttagccactgaataagtgataaaactaattctaaaacccaggtctcctgacagccacgtccagtgctttttcctctccagtgcaatcgctgcttgtttaggctgactgccttggttgatggtctaggtggcaattaaaggactgtgtgctttctgcctttcagggtggccattcagggcaactggggccttcgtcagttgccccttcattccgcccagaggatgagcttgagcacctgaccaaaaagatgctgtatgacatggaaaatccacctgctgacgaatactttggtgagtggggcctagagctgacttctgaagtaactatcttgctctgatttccttccttagtaattggaactattatcagctccactggtaaagtatttgagtccagatgcatgagagttgatatacatccccgcacaactaagtaattgtaggatttgcatttgcaagactgccatagatgtgatgtctacttagcttatactaaaatttcagtggtccttagagtttccttagatacaaattttattgttgagacttattttttaccagtctaggcaacatggggagaccctgtctccattaaaaatacaaaaattagctgagtgtggtggcatgtgcctgcagtcccagctactcagaaggctgaggctggagaatcacctgagcctgggaggtcgaggctgcagtgagctgtggctcagtgagctgtggttgtgccactgcactccagcctggacaacagagtgagaccctgtttttttgttttttgtttttgtttttgttttttgttttaaaaaagaagacattttttgacaacttattagcttcccattaggcagaaataggatttctgtgtatgttcccatttctcactggtctaaagattcaagtaaaaaatgtggaattggatattgtctgatatccaatttccagattgtactcttaatttttttttctatctcagttgaagaaatgatgttttctttgtagttttaattttcccctcttcaaacttgttaataactaggaatggttaatccttccaatccatgaatataatgcaaatttatgaattatatgccgattgtgaggttctgtggacgcataacctgtcctcagtgaggttaaaattgttcagaaagaggtaagacaagcatacaaataattactagtctaggtagaaagtgataaaagacatgagaaggcttaggtcaattgttgcaaattttatttttattttattttattttatttatttttgagacagagccttgctctgtcacccaggctagagtatactggcgtgatcttggctcactgcaacctccacctccggattttgagcaattctcctgcctcagcctcccgagtagctgggattacaggtgcccaccgccacacctggctagtttttgtatttttagtagagacgaggtttcgccatgttggccaggctggtcttgaactcctgacctcaggtgatccacccgcctcagcctcccaaagtgctgggattacaggtgtgagccactgcgcccggccagaagttttaaaagctccatttattaggagcatccggaatactttggtaaagaattggtggcacttgaatctgagccctttaaaccagtgcctttcacattttctgtggtagaagaccattttcctcccaatctgttggagaccagtatttttgttgagtcagttaaaattaattactagggaaataaaagacacaaaataaaatggaagatgaaattttatcattattagagttaactgttaacgaattactcttttaaatttttatactagtttctaaatattaatcctttgttcctgtatttatctcatccagggtgataagcatttcttagacacccatccatggaccactttttgagtggcactgctttaaggacaaatagagaaacgacatttggggaacagtattagtaaaggcacaaagatggggaaattgcacaggatttttgcttcttcaaatattttctattttcatgtcttttttgctcctatatgggaatatgtaatgacaggtcaactgaccacaccagtccaaaaacacacagtagatgaagtaggaggtattaggatatgaaaaccctggcttttatttgtgttggggtggcagtttagcttagctaaaagagcaaaaagagtgggaatgaaacatctggttgtggtctcttctctgtccctcgctggccaagcaatactggcatgtcacccatctgcctgagccccatttcccacctcactatatcaacggttggggcaaatgttctctagcatttctttcaacagtaataagttcaatgtacaaacatccttaatctaaagtataacaataaagctaaacataaattgatggagattaacaacaatgcatggagaacagtaaaacaaaacatagaaaatccacgaaggtttctagttacatcaaaatacacaaaaagtttattaatgctcttgtcattgccatgtgaggagggtttataatggggtctaaaatacattttttaaaagtgaaaaataaggtctctgtatttaggtcctattaaaaaggaaaagctgacttaccaagtatatatgcttcaaatatcatagcaacaaaatatattgccacaaaaaaaaaactgaacatagatgctaattgcatgaatgaatatatattgaacactctgggaaacagatataaattattacctttcccttcaagaactgtccaagctctactacttagtagcttagaaaacttgaacaagtattattccctctaaaccttcatttttgttttgttttatctgtaatatgggaataataactagcttatactgttgttttaagaaatggatgaaatatttatacaaagcacttagccaagttcttggcatgtagaatatgctcaatacaatactcaaggttctcccatgctcttggggcttatagtttatttaagacataagatatgctcgttaaaaatccattaataatgctcaatttaagtttaagttcctagcaacaatagaacgtatgtcactggtaagtaatcattgccaaatggggatgaataaccatttgagaatttggaaaaatggctaacttttattgagtgcttatgatatggcagcactatattttatttacattataggaattaactcatttcactcttataggaaaacataaccctgtgaaatagatactattatcattttcagattttgaaattaaggcacagaaatattaatttgcctaatgtcaacagctaatacattgcagaactgaattagaatgcagatctgtacatttacacaccacactgtaaaagatggggaaagctagccaggctacatatttagaagagtgtttatggtggagattagctttggacagatgggaaataagagatgagcattctcttctaggtacacagaattaacaaaatataagttgaggccaggattatttaaagaaaatttacgttatgtagaaaacaaaaaaaaaagtgcctatggtaatattcaggctgctctgctaggtggtggtgggggtagatgtgggtcttacctttgaagttcttatagtctaataggatatgtgtacagagttatggtgttataagcacaaggcagaaagtgacaagtgacttaatcaatgttcaccaagtgttctttgagaattcagaaaaaggaaagagaaaatcaagagagagaaatggaaaagtatttatggaatacttagcctttgagtaagtctttaaaattgtgctaattgagatttggaagtaggaagatagtagagaagtgaagtcatttctcatgaggggagtttttgacataacagggaataaaaccactggagtgaagtgtccacgtgagaagtagcaaatattgggaaataaggttcaagtagtaggttaggaccaatctagggaaggctgtcaatgtccggctaaaggctaagaacgttattgtctataatgagcccttgcacattgagatcacatgccatgagaactgctctgtggatagtggttaaaaacatgcactccagagccaggatgcacttcttaccagcaagatgaaatcaagaggcaaaggactagtgaaaagaactgtcctttattgttccgtgctttaaacatttctcaagcaccttctctgtgcctgctactgtgctgggtgttcaggacacccaaatgcagaggctctgccctcatggggctcacgggttcctaggaaggacaagagagtcacagatgtcaaggattttagtgcagatattagcactgtgttgggtgtgactgagctgctatgtgagagtccataagtctgcctgaggatgagcggaaagaatacatagcagtgtgtttgcatcagcagggcctgacccaagagcgataaagtcttctcttcctttctgtcagagttttacctttggcctattctggactgcaaatagcattgccaagcacttcccttaaataacttctcttttttgcaggactatcctctcagccctgccaaaaccccatcacctactctttctttactactttgcctatttaatgctggaatttttatttaaactgtagctgatttactgaaggtaattaagtgctttcatgctgtagatctcctgctagactacaggctgtacttgggagtgagagtgaacaaaatgtaaataaatgatgtcaacagagtaggttcctttgtggtcatgttgctttgcttccaagacactcttttttttttcataagtagaatgattcatgaatatgttattatagttcttgtttctttgcggagcccctcatcactcttaacagttttatttatattgaattataattatcgtatgcttaaaagtactgggagaggtaccagaagatcacctcacagatgacttaagtacaaaggagaaaaggaacttttataatggagaggtctcctggaagccgtcttaaaccaagtaatgaaatttaacatcctcaataatgggacagactggcatgtgccaactgaatgtaggaagtctgcagcatcgtctaggcagtggtcttgctaaaatatttcagctctatccaaccatgaggaagtaaaaaatgcagatgatgggacatgcttcaagacacctgtcctgaattctgcaacactgtcaatgttataaaacactattctagattaaaggaaattgaagagacatgccattcaaatgcaaggcatgtgtcttgattgaattctggatgaaaaaaaaaaaagctgtaaaggattggtagcaaacttagagaaatttgaatatcaatgatatattagataatacatcaatgttaatttcatgatgatattaatggtgttgtgattatgtaggaaaatcttatttttatgagctatttgttgcagtataaggtgaggtatgattgtgtctacagttttattttgaaatattgatagagtgacagaaatagagagagagagacagaaagagagagagggatgattgacagatatatgtagacaaacagagatagagataaatgtggggaggcagaatcacctcaggttaaaacagctagagatgctataactgcaacaactataaggactcccctcctctctaaaagtgtactgaagcctgtcacaaatgaattaccttaagaatcccttcttgggtgggtagagagattgacatttctgcaccttctcaactttcctgttttaatgactacagtgggtctttgaaatttcccgttatcgttttctttttttcttattttttaccagacatacacatcttctattgctggtgagatgaggacaattgtggtagtgatgacaaaagctgatatttacctagagctccatatgtttaaaaaaccaagtcgcagccacaacatgactggcagacctggcgatgatgtcttcatttcattttttggatggggaaatagagattcagagaggctcagtgagttgttcaagctcacatagctaataattttggaatttggcctcactcttctgatctcatgtctatcataatacattaccattacagaaaggtatataaatgctgttcctgctgaatgttagtaactggctgtttctctcccatgtcataacttttccttatgaagttatgatcttcaagtgagagatggagggactgcttctgcccaagattacatgtttgtaatctggacttcgatgtcactgatatgtttcaactatcttaaacatcctgaattaactgctgtgacatggctgaggtacatacattaggaagaccgtctaccgaatacctacctatcagccattttgcagtctgtagttcttctcttgaccatgggagaaggcaaatcactaatagccaccgttcttattttttcaagtcaggtttttttataaaatataacaaacagggacccttaactgtctcagctgggtttttttttaatgatttcttctggaaaggtgatagttttagtgtttccatgccttcttttgtccatgttcattataacttgtgactgtcgcattacagtattaggtaaatgccacagatgttgaaccatgataaagcagttggatgagtctatatctctaaagggaagatacagtctctatactgtgggcatttgccatctacttggacttaagttttggctataacagatttccttaccatggacctgtgtctttccattaacactggtgtcattgagagggcctctaaacactaccctgtagaggaaagggaggaaacatagtagaaagttgggggtaggagaaaattcttacccagttcaataaaccagacagtgagtgtttagcccagctcatctacaggaagccttggttcaagtgcttgcattttagagcaaattttttcctagacaactagaaaaatatgttgatactaaaggaggctctcagttctagtgatagatacttaaaaagaacaaggggtggctcatgcctgtaatcccagcactttgggaggctgaggtgggcagatcacgaggtcaagagatcaagaccatcctggccaacatggtgaaaccccatctctactaaaaatacaaaaatcagctgggcatggtggcacgcacctgtagtcccagttactcaggaggctgaggcaggagaatcacttgaacccaggaggcggaggttacagtgagccaagatcgtgccactgcactccagcctggtgacagagggagactccgtctcaaaaaaaaaaaaaaaaaaaaaaaaaaaaaaggaacatggggcgatgaagtagctgtaaattattataatttagagtcaattcagagcttataatagaaaatggaaaacttttaaattgagtattaaaatgaataggagagaaaggtattattctcagaaaattgggacatctacagggctagttgccagttttaaagtttgttttttcaaacagttttaggcagctaaaggaaagcaaagttgagtttttctccagataaccttgagatatctctttgaaattgtccaagacttttctgtgttggttgatacagccacagccttaagtaatacacccagagcctctaagttttatgctttcattcattttgtaagagaaagcgtgtttgtatatgaagcttttcatacatgcatgtctgtgactatggcataattttttccaaataataatattctggctgaggagccctcaaggctgaaggcaacactgttggaagacagtatctctggaaatggatgttgtaatacatctaaggatggactggaaatatctgacagtagatttttaagcatagagctgtaattatcttgacattgtttatatgatattgtcttattccttctttaaaaaaaagcagaagtatgtgagccttaaaattattgagtgagctatttgaagaatccttcagagcagtgccaggtaaattatcttctcagaacttagcatttatctaaggaaactttttgttcatctctgagtattgttagtaggagtttttgagaatttttgcagaaaaccaggagtttgttccagtggaactaggccttcatttttcaaaggacagctagacaaaagtgaaggcatgaggcagcagggacctagcacatgctaagccttgagagaagaaaggcgttaacatgaacaaagtgctatgatcggtcactttattggttatgccagctcattgtatttggtgccttggtatcaactcaattaagatgaaaatggagggccagtgaatgttcatgaatagaaacagaacaaaaaaaacaatgaggaggatggtccattttctttctgcactagtgggaccagttgataagtgagcttgtccagaggacttgactaagatgcttaggaaattagaaaccatgatttgaggtgcagttgaaggtatggagagaggaaaacctagagccctcattgctgttgaaagactatcatgtggaaaaggaatttgacttaatatttgtgattcaaaaattagcaacaaaggcaagtgaggggagtctggccagttcccattcagcgtaatgaaatcactttcttaagagacagaagaaagtctttgtaaaattctaggtcagaatctaataatcccttgttggtgaaaatggtgataggtactcaagcaactgatggatgattagattatacttcataagtgctgtccaattctaacattttgtgacttaggcacaaacaagacgctaaacttgtttggaagttagcgtcttgcatccaacttctaggtctacccctagattatcattattattattacatgatttcaactaacatttatataatgctttttaaagcacttttctacatgttatatcacttgagcaagacagcagtcctacaaaatagacagtgtgtttatttccatttgggatatgaagaaatgaaagatttcagtgattaagggactccccactccccagggctctccactaccctcacaagtcataaagcaggtaagtagcagaattgccctggggcacaggcctacagactttaaattcttttcacttttcaccccattgtgctgttaacaccatgttgctgaattggtcatgggccataagatagatgagttaacatacttcatgttttagctttttaatctgtataaggaacgatgtgattactttgtaaagtgcttagaggatctcaactgagaggtgtaaagtaatttgtatttcatagtttgtgttattatgtgacaagaaaatggtttccaaagtgcttctatcaattacaaactgggaaatgactccaggtaggcagctacctttagtggatcttgttttcacagataaatgacctaattaatgaaaaaccccaaaaccacaatggaagaaaaattagacaataagtggcttagagagaaggttgtattgatttggggggaaaaatgggttttttggttttgtttctctctaactttttgtttagggtatctttgagttgtgggaatagaatgttctctagttaatgaggcatattagatatattttcttttgtggtagtgacttctggtaatgtttgttcagagtagtatatgtttacagcactaaataaataataattctgagcattttatgtgttctatcttagcatacattaattttttattaatttggctagtgtgtttgtttgtttgtctgttttgtgtcagagtttcactcttattgaccaggctggagtgcaatggtgcgatctcggtgcaccacaaactccacctccaaggttcaagcgattctcctgcctcagcctcccaggtagctgggattacaggcatatgccagcatgccaggctaattatttttgtatttttagtagagacgaggtttctccatgttggtcaggctgatctcgaactcccgacctcaggtgatcctcctgcctcggcctcccaaaagtgctgggattacaggcgtgagccactgcacccggcctggctaatgtgtttttaagcattgatttggaatcccagacttagagtaaagaagaatgtgatcttagaaattatctaggaaaatccttcattttctagaaaactgtatcccaaatgacttatccaaagccatgcaactaggtgtgttttgaattctatggtcaaaattttctttctgagtaatggacagtctccgatggcatgaagaggaatggcagggctgtttacaaaggtgcagacataggtcgggcctgctacttttgtgatctcagaccgtagatccaccttattcaaacataagaacacattgtccttaaaaagaataaaataaataacttttaaggaattttgtgtatgtatttttcaaatacaaaagaaccaaagttttcttattcaaaagaaacaaaagagattcccagtatcttttatctcagtgtctttatccaatttacttgtaatatttcctatctgttttcttcactaaatgtaagtctgcgtgagggcaacaatttatgtttagttcagtattgtgttcctatcattcctggaataatgcctggcacatcggagatatttaataggtgttaatgaattaatgaactaataaatgaaaactgtgagcagactttcacacttctgtgacaggacatggtatatagtaaactatagggaggaaatacttcattcatttaagatatatttatttagcaccttataaaatcataaaacgttagagctggagggaatcttaagagactaggaaaacctcttcatttttagagatcatgaaaatgagtgagatttttagggtcccaaatttgttagtgacagagccacagagtataactcagattttctcattcctttttttaattcacttaagggcacaggaaaacatataaactagagtaagacatggctgctacatttattgaacttaaatttaaattgttttaacacctttggacttgatctcttttgcatgtatcttctgtgaaatttaaaggttcaactggtcaatgaagagagtacttggttaagattttattttttaagtactgggtcacatttcctccacctgtaggtttcatctatagtctttggttcccaggaccatttcgtaccaccacaattttcttctgttctaatctaattggattggatggatagggcatcacattgaaagaaacattcttttcttacgtttacttgagttgtccatagcaacctgtcctgaaagattgtccgtttaaagtaagcctcttcaagactgtgaaccaccacccaagattggtgtttcataccgtcttgatacaaacagcagacatccagtcattcagctgcgttaggatcactatctctttatcagaagaaagaagagaaaagtagaagagagatttctacttcataattgaatgttctttgcttattaactgtggaagcaaacttgaaattctgggagagaaagcactgatggggcacacattgtctgtggtgcaaagaaagtctcagtttggtactggtacctgaacctgcaagtgctaattatgcatcttctggtattaacacacaaacacaattaactgtgaactcagctccttttccctttcaaaccaccatcattcccccaacctgcactttccccaccactttctctaaaacacacagataagcatctccttacagactttgaagtgacattaggattgtcagaaggcataattaattgactgtcagcaaagctattgtttgaacatctctggagttgtacttggtaggcatcttgtttttttgttgttttgttttgtctgagacgtagtcttgctccgtcgcccaggttggaatgcagtggcgtgatcttggctcactgcaacctccacctcccaggttcaagctgtgctcctgcctcagcctcccaagtagatgggactacaggcacgtgccaccacgcccagctaatttttgtatttttagtagctatggggttttaccatattgatcaggctgatcttgaactcctaaccttgtgatctgccagccttggcctcccaaagtgttgagattacaggcgtgagccactgcacctggccctgttgtatttttaattgaccgattctttcctctacaaatatttattgagtgcctactactcaccaattattgtagtgtatactatgggagataatggaaatgatataatggccaaggagagaaagcatttgtcaaatcctctagggccaagggctttgatagagaacagatttcacaactggcagtggaaaatgtattcttttccatcccggttcagaggattttgccactgtacttgtgccatataaaatgctgaaatagttcatgagaagaggtacaggcatacatcttcctggtgtgtgaagatgagtggcaatgcactgtctctggttagagttcccaccaaaaattgtaaaatacttaaaaagaaaaagcaaaaaatatccgaggcaattaaaaaaaaaaaaaaaaagggaaatcacagaagcaggtccaagttaatgaccttatcccaattctgttcctaagtctgactctgatgttagtcatgttgtatttaattcttccagatttcctatagtactgtacagctctgatctcagtcctcacttggttctaaggtttgaccatcaaactttgagcttgcatgagccttgaacttggctctactcctatctggcagtgagcatcatttgttaaaattcaacaagagcaaacagaaacagtgtacactagtgacttgctgaaagagcctaagaagatacagtaggcaggagtaatggaaatgagtttttaacctccactgactcaccctttctttcctagtcacccttagggtcatggcaaagttacagaggcatttagaaatcatcttgcttgaaagcttccctttcttcagtcattagtgagcatcttcataattttttttaccatatatgtaaactatccatagtattatttgcctaatatttttatttaaatcaattaactttttatccgactttgtcttccttcatgtcaataacatctataatttgattctgtgggttgaagtactaagttgcttctttcctgtaaaagatattaaactgaatactatatttaaattttaaaaatacggctggaattacagatcacatctgtaatcccaacactttgggaggccgaggctggagaattgcttgagtccaaaagtttgagaccaacccaggcaacagagtgagacccccatctctacaaaaaatgaaaaaaatattactaggtatagtgatgcacatctgtggttccagctactcatgaggctgagataggaggatcacttaagcactggaggtcaacggtgcagtgagccgtgattgcaccaccgcactccagcctgagtgacagagtaacagtctgtctcaacaaaacaaaacaaaacaaaaaacaaagttcatttcatgcaccagctaatgtttgaaatattgagaaatgtggatatcattcaacaagaagaaaaattgataggataccatggtgaaagaaatggtgtcctcaagcttacccattaagtgtataaagcataattttttcttttttcttttgcatgcggagtcatcatgttcttgtgaaggatcgtgttgtgttgttagatattgttccaggcatccagcactgagaggcattgccggcctgatactgtcccactgactcactgtgacatcttaggccggtttctcttccataggtctcatctctcatatcacgagattagaacacatgaactattgtgatccttttgaccttaattcctttgcctcaaacacttttcatatattgtcctctctacactgttaaaatgtaggtgagtaagaaaagcagctgccccatataaaatttcagtgctgcttgcctcagagttctggagaattgtaaacaaacccaagaattatatttcctagatcactttatgctctgcttgttactgttacccatttcctgaggtttatgagagggtcactgccttgaaagtagctttcaatgccaggtaataaaagtggaataggatgttgaatatgatgaagaataccatgcactaagtgttgggtacactagcagcgtcactgtgtttcagcattttcagtaatggtgttcagtcatggtaattggcataccggctcagtaatggtgtttactaatggtaactggcatatgtgagtgatattagtgtgggtaaccatcaacggagcaatagtctaatgtagatgatacagcagtaataaaaatgaataattcatcttttgtcagatagcttagtaaagtgagcactagatttggagtcaggaaatccaagtgtaagtcatcttttctgtgtgacgttagtgacatgtgacatttgtgctctccttagagtattttgttatacagtcttgagaactcttcttttagcagctttaaaatgagtgttattttgccagaagaactaacatatccatggacaagtcagaagttaaaaccaaattatttcagttttcttgtttagattagctcttctatagaacctcagagtcttcctgaatttcaggtatttcacttattaaaaagataattatccctatctattttatgtgcatattgtgggaatcaaattaaataagtcggtatgaaaaagttttctaaaccgtagcagaagaccaaaaatttaagaggtgttagtatctccacctagtgcagcatctggtttgatttgtgtcatttatgattagtgtgtaataatcattcctctaaattgttaacgtcagtgtttatctctatttgaattaacactttgtattttcttatgatgttctgttgtaattggaatatcgctggagaatacaaaaagtgttttttagtcattgtgtgtgagaaagcaacacaccaagatataccacaatgttctcgtttgctgagcaaactactcttgctttttaatgtggaatgtagaagaactaattgaaaagagacaaaatgaattttgactcaaattgaacaggatgaatcataacccactttctcatctgagatgtgaggaagaaaatgtaaaggaaaccaaccaccacacagctttactgtcagtgtcagcataatcaatatagagtgtttttcaacagaataaagaatacatttctgcaaggctgagagttgcaggtagtcggaaacctagttatttttgctttgtctatagtctgctaaaattgtctcgttctgccttggttaaagcattctaatcaagagagtttggggcccctcagtaattgcttctcaaaccattcagaaatgtacctgtgatctctattgaacagaggccaatcagagactggaccctctattgaacgtctggtcccagtgtcattttgtcagatggtcaagagcagggagacggcagacatacagaaacctggacaggactgaattgctgcttccctgaaaataacttacttgggtttattgatgtgaatgattaaacaaaaacactttgtcctattggattctagaatttcgatgcataatccacttagcttgtgaatgtagcttaaaaaaaaaaagattttacacaaataaagaggcactatagcatatcccaggaaaaaaactctaattcctaagtcaaaatttatttctaatttttgttactattgtatttgattcataactcttatgatctttattttcctcatgtgtgtttatatattttctattttactgtaaaattactaagatgggagagcacatctttcttatcttactcttcctctcttccccaaaaagaaaaatgagaagaggagatagagctggatgatttttttaaatatctttgtgccactccaccaagagttttgcttgcaatagaggttctctagtctgatttgatcctaaaccattctcactaatgattctgcttaaaataagactagtacatattgagcactgactatttagtatgagttctacatgcattacttatatctggactataactctaggcagtagatactgttttttacaatgagaaagctgaagccaagatgagttaaataattttcccggaatctagtaattagagttgcaatttgaacacagaacccagctcttaacccctgcatataccatgcctgtgactatagatttcagaaaatgagctagccaaagcctggaaaaagattagactcacaggatctgtgctcattccatgacttttctggtaaatcctattctgttttttcctctactttccttgggggatgtttttagtatgatttgattttctctgattgaaagctctcactactaataagggagcaattagaaatacaggtacaccatctctttgtttgctctgtaccagatgtctgctgagacagtgtctttgccctcctacatgggtagtagtgcccagttgggctgcttagtccagataacaaaaggcgatttctgaccgtaattttttttgttgttaataacacttgaaatatgcatctttattcctccattccttcttggacttgaaacttggttattatgattgtagcaatatttatgtccagaaactctcttctccccacaatttgcctcaatccagtactgctttctttcacacacgtaaatagttttaacttttaacgatccatgcctatggcatcttctagtctagtgatgtgtagaaaagccaggcccagtctcattgcccaggtggaaataagagagagcaaggaaaaggggactgattttgaaaataaagtcaccctgttgacatgtcatcagtcaaaagagttcagtgcaatagctagcaattggctcactcagtcggaagttgatgctattttaggccgtcagcggcagtgtcaatgtatctgtgaattttgccattttatttcattaagatggttcaggaagtcagacactgattaactgattcttcgacttagttcccactcctaattttggatgtgtggtgtctttaggaagctgctgtgtcaccttgattctaaagaaaagtttcgttgtgcctctagagcaatccggaacagtttacccttgtgtctggttatgctggaacctgctgtgttctacctctctggtcacaggtggtatggggatacttttgcttctggttctcctctggcagatcaagcaaatacaatccaagtgcgtgcagcccgttcccattcaaaatgtatccgtcataataacagcattctcgctgacgcattagactcaaggtggacttaatttggagatcacctatgaagacatctgtggaaggaatggcctcagcattgcagtcactttcgaagtcaagaggtattctagacagaccacacagcatgtataggtaagactaggaaaattctaagttttgtgttgttgctaggggcttgtaatcttattttatttgtaaacatgctctaaataagaaggataaggatctctagataggaaatatatgttgttctttgtttctccatttattcaataattattgaaggcctatgatatgccagacaattgttccaagcatttccattaaacattagtccacaaaatatagacagaagtgcttacaaatagctcaattccaatatgatacattgctggagtttggtgatatgggaggaaagaagttagaatggcttactatgaatggaaaagtggagaaagattttctgacatagatcatgttaagactgaatattaatggaatttttcaggtaagccatgaattcaagggcatttcagacaaacaattcaatagggacaaaggtatagagaccaacaccaaaaaaagtgcaatatgactgccaaagaatattggaaggagaaatgagactaaatgaatgattagtggccagatcaagagggcctcttatttcttactaaagaatctagagtctgtcctgaaagtgtggaaactccatgaagggtttcaacaagggaaccacaagatattgattaaagatcactctgggtactattgtggggagaggtgttcaatgggacaagatttgggggatgaagatcagtctgggtgtcatttgtacttgtctaaggggaataagggctggaaccaagatagtcatcttgtgacaatttagagaagggtttcaaaggggcgtaagagggatgggctgagacttattcctgggcctctatcttgggtgggtaatgacatcactaagtgatgtgagaaaaagagaaggagttcagtaatggtgatgccatcagtccacagagatcctctctttatcaatacttattgagcacttgctgtgtgtacacactgttctaagcattggtgctacagcagatgaaaagcttcttttatggggcttacattccagtgagaagaaaatgatgacacataaataaaatacatagcaggtcagatagcagtatatcctattgagaaaattatgcaggagaaagggatagtgagtgatacagtggtattggagtggaagtattatggtgaatagtgtgaccgctataattgtgaggtctctattatgggtgaaatctggtctgcctaattttgtttcttttccattttttgtttgtttgatgaattattatttctcgtaaacaaggcaaataaacagcaatagcaacataaacatttacaagcacatagatgtaggcataatagtttgtgttgccaacataacacatgccaggaaaaacaaaagaaaacagcagctaaaaaaagtaaatatcaaaaaagggagctttctcagacacaaattcttatcattcaaaatgctgtgtagtttgaattagaaagtcacagaatgggaccttagatttaatccaaatctcttagtttaggcagaaaaaccttcagccgagcaaggaagtcagttattcaaggacacacaggtaggtctacaatttaggtgctctaacttcatgtctaaggatcttacccttatcaccatcccagaaaagcccaaagtagcttgggtctgaatttccactttgccacagtaaccttgagcaagttttgcttctctttgcaacagtttgctcatttgcaaggtagggatgattataaaagtgtctgtgatagggggttttggaggattaaataagttaataatacatgcaaattacttacagatgtgggctgacacacagttaatgttcagcagtactgagagtattgaaacgttatgatacaggctacttaggttttgtgtatttgaacataaacttcagaccaatttctggtgatgaccacgggtaagatattctgtgttttagttaagatgatttccagttaagatgttgaaatattaaatacttttcttgggtcactgaataattataaaatatattaaaataactttgatatttatttcattcatagaagttctagacaatccagtctagagaagagttatgtaaaattctacaccagaaatagaaccctaaccttgaaagacagggacacttattcatatatgtatgtctaacacaaatgggcctcataattgttgacagccacttattgagcattgaccatgtgccaagcagcatgctgaacacttcacatagctggtcttacttaatgctcacaacaggtaagcattcatatccggatttttcagatgagaaaattgagtcttaggcagttcagtaccttgtccaaggttatacggatatcaagagcctagatcttcataagccaagtctctgttctttttgctcagcaaatacctatttttaatgaggatgcttttctcaactagctactatattctgcaaccagtctgcattttacactgctatcctttctgtgtcattcctaatactcattcatagaattataagatcatagattgttaaggctggaggaaacctgaggagtttcttggttctcagcataaagactcagaatcacctgggggagctttatcacattcaaaactacacacccacacacatctaccttgtatttacaatgaaactctgatctactgacataaccctagatccactgagaaaatattattactcggagaaaatttagctgatggagtgtgccataccccacgtgtgatgagataacaaaaaaagttgacaattactgatctagtccaatcttacatcacaaacatgaaaacagaatgaagagtgacaatcactttctaaagatttttaaaatgtcacttataactatctgcaaaagaacctgcgtcttttgacttataatgttaagtgattttcttgtttattccttaaaactgcctttgtagaatgcactatgttatttgatggttctggagtaatacaaaagaagagagtgattaatttgcctgggatcctacaacaaaccagttgaccaagagataataagcttattatattatgcagatctatacctattcacttcgtttagttaagaaacagctcatcaatatggaatacacattttcatagtagatttgtgggttgcatagcttttttgtgtctgttttcaatttctgttcctttgataactgaacaaataacagagatggtgaaacccagcaagcaaattatcttccagattttatgtgatctcccttctctagtgagttggtatgtctactaatgacacagtagattataaggttatttggtttaagtaaatatttatgcagagcctatgatatgtccatctctgtcttaggtggggtgaattagaattactataagtgctttctgaaaaaaaaaaaaatgtaccatgaacaaatttagaggtctctgcccccaagaagtccatagaccattataggttagagaataaaaaatatatgataatcccttttcccatgtgataaatgttataaaggagctctgtacctatgattatgagagggaatgtttgagagctctaggaaaaacctccctagggagattaagaggtgatatctgatgtcttcatgaaggaataaaatgtttccaagtagagaaagagaagaaagatgttagatacagaagaaacagcatgtacaaaggtatagaggtaggaaaacatggtattctgggaacaggaagatgttacttcctaacagaacttctctgtggctgaagccacattgagttgagggacaagtagtgggacaaggaaggatagagagtctggagttcagtgataaaagatcttgtgtgatagtcataggaaggatgttttggatgtttacctgtgcaaaatgggaaattgttgactattgtcaaacaatgggtaacatcagattagtgatttatgtaaaactgaagggataaccatttctactgctgtataccacttggataaccttataaagccacttaatagggaataatggggctggaaatttaatgggaatagatttaaagtgcttgtgggataagaaacatgatattgctctcttttgttctctttcagttcaaaacaggaagtgcctaggtatgcagaaatgcaaatcaagccagctatatttttggtgtgttttgtgtgtgtttagattttcacacatcagcaatactgtaagaacactatgtggccaggcacagtggctcacgcttataatcccagccctttgggaggccaaggtgggaggattgcttgagccctgggagttcaagaccagcctgggcaacatagtaagaccctgtctgtacaaaaagtgaaaaaaaaaaaaaatggatgggcatgatggcatatgctgtggttccagctaatctggacgtggaggtgggaggaggatcacttaagttcaggaatttttggtggctgcagtgagctgtgaccatgccactgcactccagcttgggcaacagagccagaccctgtctccaaaaaaagaatactattatgtgaataatccaccagattcaactaaaaaatggccatgatgttttaaaagtacatatatacacacatatagatttaaagattactttcaactttctaagaaattagtagatctttagaaaatcattgtgcgtatgtgcatatgtgcattgtttgtgctggtcccaccttcaaggagaaaatatttcaagatcctgatgcttacttaagaggttgtatgtgtttaccatggaaaggaccttggaaatcatctcctaattctgacttcattatttatttattttgatgaagcaaatggtgcccagattgaaacaggagtgtaagccacagccaccaagtgccagtgcccaggctaacacttttctccattaactctggaaaccttatttcctttttgtaccacgtatttacagtgtttggtagttatgaattgagtgaattatcccaaggttggagatatcttggtactcacttgtaagtggagaaacactaataggaaaatattctgggaatctggtaaggaagtatgagtgaatttatcatatttaacctttgttcaaatacattaagccctttcttccctttgtcattctcaaactggatcgacatgataggaggagaaattttatcaactaaaaggggttgtgtcaataagtgtttatgatacctctaaacttaggccttaaaacaacacaatctgtgatctgacagttctgtaggttagatgttcaacatgagtctcatctggctaaaaccatcatgttagcaaagctgcatttgtctctgaaggttctttctaggggagaatcccccttgctttttctgacttctaaaaactgaccacattccttgacttgtggccctctttttccatcctcaaagcctgtaacatagcacctctgaccatttttttcatagtcattctgtgtctggccccagctgggaaaagttctccaattggtaaggacctacttgattagatatgacccacctgaataacctcacatactcttcctatctcaaaactcttaacttaatcctatctgcaaagtccgttttgtcatatacagtagcatgttcataggtttcaagcatttggacatggtcctctttgggaggcattacgctgcctgtgacagtgctcttctgatacattttcagtgatcttctagacataacaatcctggtcctgggaacatgcatggcggggacctaaataagtctattttttaagaggccctaccctttgcatagattctaatcttggggtaaaggaaagtttgagatttcactccacctttttttttggtgctggtatttccactgtgggaaagatcattcggatttaacaaccacatgaagctcctggattatctggggcatgtttgctgattcccaaggaagcttgatctttttgatggagcacttgagctggtaagttattagaagctgagctataattttccttggcattggtcatttttgtctaatcttttatttttttttgttttttttgttttgttttgttttgttttgagatggagtctcactgtgtcccccaggctggagtgcagtggtgcgatctcggctcactgcaacctccgcctcctgggttcaagcaattctcctccctaagccttcagagtagctgggactacaggcgtgcaccaccatgcccgggtaactttttgtattttcagtagagacagggtttcaccatgctggccaggctgatctcgaactcctgaccttgtgatccacccacctcagcctccaaaagtgctaggattacaggcatgagccaccgcgcctggcctgtctaatcttttatttaatgcatctaggctcctcctttcttccttcatggtttcctttttcctacttccctatctcgttttctttccttcttttcatttacagagaaatggtgttagaaatgaatgagaggagtgagcaaagaaagatgagggaaaaatagatgtgttaaggagtatacgcataaagaaaagaggccaggaggaaaagctgttcaccccgactcccatcctaatcttgcgtagtctttcgtttcctgagaatagttaggtcagaagttacagtagaaactttcatggaatacacaaaagggaattaagtaaggaaacttgtgaccgatgctatgggaaaggacatgtttgtcaaagcaataggttcttcctgagttagagaacaattatggttcccccatggaaatgtttatctgacgcaatgagaaccaggtcagacacaattcagaaatgaaatgaataaaattattctaagatctagatgggaggagacataagggattgtgttttgatagtcttaagggtgcacttacatttacatccccaaattccctcttccatgaaccactgtgcactgtacattgccacattaatgctaactgtgccaattagattaactaatattggtcaaaaaagaatatcctggccgggcgcagtggctcacgcctgtaatcccagcgctttgggaggccgaggcgggtcacggtgaaaccccgtctctactaaaaatacaacaattagctgggcgtggtggtgggcacctgtaatcccagctacttgggaggctgagacaggagaatcgcttgaacccgtgaggcggaggttgcagtgagccaagatcacaccactgtgttccagccctagcgacagagtgagactcttatcaaaaaaaaaaaaaaaaaaaagaatatcctaatgaagagaaaaatgacagaaatttctaagataactgtttcatatttcttcattaaattaaaatgaaaatacatcttcttagagtattggggtataaattaaactgaataataccagtgaaaatgctctttcaactataaagtattagagttgagaaagttctttttgtttgactattcattctgtcatctcaccttagtggtaatttcttctgcttggacaatagagcaaagttgggccagtaccactttggcaatgggcatcaaagtcgaagaatcccatgtgcaggtcgaactcagtgaaaaagggctggaactggctgctcctgcccgcttcctgccatagtcaggcccacatttgaactttattatttcgggggtaattaccttgtgtagtcgtaaattttaatccaagtctcatatgtgactgtggatgggtacagtctaaagggaacatttctttatttctctgctgcagagtgactacgtctacagtcaaaagttctcaacctatcttaggaatcttactttacttcaccaaaaacgtgtgtgtgtgtgtgtgtgtgtgtgtacatttatataccatacatgtacacgctagtatgctttagttaaaatacaaagcctctgtagaaaacagaagaattctgcaatacccctgaaaaataatttattttctacatgctatctcataaatctgtactaaaatcaattttgaaaaattaagccccccttctctaacatggtactctctctctttatttgaattgtttcatgcacttcaacaattatttctagtttcatttcttttcatgaggactttattccaagataattcaatttttgttgctactgtgcaatctttttgcttgttgttgttgatgtgtggttattgctagtttaaaggaaactcttgactttgcttgctcatatccaaacactttaccaaattcagttgttaacaaacttatattaacaacgttttcaggttcttcagtgattattaggctactgaagtgtttttgtggttgttttgttttgttttacttctattggaattcatgtggctgtttatattttgctagaaaattatgcattttgtcaagattgtctactgttgttactatgatataggcgtatttctcacttatactttttaaaatatctgtcttgtccatattcatagcttccttttgctttgactgtttttcctttttcctccttagtggaactttcctaagaagtgtgtatatgtgtgtgtgtggagtttgttttctaactcattacttttaacgtttgccttattattttatatatccttctttaagtttatttagttattcattgttgtagtatcttactctgaatgttcatttatatttctctgtctcttctgtttactaataaaaagcatttaaattgatgaaatgcctctccttgactttatctgcatcccatttggatatcttttaaaatttatcataaaggtgttataattcagtcattcttccacataagaattattcagaaacttatttctaaattatttttatcaaaaaatgttattctattttttaatttgaaagaatttaagtcttgaaatttattagtgacatgtaaattcctgactgagcattatgaaacttgtttagttcattgctgaatttggtattttgtcagctgggaacactaaatacccccacttaacttgctatttgtgaagctcagagtagcattggggttcctgtacactttggcaattgccccatggctaatttggccaacttccaattcctcagggagcaacaaagagttgtctcattgccacctgctattaactaaatgcttaggattcagtgtcctaggggtgactgggagacatgggaatggattattgtaacagcctgtggaacctccttccctggggaattttgagaacagcaaagaaccatctgtctgggctggttttaggagcagccctgcctgaaggcaggtgcacggattagatgacctgtgaagattgtcatccatcccaatgacttcaatggaaaggatgcatttgctgaatttgaaaagagtccaggaggaacactgataggtttggggagcatatggtcaagagcctgagggtattgagcccttcttgaaattggagacactcggtgtcaccccatgccctgaattccagaatgccataatctacacgtgaacccagcagtcattcacccttgaaaattatgtgcagatgtggttcacattggagtattcacgtcgttgttgatcataagcagaattcctttttaacacatagctcaactgatctatacccagaacatactgttgaccctgattcttctggttaagccggatctgcctgtataatacatcatttactgacccactgacattgagttttcttagcttgtttctcagtggttgttctgtgtttgtttcaggcaattaaatatgttgatgcatgtttcagaagagctctcctaattatatcaacaatagctttattatagttagaaaagacaaaatgctaaatgaattagccgggttaagtcacatttattgtgatttaattcttactgtatgtagtgtaatataaataaaataaaaattttattttattattattattattttttgagacgaagtcttgctctcatcccccaggctggagtgcaatggtgcgatctcagctcactgcaacctctgcctcctgggttcaagcaattctcctgcctcagcctcccgagtagctgggattacaggagcctgccaccgtgcccggctaatttttttgtatttttattagagatggggtttcaccatgttggctaggctggtcttgaactcctgacctcaggtgatccacccacctcagcctcccaaagtgctgggattacaggcatgagccactgtgcctggcctgtaataacatattttaaagttacagagaaagggcaatgtccccaaaatattttcatgatgatatgtcagacatatggagtttcaaactaacactgtggtaattgttgtgtgtctaaacaagtgacaacggggctgggcagcaaaactagacatgggagaagccaactgatccattgagctgtcccagcaagagttagtgggattatgatttatgaaagacctgtgtggacaaggtagtttggaggaactgaatggagggagtgaattaattagaagaatgagacaggactagccacaaacttctcctagaagtttaaactattttaaaaataagagttgtggctcatcaaaaaagtagtgttttcaaaaaacacagccccttcacttaaatgatacgcacagtccagatagactgcaaaacttaatgtttagaagctaacaactttttaaaaactttattgatctgatctgtactgagaacagattttctctgtgctttataataaaacataaagatcaatcacaaaataatttatcaataaattttaaaacaaaaattttaaagtgtatgtaaatatcatataaaattaagaaaaaatatgtaagaataatatttgcaatgactatgataagcaaagggttaacaactgtatgaaaattttcatgcaaatacaaatatcccaacagagaaagacaaggaatgtaaataattcttaagtagataaatacaaatggatatttaacttaaaaaaaattttattcacattagtatgaaaagaaaatttaaataattgaaatctagtttttcacttatgaaattagcaaagatttaggaaaagaaactactgtcatttgctgctggtaagaccgtaaattggcccaaaacttttagaaagttattttacaatatttctcaagaactttaaatgtctcatatctgtcaatccagacagatagatggatggatggatggatggataaatatcagatggatggatggatggatggatggatttatcagtaatagatacatagatggatagatagatagatacatagacatctatagagatatatgtttctatataaatatatatctatattatcctaaagaaatatatatttgaacaaaatctatttatgaaaatgttcactaatgcaaaacttataatggcaaatagaaagggaatctgctgaacaaaatattatcaatcccaaataatgagatattgccaaaacactatatttaaagaacttaagtgatttgggaaaatattatcttgtgagggcaaatacattaaatttgtatattcagtattgccaaatttatataaaaaaatgggtagaatttctttttaaaaaacaccttaaaatataaacggagtacttcccaataatcagattacatgtgattttattttcccccctaattttccttaattttcaagttccgtacaatgaacatgtgttattttcataagtataaaagacttttttataaaaagaaatatatagaactaattagccaaataggaaagtttctaagaacaagggaagaaatttgtgaatggagtggtgaagagatccttggactgagagctgggcaatgtggatactaacactggctctgtcacaaagaaacaaggagacttattgaggttctctcttctggctcaaagattttatgagccagtaatttatcaaagagcccatcctagtgtacccatgggcctgtcaaccctggtagacaggttagtagcccagatgaaatttcccgtggatgaattttagaactccgctccattgatcacccttttttgttgttgttgttcttttactcttctggaagagagctaagaaacttctgataccatccccctttcccactcgccctcagttgtgagatggaggcagcaaatattcagtgtgttctttttggtcttaagtagttctagactcagataccacctcagcaccaggctgagtttgggctggctttggctacggtttgctgctgaatgtatcagtgatggacttttgaatgtttaatagccttagggaatgtggcagtgtcccctacatagagaactgtagattctttagtccaccatttccaaccctgtgatttagattgtcattataagcatcacaggatgccctgagttgagaaaaatctgtgctgtttaaatggtctttaagcagcctttcctttctcctctttctcagctctattctgcttaggatatggcttatgccacttaatcaacatgctatcatatgctttctgcattccagacatatattgaaatatcttggttgttatagccatcttctcccacatacatcccctttctctcttcccctctacatttttttctgttacttgttatttttggtactgatgtgcttttatttgagtaggatattggaatgcaattgtcttcttagtccaccatcccctgacctgtcattattgaaaaacaaaattctgtagcaaatgagtccccgaaagtgttttttttcaaatgatgatgatcggtcacgttgtgaatctgtagactcctttgcgaaaacaacaataaacacagtattatttatggtggatatgctaggtacatccaaagctcttcatatgtgttgccttgtataatttcctcagcaactctaatttaatagaaactattgtccatgtatagatgaggtagtttatacccagataggttatacaaacctgtaagtaacagagccaaattttaaaggcagacaatgtaactgcagaaaccttgttcctaattgtttaatggaatatggtttagaattctgtgtggagaatcttactctaccctagtggtaaacttaaagctctttaatttactgtggttatattatatatgtgcaatggatccctattttcaaacatagtcgtttgataaagtgtgggctgcttttcatcacgaatgtaaaaagtctcttagttgctacacccagcaactaagtgtcctttaattcttaactttgaatacttaattggatccctggtgctatgtgtatttgatttttgttgtgaaagttgcattcactgtgtccctttatttgacatcagcaagatgtaatttctataaaccaattaatgatgcacctttcaactcttactatgagaatattagctggtgtaaatatcggactccttgtgaaggatgactcgctatctgattggtctttaaaaaaatactttaggaaataatggcttgcccctgcatataccaatttgaagtctttctaatatcagccattagctgggatccacatggagtacatagacaaatgaccatagtttctactgtaaaaatgcctcaagatcttgtaggtgagattaggcaattagataaatgcctatagcacaaaatgaattaacatgattgcttgaaaagaattaatttctgtaataatttgaagaaggaagaagttatgtatgctttggggggtatacagaaaggctttataaacaaccctatgaaaaaatggaccacagttttaaacgggcaatccacagaagggaaacactgcaatattcattggaaaaagaaaaggaaggaagggagtgaccaagagaagaaacaagaaggaaaggactgaaatcttgtttgcctttttggagaagatagcatttgaaatgggccttggataataaggtgtgattgtcgttggtggaaatgaattgcatccagaatgcagaaataactcaagcaaaggcatagagattggaaaacatggggcaggtagaaaacaagtccagagtctttgctgcttcttagaagatgtataagggttttattttatagttttataatgaagggcttttaatttcaagtgatgggtcagtgtataattccttaggagataaaattccagggaaaaggaggaggggttataagataaatctagaaatctaactcataaaaattagttcccttccagggagttagttactccaaaaatatccttgataagctaactctgcatggatataactgtgttatctgtgagctggctacagacaagaatttacaattgtctgtagttgcagtctttgagctgcagtcattcaatctctgtctactgctaaaagccagagtttggaaagagcccttatgcatgcttgataatgacacaatttgactgagaatactgccattttataataatctctgaaagttacttccttggtctactgaatctcatattttgtgaagttaaatgaccaatgactgtcattcattggccatgattgtcttgagtttgttgatactaaggtgttatttataatgtgccttttgtttctcaagaatatgttcgcagaaatcaccagtagtgttatccatgtgtatggaaggccagactgtatccccttatgtactaacagactgtatggcaagaagggagccaggttgtcaatgtgagagctaatgttgatatcaacacaggcatcagaaagtcaattactctgtttccctagtttactaaatggtgcttttgcaatagggaccatgttgcctaatgggctgtgaactttaatttgttcataacagtgccaatgagtaaatggatctacctgtggactttagagtgtacttctaacattttaggactgcaagaaagtagtgtgttttatcctctgatacattcatattctctattggagcatacctatccaagcccaatatcctacatcagttttaataaagagaaattacatttaattgtgtctctatcctttcatattaatccattatgaatattttattccacaatgttagaaaaattacattaacttattagtgaagaacattcttttataagaagtgctttatacttcagaacctcataacttactttaaatatttcaggcacaataactggtaagagatgaaaaataagcctgaactcatagggtaaggaccatttagaagtcttttgtcttcagcttgtgattgttcagttaaacttatttgatgtgtgctcagcaggttgtaaaattcctatctttctggagtgatccataagagattacttcatagtgaaacacttaagtttgattcttatgagttgcaaaatgattttccaccaggaaaaataaagaatatgggttccatcaaaagtcaggcatgaattctcatctcctgataaaatgtgaaatatctttgctgatcctgtgcctattctcagtttccatgaccatgcacaattattatttttagcaaataagcaaatttgaggcaaaaacattaatttgataagatatctgcaaatgcctttctggaggagaaaataaatttaaaaagcatcagtgtgtttcactgatatgcacaatcccccacttcttataagaaattaaaacactagtttttaatatcttcagagagaaaatgagtaaaggaagcacagtattttccgaaacgtgttatttaaactaaaaccatgaaatttatgaaaaaaaaaaaaagtagacccttccttgatacacttggtcccaccgaggttcaaagtttcctttgaattggggggggaagggagattctgtaatttaagttttaaacttctgtctttgtatctatccttgtgctggtactccgctatcttggttgctatggttttagagcaaatcttcatatcaggtggtctaagttctccaactttgttcctcttttccaaaattagttgaactattgtgcatcctttatatttccatatacattttagatgtggcttgtcaatttataccaataaaggattctgttgtacatgtaaaccaaattagggagaactgacactttaacaatattgtctttcaatgcatgaacatggtatatctctccctttacttcatttttttttttttggttctctcagcagtgtttttaattattattgtaaaggccttgcacatattatggaacaaacacatattatggaacaaataaatgtaaaagctaaatctataaaacttttccaagaaaagaaaagaattcttacaaccttagataggcaaatatttcttaaggagtatacaaaaaaccccacaaaccataaagttaaaaatgataaatttgattttataaaaactctaaaacttgttttttaaaagacaccataacaaatgaaatagcaagtcccatacagggagaaaatatgtgtacagtatgtgtatatgacaaagattttatgccagaatatagaaataattattaaaactcaagaagaagacaaagaatgcaatttaaaaacaggcaacagatttgaaaataggcaatagatttgaacaggtacttctctaagaaaatacacaaataaccaataagcaaatgaaaaatgctcaatatatgtagtcattaaagaaacaaaataaaactctgtaaggtacctccatacattgatgagagtggctaagactaacaataccaagcattagctaaaagacagagcaattgaaattctcatacactgcagttgaggatgtaacatggtactgccactttggaaaacagtttggtagtgtcttaaaaataaaacgtgttcaacatatgacccagcaattctcctccttgacattgacccaagtgaaatgaaaccttttttttacacaaaggcttgtacacaaatgttcatagcaactatatttataatggccaaaaactggaaacaacccaaatgttcattaacaggtgaaaggacaaattatgctatatttatacaatgaaagatgactcatcggtaataaataaatgatctgctaatatgcacaaatacatgaaaaaaatcttaaaaatatgatgctgaataaaaggaaccagagctacctccacccctaaaaaagactgcctaccttagaattatatatttacaaaatcctggaaaagacaaaactaatctatactgacacaaagcaatcagtggtttgctgaggctgggagtggggaaaggattgattataatggggactgacaaatagggaactttttggggtgatggaaatgttccagatcctggtaatggaggcagttacaaagtcttataaatgtattgaaattcatcaaagtgtacagttaaaatggttttatttattgcatttagattatacctcaacaaaggtggttttaataaataaacaagaaaaagtgtttttcaccaattggtttgaaattcggccaaggcatatttgagcgagggctgtcagccttgtatttgttgcaagtcacagtgagtatgtcctaatggatcctctacaaggtccaggttaggtttctttaaaggatggcaagaacctgaaacagtgtgagtgcagagaacagtgaaacagtgtgtgtacatagtgctttgatttttgtgcattttttggtcctaatattttaaagtttgctgaaccatacctcatagaacatttacctgctttttctgagggaaatatctttatagaacttttccaaagcattctgcatagattttattttaagaaattaaaacattttatttgtattaatttacataataattggttaactcacataattacaatgacaagatcatacagtaggagcagacttgggatcaaatgcagctgactctaatagcaggtgtagcaggaggcacacagctgaggggacatttgagacgaaattgaggccaggttccacttcacattgtactagggttaagcgtgtccacccagaggaagagaatccttaggcctaaaagagcaaaagtgtacagacatactcaagagtaagagagtagccaggaacaccagccaagccataaactccagtctgtgtgtgttaacagataaaattaagagggtaatctagggagtctattgctaaatgaagggcacattaagtctcaacagtattcctatgatcaatcaagcaaccaatgaagtgtacaagcagaagtgatttgtcatggaatttcagagccagaaagatccttaaaaaggcagtgtactccaacttcctctgaagcttgtgtcctacctacagaattcccaaccactctgcttgaatgtctccaaagaggaaaaaatttagaagagaagacaaggaaaattaatcacaagataggcaatgaataggcaagtggtaagaggccagttttcccatcctcatttactctaaatttgattcatagattattgagcctcagatatctgtttgccatctggtctggtcagtctggtttggcatgcgtcttctttctctttagagtttgatgacgttttaggctgtgaggggcatttgcattgtagtagaaattggatgatgtcagacttgctttatcacactttctcaataatctcttttggtgagtttgatattctacttacagctgctaaagctccttataaccatacgcacaaacatacacttccatatagtcatacatactcacaaacatatatacacagccatttacttacacacgtgtacacaaaggtgtatatccacacacttacatgcacaatgagagatgcatagtaagaatttttccactacccctagtttaactggaagctgtagaaaatctgaactttattatattgatctctgggatcatccacaaaattgcccaaaatgggaatgcggaagctgtttcttacctttcattttctccacatccaatgtgtcctcttcaactgtgtattttgaaacaacctttgaatctgtccccttcccgcaactgcactgccaactgctgatatcattttttgcaaacaagtgtaatgaaaagagcatattctttaacatcaagcaaactaaggtgcaaattttagctctgcatgtattcattgtgctatcttggacaagttatttaactatcctgagcctccttgtcttaatgtgcagatagaagaagataatgcctacctgataggtggcataggaaaaggtcaaaaacattattttctactcccattgctccccttgcctgaaacattataatggccaaacaactggcctcccaacctcctttcccctcttcagtttttcctctacattatagctagagattttgctaaaatgtatatatggtcatcccattttttacttgaaactggtatcttcctgcctataaaacacattttgtttcttagtctcacataggaaatcctttttagtctgtcttgggcccaggactccagtccgattttcctcccattcctacctgccctcttggttttgaatgttccacacaacttcattcctttctttgttaattggcttttcctttacttagaatgctttcccccttcctgctttttagggagaacagggtaaactgttctccctatccttcattgagtctcctttcttttttctaaagttttttcttatcagcatccctcccccaatttgagctcattttctagaaagaattaatagctttcttatatgactctcaagatatttctgtgtggttctctaacagccttcatttattttatatggtaattatagatgtccatttgttctagggaaggcaggtgtcaggtcttactcatctttatattcctggtttgacatacagtgcctgatgtctagtaagcacttgatatctgtttattttaatgtttatgccctacattatctatcacaagtattaaagattgataggtgctctgtaaatgttaaattgagttaattattttcaatcttacaggaagttacataagtcattcctgtattcatttgtgaattttcgacatcctatattaagagttgcacttagaatgtgagttccatgagggcaacagcacttctgtcttactgctctgtctgctatgttggcccataattaaccactcagtaagccttttgtgaaaacaacctcaatgagtcttctacctcaagtcttttgaataggaatggatttaaagctgacccctaatacatctttcaaactttaagtcagtaaattttttacaaacttttttaagttgataaatccctcagaaattattctgaggaagctgatgggatagaaatgaaacagactaaggggctccaggcaatcaccactccccttcgttctccttcctctgttggtggggatcaatagagcaggatcctcaaaactgtggagttctttggagcatactttgaaagcctctaattctattccacgctctaatttccaaaagagggaactgaggcccgtggtggttaaatgccctttccgaggttacacagctatacatggtagagccgacccatgtcttctgactctcatcccgttgcacttacaactagcctgcatgttccccttttcccatatcgcatggatagcatcttacgcatctaagtttttttctttaataatgatcttctcttttctttaagagacaccatcactccgagttgtaccacttgcaccaggctaaattattcctcagtgtttacccctttcagatatttatagaccatcattatggcactccctagtcacctgtcagcttcctaatatgtacatatatggtttctttaatctttctgtacagtcggcttctctagtcccttaatcatttgtaccattctctctctaatgcctataagggaactgtttaaatatagtccatatgggaaaagtaacctcaacatgttgtaacagggggcagaaaaacacgctgaatagatgaaaggaacaatctacaggttaattagtagtatggccacaaatatgtgcacagttttgtttcagaaataaagcaagctgtatttgttgttaactatctcttctttgaacttaacagaatgctgataatgccaagctgtgtttacagtccaaatttttgctgaagaccttcaactttgcactctccctgtgtggtatctcttgcccaagacagaacttcaaataaaatcacatagctgatgcaagaaaccgttactgagcgtatccatttttatgcagtttctgtggacttacatggtttctgggagctccctataagccttagtaagggaaagctcttgacttatctcactagttattagggatttggatatatgtttactaaatgtgataatctaagtatggaaactacattagtacaagaggaatcacccagaaatactctactggcataaataaaacattacctattgcccagttttctcatttgtttcattttgtaacttttataatgtgtcaataagtttgaagtcttgaagggctgcccagaaaccaccacagagtggattttccttaccctcaatctgccttcatcaaaatttagtttgtgtgtttatcctataaaatttatctcataataaaaactgaagactaggacggtccttagaaaaacacttgattcggtgtatttattttataaaagggagtcacagagagaaaatgtggccagctcaggtacatggcttcctaggcaatgttccatttcccaaaactttcattggtccagaaagtgtaccttcattcccaaccaaatccttcctataatgctttccatgcctttcttctgtggctctctctgatgatctcacaggtctataagctcttacaggtagaaatatgatttcttgctgtgttcttattataaagcattgccatgcaactgagaagtaatgagagccagtggattttattagaatggaattttaacttttctactttaaaacccagtgattctgctagtctggaggtagcaaagaaggatgactattttctctctcacacaaagtaagattctgaaggggcttattctctgaatgaaaaacgagaggagaaaagtaagaaccttctaatgttttattcaaatgttaacaaagaaatttgagaagcgtgtttccttaaaattgacaccatttttatcccaaacattctggtaagtgatagcagatgactgtgcaagcttctatggagagagagagaggaatttttccaggagcatagtcccagtgggaagtattacctaaaagtaatacactaatcactttcaatcttgcatatttccacatactgtgtgcacacatatgtgtattaataactgttccctagacgtcacttcagcgctcagacagcttagtgttgctatgcgaatgctggagatggaatcagatgcagactacagtttagcaatgagaattcttcagagatacaagaatggaaatggccttaggtcctgcctcatgggtctccctctgagctccagtgtaacatcgggtgtcaagtatttgtggccccatctgcccactccactgagaatctaaatggcattgccagtatttgtgaggtactcatatcttaaaagtcagtgtactcaaatcagtcttgcattctaccttgtggattttgcatggaaattttttagaatgtcattgctgatggaagccccagatatataagtacatctgctccatcgtactggtgatttttatagatattcataagaaaatttattttacagcagtttattttagaggaattctttgcattttatttgtatgtgtgtatacttattttactggcaggatacacacacatgtatatacacacacacacatacatatatacacatacatacatatatatatgaatgtatgtttgtatcctgtcagtaatactttgaggtacctagggctgagattactatttctcttccacctatggctcaaatgggtaaaatagcttactcaaagtcacagttcatacatgtggtgcagcttgaatcaaaactcaattcttctatccacagatttaccactacttgagtagtctgtggtgtttaaaaaaaataataaacaacaggccgggcacagcggctcacacctgtaatcccagcactttgggaggctgaggcaggtggatcacaaggtcaggagtttgagatcagcctggctaacatagtgaaaccccgtttctactaaaaatacaaaaaattagctgggcatggtgacgtgcgcctgtaatcccagctactcgggaggctgaggcaggagaatcacttgaacccgggaggcagaggttgctgtgagccaagattgtgccgttgcactccagcttgggcaacaagagcaaaactctgtctcaaagtaataataataataagacgaagaagtaacaaagccaaactggaaagtttctgttaaatgaatgttctagataataccaacgtataaagcaatcattttataccagctatggtcaaacagggaccagagccttgacttttttttgcctcaacacagctctgcagaacccactcagtaccccatgtcctactgccattcctttggtttccagaacattgagatgtacaaatccaaaacaccacagtgtttcagagagaaatggcatgactctactggttgcaattgtaatggagttcaccttgttctggagtcatacagaagccatgttgtagacttagtgtcccacgcaatactcctaattacaatgaaaatctactgttaggtagaaggagaaattcctcacaatcaggcaacagcgcctactagtgggaagaaactgatacttgaggtagggcacctgggagatagctctgtgcatcttgagagagtgctacactgagagcccaaaggctctcaggtctcatctctcctgacagcttgctatgacatcttaatcaatgaattgcctctctcttaccctttgttattgagtctgtaaatgaagagtttggaatggctactttctaaattttctacacgtcctatgacccttgaaatcctcttaacaatgtattatggatactttgctactaaacggtaaaacagaatcccgagtaagatgaattggcttcctaaggaagtagtgtcaggggagaatagcaccatctttggggccagttccatttatgcaggtaatatggtatggtccagctcaaagatcactggactgggctgagttgcaactctgctacctacttctcaagtcatgtacaaggtcattcctatgttaactcatgtgttgggaagatgataattgtctcatttagcttttagttattataagattcatatgagaatatagaaattatgaagttttatgtgaatctgcaaatttattttcagtctttatatatcacaattttaatttaggctaattataatttttattttcccctttttgttctatattctaaattcgtatctcccatggaggcaggtactgtatggacaaaatcttttattagtcacatattgttttcatccattttgtgctgctatagcagaataactgagactgggtaatttataaagaatgaaaatttattttatcacggttctagaggctggtaagtccaagatcaaggcaccagcaggcttggttttctggtgagggctactctctgtttccaggatggtgctttgtgctacctcctcacatggcagacagtggaagagcaagccagcagaatgccgcatgaagcctctttcacaaagggctttatcccattcatgacagagaagcccgtatggcctgatcaacactttttaataaaatcacaatatctactgctgaattttggagggaaccaattcaaatcatagcacacatcttttctaaaatggaaagggtaatatgatcattggagaaatactcattcctttgcatattggtttactatccaagccaggtgtggtggttcacacttgtaattccagcactttgggaggccgagatgggtggatcacctgatgtcaggagtttgagactagcctggccaacatggtgaaaccccatctctactacaaatatcaaaaaattagccagccatggtggcacacacctgtaatcccagctactcaggaggctggggccagagaattgcttgaacctgggaggcagaggttgcagtgagccaagatcgcaccactgcactccaacctgggcaaccgagtgagactccatctcaaaaaataaaaaaaaaagtttactatccagagaatcttgtccaggttaacactcttttttgtctgctttcttcttttgtgaaacaagaaggtaagagggacactggagaaaacctaatgttctttacaaaatgagtcatagttctccatctgcaaactgtggctcccatttatgtcttggtgtcaatatgactattacatgttatgtacatggattccacctcatttgcaacatagtcttctgcctgagctctgtttgttggatctgatctaactttacatggtcttaagtcacacattgaactcttaagttctgtaggcctctaagcctttttaagttttagtattttcatcgttaaaatgagagtgattataacccttgctttgctgcctccaaatattattgagggatcaaatgcattgataaataagataaagcactagacaaatataagggatgcttgatgacttcacagagggaagattattctgttgctggctgctgaaatacagtagctttagaaaaacccctttgggttcccttattatcaggtttggtctcaaataaccagaataaatttggagatttcctaccacaaaagctaaaagtacctgggcagatttaccctttgagtggacctaagggaaatgcagattcccacgggagagatcacggagcagattcaaaccataaggcaaaaataattgttgcaatagcggttctaactgtactagtaaatattgatttttctgttagcagatcaatcatgaaatgaattctaaatatagaagactggttaaaaaattaagacggagaatgtgaaaatgtccatgtgtaaaaattaacttaaagagaaatcttgctttggccaaaagaaatactactgtttctgtcaggaatgttctgtgatttaatcaagtttcctgcctggccagataattttaggaattgtggacttttaaagtagtaagtcagtttagaaaactggttaagtggacagatgtaaagtcagactgcctaagccccaattccagcttcaatatttaactctgtggttgtgggcaaggcacataatctctttatgctgccttttcatcaactgttatggagataatgatagaacctacatcatagagttgttggggtgactacatgagataatacaattaaatacttaacacctggtccataaaaagcgctgaataaatattgactattatcatcaccccggggtctacaaatttttgtaggattaggattaggattgaaatttctaccgaaaaattccatcagtaaaatattgataaatataaatcttaaccaactgcctcagagacatagggacctctattttccactcattgactgtcatctttagagaacagtccaaagcatgtgcctttctgttctagttgttatgagctctttattttgaagttgaactatatacttcctatagtttaaaggagaaagaagtaggtctcatgctggacaccttctagatgttacctcctccgaatttcatagccaagtatttaaggcagttatgatcatctccctcttagagaagcctagaaaaggttactgcagtgcttgacagcaaatagaaactcaccaagtgcatttgttgagggattgacagaatggctggataagtgactcaactaagaccacttatctagtgagtgcgtctactcagctgcttgttttgaagacaaggaaattcgggctcagaaaatttaggaaacttgtctaggctgccaatagctagtaacaaaggcaagaattgcatatctgattttctttacaccatgttacatctaactgttcaaaagataaccatgtattatactcgaaaatgcaaaacagggttgttttttgttttgtttgttgtggtggtggtgatggtatttttgttttgtttttgctacttttcctgagagtggaagttgttatcaaaaagttactgtcatgactactatgtgtatagatgctattagtttcatcaaggttgggaatagggtatatgttgcccaactttctgcccctctccgcctcatattaaagttccagtttcctagaatatatctcctgggagatttggcactagccatcactgcattccaataccccgggacaaactactcttggtggaacacagaagcatacagtccttgttacagcagtggttctcaaactcacattcctgatggaaagctagagttgaagggtcaacacccaagagctgcagtggaggaccatcacctgtcctgattcgccacctgtggtagatcatgactttcactaagatcccctgaggcttgtggggatggagaagtgatgctggactggcccttcctctttccctgcaggtgttaatgggttctgctcctaaacaatactgatataggtcagagttatgattgaattgtatacatagaaacatgtgctgattgagaaaatgggctttacaagtcagacctggttccagtctcagccacactacattctgcctttgagactttggccaggtgatggaacatcaggtttcttatctaaaaaggagaataattggttggtaggactaaatgaaaaaatgtatgtgaaatgcttaggacagtgctgagcacagataaaaatgcacaataattttctattttttgttagtttccttcacaatacatatatttacatcagcgaaacatgcttgcttttgcaaccttctgtgggactccccctcctaatttaccacctcacctgaagttctaagctaagcaaatctctgtctataaatgaatcacatcgtggttagactttataacaacttccccttgccaggagatcactcagccttcacttcatctcatctggtttgctgcccaggcctttatccactcattcctgaactcctctccctgacaaccttggggttttggcttgttgtgtgcgtgtgtgtgtgtgtgtgtgtgtgtgtgtgtgtgtgttttgttttttgtttttttttactttaccttaatttctctttttggactaagatgttaaaatgtttcttaatgtgactgtctccgaaactgttttgtgtctaccactcatcctagtggcagtcattgatccttttcttgttgcgagtgtttgagtgtgggtgtgtgtgagtgtgtatatgtatttgtagagggaaaaacaagagagagggaaacagacattggagccacctttcccccactagccacgtacctgttgaaccttcaagcctctctatagaatcagatatacacaagcacagtgacagaactacatgtgtcctacagtccagcttttaagatatgataaaaactcttgtattcacagagctaaatggcaataaccataggagattgcatattgctacattatgtaaagacagagtcccaagaaaatagtgagaactcagtttgatgtatgatgtgatatgtgatatcttactttacatggctaacagttgacattctttgtggattctatattgtctaaggctacagaagagccatatgataaattcatcggcaacccaaaagaagcctgttctatcgcagtgcttccaattaatataagtaaaccactttctctggctcaatgctaccaaaatattttatgagaaaatttagctgattctgctcatgtatattttcaatggatggaaagccattgcaaacttttcaaactaaaatataaagatagcattagggagaatactctctctggtgaaaaacaacatgtattatgatgcgttaggaatttctttttttcagccaactcgtggttgagcagtctgtccccaaactgttttgcatgcggacgaaacctgtttgggcgatacttgtcagcttttcttctgacaagcaggacagaaataggcacccccagaacactgagtttgacttgactcaacatagaatcacctggagagttttaaaagtttctctcctgtaatatcccacctccagaccaatgaaatcagaatctttggagttgggaaccagggatcaatatttttttttttaagtttcccagatgattgcaatatacaggcaagattgagagtcactgtcctagagtataagcagtttaagaaacaagttgtctattattacatgcatcaatactacagagtccatgaaataaaagctttggtgataagaaaatgccaccatcctagagccttcagttaacatcatatgggcctgtcatataaagaatgcaaactcattctgttatctttttgggccttcagtggaagataatttttaaatcagcttaatggaaactgtgcttcaggaaaataacttcagtagccatatgtaggataaactggagcaggttttgtttctaggaatatgttgccatcatttcactacccttatataatcttattgattcaacttttagaaccaagactttttgcagaatatatcgaagaatgtgcttaatgggaatgctgatatatcatacaattggcatatagagcttcagttcattatcatatttaaaggtacaatattaattttgcttgtgcttaaaatgtctattataattcaagtagcaaggaagacataaagaaaaatgtgacctggctttacatctgcacatatttaatactttacatttgatggtgaataatgggaaagtttgggagtatgtcatgctcagtcaccatgcatcaactcccaaaatggctgtggacagctttggtcctgcctcaaaacaagcactgcttgcaaaagagggtctgtggcttatttttatcagttgtgtggtgatcacaggaaaaacattttaaataaaaagtttattttgccatcatgaaagaaacaaattcatattaccaaaagagaaaataaatatgacaacccagcctggtgcagtggttcatgactataatcccggcacctcaggaggccaaggttggagggttgcatgatcccaggagcttgagaccagcctgggaagcacagcaagaccctatctgtacaggaaaatattaaaaattagctgggcttggtggcgtgtgcctatagtcccagctactggtggcaagggctgagggaggaggatcacttgagcccaggagttcaagggtgtagtgaaccatgatcgcactactgccctccagcctgggcaacagagtgagatcctgtcacaaaaaaaaaaaaaaaaaaaaaaaaaaaaaaaaaaaaaaaaaaaaaaaaaaaaaaccccaaaaaaaaaaccccctttttcccttttcccctttttttttttaaaccgggaaatttcctgggaaggccctttttccccccgccccccccaaaaaagggcggggaaaaatttaaacttttaaaaaaaccccctttaaaaaaaatttggaaaagtttttttggggggaaggggggggaaatcaaaaaattcaaaaaaacggggagcccttgggaaaaccctttaaaaggaggggggttttgttaataccccgggggggaaaagacacctttttcaaaaaattggggggggggtctataaggggaaaaaccccgggggaggaaaaaaaaaaaaatgggggcggggcactaaaagagccccccccccaccttgtatttaaaaaaaaaggggttttaattataaacccccccctttttttgggttttggggggggaaataatttaaattttcctggggagagaaggccccccctgggggggggggggcccctcttggaaagggaaaattttttttagggacagggcgggcgccacaacaagggggaaaaaaattttttttaacaccccaccccgggggggggaagaaaaaaaaaaagggggggggtccttttatagccccaggagccctaaaaaaaggggaaaaataacccccgggggttctttgtgtaaaaaaaggggggaaaaactttctcaaaaaaagggggcccaaaaaaaggggggggggttttaaaaaaggggggggaaaaggccctttaggggcgcccaccccttggtgggggaaactttcctcctctagaaaaccccccaaaaaaacaaatttaaaaggttttctctgaaaaaggaaaaaaaggcccttttttgccccggggggggggggcattaaaggggggccccccttttttcgccgggaaaaaaggggccaagaggtacccccgagggggcccctcgttccaaaaaaaaagnnnnnnnnnnnnnnnnnnnnccccttttattttttgttgtttttttagaaccacactttttccaataatattaaaaagaggtgtttgagaggaggtttatattcaccacggggggatagaagagcccgcggtgctctctattatagagggacattattatattgtgcgtggcgtaaagagtgtttttattttcccggggcggaggagggcccataaaaaaaatgtgggcccgcgtcttccccgcgcacattattaatcctcccccttgaggggaaaaaaagagaaaatttgggggttatttattttcaattcccccaggccaattctcaaaaaaggattgtgggaagattttggttctcccttaaaaaaaagaatgtttttaaaaagaggggggggggctttttttccagagggggggggcccccggaaaacctttttaaaaaaaaggttttttttgccccaaagaaagaaccaatttctttttccaaaaaagaaaaaaattatgccccccccccctggggcagggggttaaaacaaaaaacccggccccccagggggcaaaggttgggggggtgtattatccccgggggtttggcccacccggggaagacaaaaaaacccctttttggccggggaaattttaaaaatttctggggggggggggggggggccaaaaacccccccccttggtggcaagggttaaggaaaaggattccttttggccccggggtttaaggggggggtgacccaattttccccaatgcccccccccccgggggaaaaaaagagattcctttcccccaaaaaaaaaaaaaaaaaaaaaaaaaaaaaaaaaaaaaaaaaaaaaaaaaaaacacaaagaaaagaaaacccatatcacgctatgccacttctcttgttcaacctgtagatttccctggaatgccactattcacccatgccatccccaaaaatgacttgttaaaattctaactcttcagattagctccattattaagacttctgtaaagtctttctgttggtaagaggaggtaaatcagagatatcagaacaatcaggaagccattgcaatagcctttgaaaggaagggtgattaggtagtaggcatgtggtggaaagcaggcatttctgacacattgctgaggttgctatagatgggagagcagaggtgaaggataagaagaattgttggctgaatctagagtcagtacaaagcaatatataaaataagtaataatatataaacaccatttttggttttgtttggaaatcttaattcactgacaaagttccccatcggctgccggccctctgtcatcggatcttttgattgactgactgctcagcattggcagcaagctcttcacaccagccctgggtctgagctaatcagctgtgtttccttcatgctctgatgccttgaagtttggtactattctcctggtttctcttgtttaaaagtgctgagatacttgtctaaaagatgggccttaagattgtggtgtgcttttaataatgtgtggggtaagtgcctctagaggcaagcatacactatgcttgagtaactttctctccattctgaatctctccctaaaggacacagtttgtaaatgtttgttcatgtgaaaagggaagattcaggtaccttttctgtcctactgatgtgtggggctatttttatgttttgttcttcacttttttctgtacttgtgatttaaaggtgccagactggttaccctcaaggctagtgtccccactgtatcccaagaatagaaaaaataatgagaggcagcaaaactggcctgtgtctgagtccagcatattaggctgacccactctagaggaatattctccaaagcataaagtagaagatcattccttaggaatacaatacagtccatctgttttcatagctgagaaggcaattccgtgtcatgccatcatggagccactgcagtgttttggtatccaagccatagtcactcattctctccgtgagggaaaactagaatgtcttttcctcttccacctttacctttcaaaattccatccttgaaggttcggctcaaatgcttctttctccacacaacctttcctgagcccctgtgagtgtggttttccttccacattccatagcactttcttctaagacgtgttacatgctttgccatgtgactattgcatgtaggttgtcttgactgtgagaggcactgacatcgtgacatcgtcgaattcatttttgtatatcacacagaaggagaacatagtcgtgggcaagagtagatatttgaggttgaatagatggaccatttcaaagcttatcttttcagcctgacctttaaggctttgctctggccgttccctctaaatcagtgattgaagtttgctcccagatcctcatgagtagctatcaaactctccataagccatgtaggctcaggttcttggattccaggtattacacttcgggcatcatagtctgaatcaaaattgctacttttagctgcttagtagactgccattaccaatagtttaatgagaactacttttttaggggacggggggaagtgtggtccacagatccctgatagcccttcgtgtactatgtagtgaatctgcttgacatctagaaaagggaagagtaatatagaaaaagaattttgttgacctgcctgcatttaacaaatgtaaaatgtaaaattacagctttcacaggaatctaatatgcttttaataatcatatggattggtaatccatttactcctaatccctaattcgttttctgcaatgaaatgttgtcaaagggtggcatgaagctgttagaatttaagcatgattttcaaacatagcacattttttttgtggttttgtttttttggttttttttttttttttttttcagaataatttcaaaaatagtgccatatgaaatagttttgttactgttggcaggaaagtccaaaatgttatctcataataaaaacaggtacaagttcagtcttggataaaaacttttgaagtctgccacaaacaaatactatacaaaattttttcatcaaatgtcaagactgtggtatcaagactttataatgatatcaactgtagtggtgacagcttagtttccaatactttaactctttttccagcacttcatatttctttttggtttgagatgaagtctcgctctgtcacccagctggagtgcagtggcgccatctcagctcactgcaacctctgcctcccgggttcaagcgattctcctgcctcagcctcctgagtagctgtggttacaggcacacaccaccacgcccagctattttttgtatttttcatagagatggggtttcaccatgttgaccaggctggtcttgaactcctgacctcaggtgatccacccacctcggcctcccaaagtgctgggattgaagacatgagccactgcacccagccttcatatttcttattccttaggaaaaaaactaagatgtatactttgggttatatttaaagtcacattcaaatcccacaacaggatataaagaaatacttttcagggccaaatacaactggagaggattagaaataaatttacctttttttctctcacgttgaaacatctagccctcccatgtttgagtgtgaaatggctgtcaatccaatgtgatggagtgctgaaagccgtcttcagtgagaagtctctccataatgctccctaacatcagatccatgttaatcctgatgcacagaactgggaataggtaatatagcatagtgtttaagagcacagatgctgaagttagactgcttaggctggaatttagttaaccatttgtgtgactcagtttcctcatctgtgaaataggcataataacagtacctgcatatagactgttgtgaatatgaaatgagttaatatatctaaagcccctagaaaaagtctgacatatgtgaagcactacatttgctataccttatctatcaaagcctacagcttctggctaacattcccagtgttctataattattagatagaattttttttaacttagtagaaacaaagactaagaagggaaactagatgtggacgtgacgtctagctcaagattcccatgatggagccacatagagatatggatggcaaccagcataatgcctctcactgacataactatttgtctgaatttatattttattgttattatttaaagcttactgcaaattttaaaaactgaaacctgatgtccatatgtaggccagatgccacattaatcaatttaagaatgctggagcttcgcagaatactgcatgaacaacgagaaccgtggccctgaaagactcaaaaccctacagtatatgaaactattgcaggatgtgtggatgttcaaaggaataacagacttggaagcaatgcttactgaattttgatgtattaaaggatgtcaagtccaagagagagataaggtctcagaagacagaactagaaccatggggtaagcagttagaatgaggaagcactatggctcagtaggagaaagaaccttttagccatcaaagcgatctagaaattaaaggactgccttgggatctgcctgtcactgagagctggctgcagaggttttacaatcagggcttttgtaaaaggaactaaaatttgagtttggacccaattatcttacattctaactggatgtgtagaatctccaagaagaaagactcttctgtactgttttatagattttgccttccactccaaacatcctgagtcatgttccttttatacttgcatgtgagatgagagtcagagcactgacctcaaagccagcgaccgggttctactgttcctttctgcaagaacttagactatgagactcaatcccctcaaccgattaatgtaaaatcccctccatgccaatcttgcagaggataggggtggctgtactggtgatcttgctggggtaatggggtaatagtactggggtaatgacggcaggagtggtggttctattgctgctgacgttatgaacctgctttctcctccactttggctttagcaggactgaagtactccttggtgtgttcttatcaaacccttttttttccaggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattgtaagttccagatttgttcctcaagcactttgcaaagatgtcttctgtggctgaatgccagtcactctagatagaatatagccatcagatctttgcttcttcctagacttcaaaatgtgtgtgtggggtgtgtgtgtgtgtgtgtgtgtgtgtgcgtgcgcgcatgtaaattagcatattgtaatttttttctacacatcccccattcataagcagtcagaaaggtgtattagcatgggactgccattcagttagtggtctgctgggaagatcatcagcctgtggctttctagcatgtatgtacaagctaaaattttctttcttaaagcatcagaaagctttccaagtagctgagtcacacctcttataagatctcaccctacatttgaagtgcccagtagtttcaaggaaactttacagaatctctggacttgtcagtcctcttccagaatactgggccctttgagtccatttttatctaccaaaatgtttcttccccctcttatccaacaggtttttaatgatgcaaacaggggaactgtttattataaagcaccttaaagagaaatgaacagtaatgctgactgagctaatcattgttttcttttattacagaacacaaaaactatattttaataatatacctgggtaactaaaaaattctcagtcatgttaccttagcgttttacaatgctacttacttaatctacctgttaaactattctctggtagagtaatttgatgaatgaacacagacttttttcatctattgtaaatttctttgctatccttcagcatgattttaatctttgtttaacacatgttgatgggaaaagtagtgttttttgtttgtttgttatgtaaacccacaaaacagtcatggtttgtccctcagtgcccagagatttcaacataaaagacaccttggtttctttaccaaggtattgggagtcatacttggctttacaaggttcacatttattgaagacgtttttggcctggttggtattttcctataacttggcagctctaacccattgtaaccttggggtctgtagcacagatctgaaagttcatcaagattaaggcttcgtaggattaaatatggctttgcatctgtcttaggttcaattttatttcgttttctttccaaaggtaacttaatacatgtaacatcatttctttccaaaggtagcttaaacacatgtagagccatacagtggtagagttggaaaaaaaatcttaaaatcatttgcgtaattactctctttagcaatgagaatgccaagacatacagaagaggaaagcgacttcgtatgacctatcattagtgtcagaaccaaggctgcattccgttattcacgctccacagtcttagattctttgcagatgctacatggttttcattttcctaaacataaagataaacaaagtaatgtactgttgatctggaaggagcaattatgcataagcgaaagtctagtaaacaaaagcttacctctttagaatataagaatatttcaaatatctttgaaatctttattgaaaaaagaaaggcattacataattccttgcctttttaaacagactaaaccgggtgtcattcacaatggcttggcaccacgtttatgaaattatttattgccacgagccctaaggtagtgatgttggcagagtgtgtagaggcacccagggttgtccttacaccaagtaaacacatactgctgtgtttttttatagctcctgtctattttttatccctttttgactccatagttgatttttgctactttaatgatgctactgtggcagcagccttcttcagttgttttgtttcaacccttgttagcttgaaatcatatagacagtattgggaaacagtgtaacagggtgggaagaacatgaatttgaatttcgttacgtcacttagtgcctcccctccttgggaaaattatttactctttctaagtatcagttgcctcatctatataatggggacgatggcagttattttccatgaagaagaaatgagacaatcctagtaaagcacactgggcctcttcaggaaaagtagtggaataaatgttattctgggattaactttaatgatgtttctgaaactgtttaatatttctgaatgtgggaaccttacatgtgcagtgaaattcactgggctttaggaaattattataacctttcagacatactcctcgcatttttacatgtttgcttgcttttctgagtgcgtaacaaaactggagaaggtctaatctgattaaataataggtttctacagtgtgtgggctcaagtttctatctccattccaggcataggatgggtctctgtgattctgtaggatgccagccccttcttctttggtttgttgttactatactatgcttatgagaaggaaaactatccgggagatatttaatcgcgtacttggaagaactgggtgaattcaaataatggaaattctaaccatttttttttttttacttctttccctcataagaacatttaatcaaggtttttctttaatgagatctattcgtggtgactctaaaatgtaatttaattcttatcagaattcagttaagctttaccaaagacccttgttcaatattgattcgagttcagcacagtcctcaagccctcagatggatgtatcagaactttaatttcttctgaacttttatatgtccaataagctgcatactagaagtgtaaggaggttgaggaaattgggcaaatgaaataaaacaagttggctttgaagatagtttgcattaaggagaatcctagaactgtgcgtctctcttggaaccaaaagccttagaacaggaagcatattctgtgtgatccagcaaaattgcctttggttacactgttgaaaactgatgtctaaaaggtattccatacaaaccagagcaaacctagcccttggccatcagtcagtgtgcctgtcttttttttttttttaattgatggaatgagaatattcaagatagtggcttaattatttttgtataaggaccagcatgtttgatactctgagttcaggaatgagaccagtctaatgtaaattaaatttacttctgcctaaattggttgttgatcaacttaagatcctattaaaattaaaaatttacatgattttgagggaaaatgcaccagtaatgtctgcagctttggttcaatgatttttaatattttcctgtggtttattgagtttgttcttaatctttgtgcttaagtagttatgattaaacagtttgattcagtatagcattgtaattctctttaatcattttacatattttgttttctattttttatttattaacataatacaaatgttcatatagttttgcattgttagtattcatttttagatttttatctgtttagttttacatttagattacacacttcattttaaaaccatttgccagtcaaaatgtattgtgtgttttgcaatcttttagaattgtaaataacatgcctatagatagttaataaaaattttattttttattttgaattacatccttagcataaattctttgatttatattaccaaatcaaatttaatctggaggacttttgcattaccttgctagatttctttagaaatatttttctaatttacagaaccatcaacaataatgaaactatatgttaaaatgcaaactatcccctatggcagaagtttatttatattttctgaactaatttaataagcacattatgtcttagttattttaagtttgtgtaattattagcaaaatcaatgagatgcttttcttctttggtgatatgtctcttgaaagcctagttttggttattcttatagatttgaatatgtaaacagattaaagtaaagatcactaaaactttgttaggaagtgatataaatagaatgtatttatcctaattctagctctcctggtgtgaccttgggtaaatcatttagcttctgagtatcagtgtcctcatttactaaagggagatattaatttctcccatgtcttcacagataaggaataagcagttgtgatattttgtatacatgaaattatttactaatataagtgcttaatctgattaacagaatttttatcattgctttttttttcccctttagtataatgtgatacactatagaaaccctctaaatctggggcaatttcttggctgtagttgctatggaaatactgaaataaataaatgtcatggaaggaatataaggacacatattaaaagcggaggttcatgctttgcttaagaagatttttatgttggtatgaatatgaagggcagcaacagtgcctcctgcttatgtacccttctgcacataaagagacagccttactcataagtatagttttagaaaaagaattgctgttttattcctagcattaccaaggagtctgggcctagggacagagtgcatcagaaattctcagcaaaagtctatttatgaagtggcagccaaggatcctcccccaaaccagtgcttttattcccagtggatggactccaggtcctaactctctgacagcagaaggtggtacagacatttttactagagttgaaatccaaatgactaaagggcctctggaaataggaggccaactccacaggaggctaaacactttaaggtacctgaaacttggcgcattagtgaccaacccactagcagccttttgctcccttatgtcatcaaatggctacagttaaaacattctaacttgtcagcctacattaagaggtagttttgtacctctgcaggaaagctgttcttttatatactcaattcttcttaataaaatgttttaaaagcacttatggccagtgctttatgtggatgttggaaaaggaagcaagagtttggactaaacctgaaaaatccacatgaactttcttcctttttttctaattgcctacgtctgctctctcacctccaaggagtgtttgtctgtgcctcttgtctctctttctgtctcacacaacacacacacacacacacacacacacacacacacacacacactttcttcttgctgttacatcatcatttcaccagaactctcctaggaaggagaaaaatggttcaagaaagagaaaaatttgtcaagcactctcttgggaagttaagcatgttacccactgggaatagttatctcttccattcatacagccccttacattttataatgctaccgagcatctgttgttgcatgctgtcatacctagtagagccttgtgaaatagatcatggggagattattagtctcattttacaaatgtggctcggatgttttcaaagtaaatgacaaaacaaagactatgaataacttttataatttacactttattgcttggcccatactaacatccgtgctaacattcagcaactaattttttttttcttttttgagatgtggtcttgctgttgttgcccaggctgaactcaaactcctgggataaaatgatcttcctgcctcagcctcgcaagtagctaggactacaggcttgcaccaccacgtgcaacgtgcaacttaatgttcaactcttttttttttttttttttttttttttggagacagggtctctctctgtcgcccaggctggagtgcagtggtatgatcttggctcactgcaatctccacctcccggattcaagcaattctcctgccttagcctcctgagtagctgggattacaggcgcccaccaccacgcccggctaatttttttattttttcatagagacggggtttaaccatgttggccaggctggtctcaaactcctgacctcaggttatccactgccttggcctcccaaagtgcttggattacaggcatgagccatcacacccagcccatgttaaattttctacgtgaagatcctaaaagcccccaactactcagatttaaaatcaggtataattatagccttttcccagaaaattttaattgataaccacctgactcatgctttccagtatcacagaacctgaaatgctaaacttctactgatgaaaaaccataagcccttgtattttcttgagcatttgaggccttaaaaagcaaaaaaaaaaggttaaaaatatttataacaactgacattgacattaacatttgctcagtgctttaacttttatgaagcacttttcttttatcatattaccctctaattaatgatcctagaaaatagttacagttatttttgccttcatttccagtggcaagaaactgaatcttagaaagtgtcagcttgcttagttccatagagtatgagtgtcagagctaatacttgaccctgggcctctgattcccaaggccggctatctctacatctaacagaaaacactggaaatcccatttgctgttgctaggttacctttttcccatgatggtaattcttttttaaaatcctaagtttttcattaatgtacgcccattagagaaaaattagcaaatagaagaagaaaggtatgtaattctctcatctcagtataatagttcacattttgtcatgcacttcttttctgttatgtttacctgtgggtatggaaggatgtatacaaatgtaaccacacatctgtatacatgtggttacatacacacacacacaatgagatcataccttaactattggttagtaccttgcttttgttacataacagtatatcaaactttgccttctatacagtccgttttaaatattcttgaaccactgaaaaagaatatatgtcacctacatatgctttctgaaggttgattcaaggatattttccaaaaggcaaataaagtaatcaaaataatatgcacaagagatgcatagcaaataaaatggtgaaaagcaatgaagtaataaaactactggtaaaaaaataaaggggcaaagatgtagtagtaaactcagaccaaaataagataatattaattacctactaactacaatattcatagaagaaaagtaccattcagtacaaaggtatcaagcagtctgaagaacattactttttgataaatgtcacagttccccatgaagaatagccctgagctttccttcattaaatatcattatattgaaatgtataatttaaaaatactgaagtaagagataagaagggtgaaaacatattctttataaaacctgaacacattgcttttagtctttgataaatcataaaaaggagttaaataatatgattgataacgttaatttaatccacatacactgatctatgcaaacaaagagtttctatcttctgtctaaatctgcatgggagatttagaaaaacatttatcatatcaaagtctaataggaaattgtagacagttcctactgtggctggcagaattacatgtagccatatagtagaacaagaaatgaataaatacataagcgcactcttgggttaaggaatcttagaaagtagtgatgatgctaacactgcatagcaatgagaacgggatggagccgacatagtatgccaagtaatactagtctcattaattgcaacaggaaacagtgcatatgtattaacttaaaaaactagaacagacaagaaaatcaaccttaaagaaatccattaaaataaaacattgttgataagttgaaaaatactgcaatgtttagatctggggatgattttttgaaaagagcagtgaaataaacatttggttaagataaccaagaaagaaacaaaaactacagaaaattaggaatgaaaaagacactcagcatagatacagatgacattttaaaattattgcacttaaaattttatatgagagactatgttctatgcaaatctaaagtacaggtgaaagaaacttgaataaactcgtaaagacagatggaatgtgaagctactacttgcaaaagagccagaaaatttcactaatcaaagttttcagatctccaaagaacaaatgatttctgtgctatttcaactttaagagcctagcaaaaaacgagatgcttaccaaatcattttataaagctagcgtgctcccaataataatacctaacctaggttacccccagaagacaattctgtgataatctaactttcataaatgcagaaatcctaagtgaaatattagcaaattgaataccacataataaaacattccagttattccatattcagtgctagaacaattaggaatcttttagcataatttgctatattgatatatcaaaattttagaaaaactagtaatctccatagatgcttttcattaaaagggcatttaataaaatttttcatgcattcatatttaaaaacaaaaacaatggcaatgcaaaataagctctaagtagtatttacatatttcgatttattatgcaacatttctaacatatataaagatatgaagcataatgacaaaggtccatgtacctgttatccaatttaagaaataaaacattaaaaattcagtagaaatcccttgggttctattccatgatcatgttcccccagagagagccactattctaaatttgttttttatcattttatgcatttctttaaacaatatgtagtgttgttagcacatagtgtttcttaattttaaataaatggcattctattatttgtattagtgggagacttttccactcaacatcttaagactgtatgtacatatagtcatttacaaatgattgattattcttctagagaacctgaaaaattttaaatattggaataatgaaagtttagtaagctgacaatataaaaatgacaattttaggtttagaatatataacagaaaagtgtcctcatacagaagcaataaaaaatataaaatatctaggtaaaactttaaaacgtataaatgatctaagtgaggaatgctaaaaaagttttgcatgaataattaactcatgagcaaaaagggtattttggggattgaatgtgctttggaaagcctctctcgctttaatagacattcgtattatcaccctttattatacaacaatgttttcagtgggggaatgaatagttactacactctcctttgctagtggtatttatttagccctttcaaccaaatatcccccagccctctgctcatcttagttactgctcaccacatccttgcacgttccaaggcagcccttacttggtaaggaaagagaggcacagacctgtaagtggattgcccagaacaacaaagaggcctagctgaacataaccctttcttcccagttcctgttgcaaaccgtattaactgctgttgtcatagaattagaatgctttttaaagtccagcaggaaccttagaaattcaataatgccattttatagctgagaaagctaaatcccaagaaagctgagtgttttgcctgaggttatacgatttattaacggcagaggtgggactagaaaccatgagtcttcatgaggccttcaaagaactactttctttgggaccgacatgaagggtttaaacatttgtggctacaggtccagagagacatccctagaaaatgctgagattagtaagattttggttggagagtgtagaaataggacagcgtttgctttcaccctaaccagaatgaagggtctcagatttccaggttaaatgcctctgaaactttattctagaaccttcccactgccctagtttgtttaagtcaagcatgaactcaccactcaatgtttgccagagtttggatgaatgtcagcatcaggctactgtaataatggtttaagattatttaatcccattagttatacacttcattaggctgagtgaattgttggcagtggttcagtaaacttcctcctttagagataaaaggacagaaagaaaataggaaaggagcctattcctcattttctttcatagttataattctttttttttttttttttttttttttcccgagacggggtcttgctctgtcacccaggctggagtgcagtggtgcaatctcggctcaccgcaagctccacctgccgggttcacgccattctcctgcctcagcctcccgagtagttgggactacaagcacccgccaccacgcccagctattttttttttttttttttttgtatttttagtagagatgggtttcaccgtgttagccaggatggtcttgatctcctgacctcatgatccgcctgccttggcctcccaaagtgctgggattacaggggtgagccactgcactggccataattcttaatggataaaggaatgataattacccagctgtagcgtggactccatattagtacggtctcctaaactactcttcattctcaggagaaataaatgtttgtaacctaatattctctattagaagaaaatggacagtggcagagaagagagtgtgtgtccgtgtgatcaggccataaagttaatcttaaaagtaaacctgaaaataaattcaaagattctagatatgagagtcttttacgtagtggggttggtatgaggcagtaaatgattttaaggaaagaatatagaatttaaagtgagacctggttcacactcagccagctgctattctgcattcttccctttacttttagcttcagtttcctcacacttagaatgaaaacaaacaataagagcaaaccagtttgttatatgttctcacatctgactttgtaaaacagtttgaaaacattagcgtgctcagctccaggattgtcccatgcaggcaatgactgttacatctttcccttctttgtagtttatttttgcccagatggatctgcattcatttgtactatctattataatattgttagaattcactattatactgtagaattcattaattctattatattgtagaattcactaattctataatattgtacaattcacattatatattataacattgtagaattcaccaataatattgtaaaagtcactaataattcataaaaggaatgaattcatttgtgatcttatcaaaaaaaatttaaaaagaaaaaagaggccgggcacagtagctcacgcctgtaatcccagcacgttgggaggccgaggtgcacagatcacttgaggtcaggagttcgagaccagactggctaacatagtgaaactccatctctactaaaaatacaaaaattagctgaatgtggtggcacaagcctgtaatcccagctactcgggaggctgaggcaggagaatcacttgaacccaggaggcagaggttgcagtgagctgggatttgtgccactgcactccagcctgggcgacagagtgagactccatctcaaaaaaaaaaaaaaagtaaagaaagaaagaaaggaagaaagggagaaagaaagaaagaaagaggcacttgaatgaaagtactgtttcttagctcacatggttatagggtgaaatgaggattcggagaggacaggactgaacaaaaatcagtgtgggggctttgagtcgtaaataactgtaccagggcttagccccagttagacacataacaaatctgcaagagagaattttgcctaacttgaatcaccaaaggacaactgtaagtcagcatttcaggctctggaatattacttgcatacccacttggtttgagaacttgtggagtctgagagatggcaagtcatgagactaggagctcggttttctcaaaatgtgtcagcggtcacctgctttgtaatcactgtgaactcctcattaaaaagtaaagttctggactcctccccagaatttctgcacaaggagacaggaactttgcatcttttgcaaggctcctgggacagcagggagttgggaggtaaatttttatgcacagtcaagtttgaaatccactagtctgtacttccagtcaagctcatgcaaaaattggtcccaaaatatgtttgcattcttatctcccatcagctctcctacacattctttttacaacacttgcccaaggtgaggactcttctcctggacattgatatggaggtttctctgtctattcccatgccattggttgcctaccttctgccttttccgatctccagccttaaaatgctttcctggaacttaaccaactagatgtaaccatttctgaacatgcaaggttttcatttccacatctctcataggattgatcctcaccacaactggtattatcaagtcactggcatccttgacacactccagtactgacaggaaccccttgaagactgtgcggggtgcggggaggtcacccttttttcttttcttttcttttcttttttttgagacagagtctcactctgtagcccaggctggagtgcagtggcgccatcttggctcactgcaacctctgcctcctgggttcgcgccattctcctgcctcggcctcccgagtagctgggactacaggtgcccgccaccaagcccagctaatttttgtatttttagtagagacggggtttcaccgtgttagccaggatgatctcgatctcctgactgcagggaggtcacctttaattcgtctttgtcttttctgtagtgcttatcataataggtgaacctattgctgctctgatagtgagggggatttggggggagcctgtgtcactctagcactatgtctccccacagtcattgactcacataccctttgcttgccccttcgtgcacctaggacctgagactatgtatgtataagaaggaaggaggagaacttggctctgagagactatgaacagagtcattgctgaaatgtaaatatcaaagattgaagggaaagatgtgagagtgaagccagctgtctagcttccagccgtagaatgatcataagagctactacactcaaggtcaaacacactgactcacccatgaaaattgccaaggagtttgagtggaagttctctgatattccaatgactttgaatgggacacggtaattccttcccacagccagggcttacttaaaataagtaaatgaataaataaagtctactccctggatcttttttttgctcttgtccctgcagagtaaggggatgccagccaaggctgacatcatcattatagcaagacaggtgctttttttgaatacttcacaaggacaagggcctggtattatgtaggtcttcaaagaatatatatatatataaatttttttaattcagtctcctacatttatagtatggggaaataagacaagagcgaggaatgccttgcttgggatattgcaattggatggctgcactgaggactatttaagcaaccttaaaatcacaaacacacatctgtgatgactttttaattatatctgtcattttggaaaagatattaaacatcttcctcagaagttatttttactttacacactctttaataatgttaaaagatatttgatgcaatttatattaataaagctcatgggacgtgttagtaaaaataaaattgaatcttctaaaatatattcctttaaaaatgaatgtctataattttatgctagtttaagcaaataatctgaataaatcctgtttgtttagcataacacatgtacacgtagtttctccacaaaatggaacgcgctaaatgtgttggggcctcaggaaagaactagtggaagggggcataggaggatttgggggcaaaaggaggaatccaaaaagaaggtcttcatggaggaagagacctgtcccaatgtgtcattcggtagatctcactttctcctagtacctcatagtcattcatttttcacccccaacagacaagtggagactgatattattcccttttacaatgtaacaaaatcaaagcttagaaaaccagggggtttggaaaataaggaatttgtgtaggattaaaatagaactttgagctcctggactctgaatcttagcttctaccttgcacttaaataaatttatgctaacagatgtcctgtcatcagataggacttttttttttctttttaatgtcggcaagtctcattgttacagctctctggtctgcccagtttggttacacctgttttgagattccttgcctatacccttccaactgaagacaagcacttcctactgtacttacagaactttcatctatgtcttggtttaatcttttgcctttgttttaaccgtttaccacttctgctttatattggtaggtaatcttacccccaaatacatagactatgagctccttaggagcaaactcatttttttttcctgttgttctttgtgtctttttttccctatccacctccaaatcttactccacatttctgaaaatagcacccaaagcaatacctctcactttggggagtatttagtacattttttaaaaaatgaatgtattatacagtctggatcaccataacaaaaatacaaggactgagtgccttaaataacagagatttattttcttatagattgagaatggaagtccgagatcagggtgttagcactgtaggattctgctgaggactgtcttcctgacttgtagatagccaccctctcactgtgtccttacatggtgtgtgtggggagggagcaagcccactaagtgtcttttcttataaggtcactagtaccatcatgagggctccatccttatgacctcatctaggcttaatcacttctcaaaggccccatatacacatactatcactttggggttaaggcttcaacatataaatttataaagggactcaatttagtccatagcaataaattaggccttttgactatagatctgtaagtgcataattggcactgattgatggattgcagatcagaatatcctatgcttctagttatatagaaactacatgcttagtgttttttttttttttttagacagagtctcactctgttgcccaggctgaagtgtagtggcacaatcttggctcactgcagcctccacctcccagattcaagcgattctcctgcctcagccttctcagtagctgggactgcaggcatgtgccaccacgcccagctaatttttgtatttttagtacagacggggtttcaccatgttggcccggatggtctggatctcctgacctcgtgatccacctgcttcagcctcccaaggtgctgggattacaggtgtgagccaccacacccggcccatgcttagttatttaacagaggtttattgagcactgtgttggctttaaacaattttgctagacattcagtagggcctgatgagtgtttaagacctcgtacagttcaggtgcattttcctttaaggatacatttaacctgctagatgtcatctcattttgaagacaagagaaaaagagaggaagacttgttttttcagagggttattatacattcctattagatcattaggaaattggcacaagtggcaggaagccaaactgacctgagtctggctgggcagtgtctgcaggttactccagcaaagctgctggaataacgatgtgttcttccataaagtgctttttgtcaaagtctcttctggaattaactcctcatgcacagatcgataaaccccaccaacttgccaatgtaattaagaagtgacaggttaagcataaccattaattaagttcaaagtaaaagaaaatgaagaagattgtttttgtgaaattgtgctgtcagatttttctcaagggtatttctgagttcctataaaggggaatttaggaaagggaggagaagattgtctccacttccttgggaaaagtgagtgtttaaacacatgtccattgaatatttttaactgaaaagtgaactatttgccagttttaagagacattgagtgagcaccttctgtgtgcaaaagactgtgctccgtgctatgcggaatacagcgcagtgtgagacttgttcacgctctcgtggagccctgaggtgaatgagaagtatcagacatgtgaacaaatataacacaaggcaaagtaatccaacttatctgtgagagattcgggcagttgtgagagctcagaggaaaggccatgccccatcctacagtggggagaggaggggactggcatcgagaaagacctcccagaggatgcagcatttgagcaaagccttgaaagtagagtaggaatggataagggggaaagaatgaatgagaacagttccaatatctcaacatttttttatgttgaattccattatagcttctaggatcaaaggaaaagaaatcagcctcttgttcagtaaagatttgttgagcattcattatatgtgcattattctgcagaaaatttggggctgggagaggtaaaaaaataccttcaggataacaggctttttcacaaaagtatcaaatagtcttagactcattgtcttcctctgatggcatcttaatggaattcaatacaaaggccaaaattcctttgttttgaagccacaagaaaacacagccaatggaaaagccgtgttagtgctgcctgtcctattctgataaggtgaatacttaaaagctatgaaagaagcactgagtactgctggacagtttgagttcatttggctggtagaattgagtggaagtcaattctcatgccatttaaactggaagaaactgaagattctccaacccaagctcctctttttgcagatagtcaactgaagccctgtaagactgtagttttatagataaaaaagagccatgtgaatttcctaaatcacataacagtcagtttattatttgacatttatggtacattcacatggaagagaatgattagacatttccaggagagaataacgactcccaattccctgagttaccattagatggtattaagcaacttcacttaattatgtacctgttttccagttatgttaattatacatcctttagcatttaccacctgtaccaatcatttagcataataataccttatacttaaatgcaagtacccagaatacttttatagttgttttcatttgatattcacaacaatcctacaaggcaagtgttatttctagattagatatgagagaactgaggcatagagaaggtaacccatatagccaagaaactaaaacagggttctgacatccattttctaactatgcatctaggtttttttttttttttacctctgcgtctaagttgcctgcctaaatcgccttcagtccattgaaatccatccaatcaatatttactgagcatcatctgtatttcaaatattgtagtgggcattgggggtatgaaattgcaaaagagagaatcatcagtatttgggaaactcactgtttgaatgagatagaaagccaaacagataaatgggaattattttaagtgccataatgggtctatgcactgtctttggagattggatggacagggtagcaaaagattgaggagctaattttgctgctgtttatctaagcatgtcagggtcctgtcttttcacgtagattatgagtgtcttggcatgtcttttgtctctctgcatcccccgaggctccttgcacagtcctcacactccactggcgttctgttaatatttgttgatgatgatactggtgattttttctctctgacatccagaacactggagagattttctgttggcccttgggtataacagatttttatttatacatttgaattagccttttagaaatcattcttaagtaaaatagatatctttttagtgagagagtttctaaatacgaacttattcaaaacagtaatgatattctattttagccagctaatactcaactacgatttgcaatttagagagttgtgcttgtatagattgtccctttctgaagtgagtgaattgtaactttaaataagggctgttaacacatcaaaatagtttttaatcagcctcaaaaattccccttatttccaagtatcttatttttactatttcattgatgtttcaagtggaatcaaatattccaactgttttccactggaagaagatgaatttcaggtacaattcagtagcaaagaacacccatgttttcaaaataatggagaaatttttttctcatatgaagttatgattaaatttgtgaattgcacaagcttggaattctgctgcaggatgcctacattctgtattgctttattttggtcatatattacaaatggaatatttcccagctcatttatatacagttcctggttgctgaaattttactggcaagctttgtgaactaattttacttctcaaagatactaggaataaagtgaaaatagggtcttttctctcataggtctaaaagatacttctttcctttaaccattacattctggaggtgtaattaatccaaccctgctgtagataggatctcattataaagattctaggtaaacagtctttctagcagaaatgatctttttggttcagtcttgcagcatttcctaaaattgctagtgtacgtagtaaatagggaggtaagtggggaaatttcctaaaaatgccagtgtacagagtgaattgttaggtaaatgagaaaatcaggcttgatttaccaaccaccccatgtgcacatacaaacaaacacacactcacaccaaagccaggaaccctgcaacaaagttctatttaccctgaggagatataaaactttgtgactgccactaaattatttttttgaaaaataatacagaaatttgtaagcagacacaacagctctagtttatccaccaaataacaatataaatgggacaagcaaagagaaactgtaatttgaagatttttgagtgtgatacttataaaagtgtgtgtgtttgtgtgtagaaatgtattgaatttgagagtaatttatggaaagtgctgtcagcatggtatttcaaatgcttcacaatttgaatttaaactagtcaatgggatcattaagattattatgcatgttttccaaagagtttgaattcaaatgacaacttaaaagaaaaaaaaaaagatgtccttgaaaaactaaggaatgttagtgcacttatagaaattcttgcagtttggagtaatttgccacctccccttctgaaaaagtacctgatgatagtgtgcttgagagataggggtattgcagacatattccttaggtgagtaaaactgaattgtaaagtggatgctatggaccatggattatttcatttagtacgattgacagtagaaaatcaggaagggacgtgcatcagtgcgaggctgacacacagatctgaggatggcagaagctcactgaatagcacacgcaaggacccttcaaactcatcacatgtgccgtttggttccctttcaatgggtcggtcttggaatatggaggtctgctttcattttgtgccaagtaaccacgtgagcagtttacaaaagatacaaacagaaggctgctcattcatttttcaaaaagacttttttttttttgcaatggagtttgcaaagtgattttgcaatggattttgcaaaaaaaatggatgccattttttttaaataagtgtaattccaatgatgggaaatttactagctctcaaggcagcttttccttgtgttgaaatctctaaaggttaaaaagttactttttggaaagaagtctatttccttacaacatgttttcattggtccatagagaagacagctaatacatcttccacttggcagccttttaagtatttgaagaaaattctcaagtccatctgaatcttctgttttggctaacttctagttccttcatccatttccaacctaaatttgagcctaacgaacagatttcttctttcttatttaaatatatatatatatgaggaaataaaggcacagagggcttaagggagttgcccaagaacatagagctggttggatgactggaatgtaaggctgtgtggctctaaaccttgtcatttagactagagcacctatacgtcagttagcttcctgccacttcttgttttctgcctggataggactttataaagagtttggaagaagggagagttccgacgaggtacagaaatcagaacttccccttcttccaaactatatacaaataatcagttaatcagattaaaggactcttagtaacattgaaatcaaacctttgtgtttccaggagctctgagaacaacaatttttttggagcattgcaatctcttgagtatccaaaatgattctgtaatgatgtctgtgaggtcagaattggagcagcaaatggaattcctttaagggcttcccatcaatggacagctgattccagaaatggaggaggcacagtttgtatccaaattcataagcacaagtgggagaaattaggctttggtaaagagggtgacattcccaaaggaatcatctgtgaagttggggaaggaattcaagctcagggctgctgttctctaccaggttcttcagccagctggacatgctccccaggtttctactcagtctggaatgttagtaaaagtccacttcctctccttgtttctcccttctagtgaaaacgttcctcttctctaccttcctgacctcaagaccattgttccacacatcccccctcaggatcccaccccgccattctcattctcattacattgtttctggatccatgtctttatcagatgcagcccactgtccctttcagaagatgccagaaaatttacatatgtgatcaaatgttcccatcacaacagttctttccagtaatcccagtgctgggcagctgattccagtaatggaggagacactttcagctattaggcaatggatcacactttcaaaggagattgagcaatctcctcatcaagttgtacttagagcacaaatctggtgccaaaaggcactaccggattcagactgacagcactgagagttttgagtgaaagggaagttagactggtgttatgtgtattcactgggaggaactcaccgggagaaataaagagggtttccagtttattcattgtgtaaagcggctataatagtatttataggggttttgtgaatgtcaaataaaattatatttggaacagtggctagtgccataagtaggacttaacctttagcaatatgtactacattaaaaggaaggtggacacatgagtgatctctagcattttgtgactggaaggaaagagactggatgaccactcttcagagatgctatggacagtacttttgtcaaggactgggagtggagaaaatgacttatagtggtctttccaacatgaagtttgtattaatccgttttcacactgtgaggaagaaatacctgatactgggcaattataaagaaaagaggtttaattggctcacagttccacacggctggggaggcgtcaggaaacttacaatcatggtggaaggcacctcttcacagggtggcaggagagagaatgagagacaagcaaaaaaggaaaagccctttataaaactatcaccccctgcctcggtgcggtcgctcacacctgtaatcccagcactttgggaggccgaggtgggtggatcacgaggtcaggagatcgagatcatcctggctaacacggtgaaaccccatctctactaaaaaaaaaaaaatacaaaaaaattagccggacatggtggcgggtgcctgtagtcccagctactcaggaggctgaggcaggagaatcacttgaacccgggaggcggacgttgcagtgagctgagatcatgccactgcactccagcctgggcgacagagcaagactccgtctcaaaaaaaaaaaaaaaaaatctatcaccccccttgattcacttacctcccactgtgtcccttctacttcacgtggggattatgggaactacaattcaagatgagatttgggtggggacacagccaaaccatatcacacatgaaacacagaaaaaggacatctttttacatggatcttctgatatgcttgtaccaaagcccacagtatatcctgtcttcttgaaagagtatcatagttattcatttgccttggatggaaataatgttgtaataccagttaatacttttttcaactaaagggaatttggcttcatctccagttgcaaattcacatcaggaaatatcaaatccaaagatcaaaactcagtatctcatcactttcaggaccatccttgccacttgtctcaggcatcatgtacctggaagctgaaaagcaatgtacagaacctttgaattggagagatatcaatttgaacccagatcctgctacttcctacattgtgaaagggatcaagtttctttagttctctaaagcaaaggtttttcatctataaaaggaggttaataaaagggaatacttatcatgttgaattaatgggaatattaaatgagtttatgtggtttaattgcctagcacagtatctgcctcctaagatatgtttaataaatgctaactgtgactatagagatttaccctgaagatacctgtcatgtcatgccttctctgtcaaatagatcatgaatgcagttcctagcctctctctcctgttataccctcctagcaatattctgatgcagatgaacccagccacttgtcttttgcttgccagaacagctgaatgttgctgggaaaaaaaaaaacaaaacacagccgggcataatcatatcattataagttgtgaccagccttgacctgcgccttgaccccacccacagcctacattcttacaccctgctctcaactgtttcagacattctctactgtgacttctatctcccttccccactccttccttctcaagggatgccctggcctcattcttcatagtgaaaatgaaagctgccagaagaaactctttcagcttctgctctcaaatctgtgcccatcctttctgtcccttagtgcctatcagattatcagttgccaattggtctccatgtatctctggtccctttttcccctgtcttctgagtgccctggctccatggatcatccattctttatcctacccaatgggattcttctcgtcaacatccatttgtgccccagcttggcccatattttccctccattgactccacagctctctgtagctattgctttatcccttccttcacagccaaactctggaaagttggatattagaaatgctgtctccacactattcacaatagcaaagacatggaatcaacttaaatgcccatcagcgacagactggataaagaaaatgtggtacatataccccacagaatactaagcagccataaaaaagaatgagatcatgtattttgcaggaacatggatggagctagaggccattatccttagcaaagtaatgcaggaatagaaaaactaatgctgcttgttctcatttataagtgagagctgaatgatgagaacacgtggacacaaataaggaaacaacaagcactgggatctacttgagggtggagggggagaggagggagaggaatgaagatagctgttgggtactgggcttcatacctgagtggtgaaataatctgtacaacaaacccccatgacatgagtttgcctatgtgactaaaccttcacatatacccctgaacctaaaataaaagttttttttaaaaaaagaaaaaaaaatcctgcctccatttttctatcaagtattctgcctgctaccaggcccctatcccttcatagactagctgaggacatcagggacttccatgttgccaaaaccgtgagtctaatcagtgtttacctaacttgatatctcagtaaaggatcattcattcttacaaaactgtccctcccaacttccttggcaccccagcctcccgattttgtttttaatttttcaataggttattgggggcacaggtggtgtttggttacatgagtaagttcttagtggtgatttgtgagattttcgtgcacccatcacccaagcagtatatactgcaccatatttgtaatcttttatccctcgtcccccttccacgcttccccccaaatccccaaagtccgtcgtatcattcttatgcttttgcgtcctcgtggcttagctcccacatatcagtgagaaaatatgatatttggttttccattcctgagttacttcacttagaataataatttccaatttcatccaggtcactgtgaatgccattatttcattcatttttatggctgaatagtattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatattccatcatatatatattccatcatatatatatattccatcatatatatatattccatcatatatatatattccatcatatatatattccatcatatatatatattccatcatatatatatattccatcatatatatatattccatcatatatatatattccatcatatatatatattccatcatatatatatattccatcatatatatatattccatcatatatatatattccatcatatatatatattcatcatatatatatattccatcatatatatatatatatatattccatcatatatatatatacacacacacacacacacacacacacatacccacacatcccagtttctttatccacttgttgattgatgggcatttgggttggttccatgattttgcaattgcgaattgtgctgctataaacatgcttgtgcaagtatctttttcgtatgacttcttttcctctgggtagatacccagtagtgggattgctggattaaatggtggttctacttttagttcattaaggaatctccacattgtttccataggaccagcctgctgattttctctttacctatgtctcagttacctttgctgttttgtattctccctgactcctaagttgtccagtctctctgggatcattttctttctcaattttctctttagtcaccctcatatcctcccaagcttttagatatcatcagtatgctgacatgtctcaaataggtaccatgatggttttgttactattttttatcttagccattctgataggtgtgtagtaattatctcattatagtttgacttgcttttctcaaagtgctaatgatattaaacatcagtgcaggctgggcccggtggctcatgcttgtaatcctagcactttgggaggctgaggcgggtggatcacttgaggtcaggagttcgaaaccagtgtggccaacatgctgaaaccctgtctctactaaaaatacaaaaaaaattacccgggcatggtggcgggtgcctataatcccaactacttgggaggctgaggcaggagcattgtttgaacctgggaggcagaggttgcagtgagccaagagcatgccactgcactccagcctgggcaacagcgtgagactccgtctcaaaaaaaaaaaaaaaaaaaaaaaaaaaccaaccatcagtgcagaagaggatgtggagtggagagactgcatcaattatattttgctgatgagaatataagatggaacaaccattctagagaaagttttgggaatttcttcttttaaaactaatcctgcaactaccatgtgacccagcagttgcactcctgggcatttatcccagggaaatgaagacttgtatatcccagggaaatgaacaaatcaaatatttgttcatagcagctatatttgtaagattcccaacctggaaaaaacccagatgtctttcaacaggtgaatggttaaacggtggcacattcttaccctggaatacgatttagcaataaaaggaaggagttgttgatatatgcaacaccttgggtgaatctcaaaagaattatactgagtgggaagggccaacccccaaaggctgcatactgtatgattctatatataacattcttgaaataacactatataaatggagaacagattagtgtttgtcaggagttagggatgggagacaagaagtcagggattaggaattgggggtttggggtagctgtggttataaaaggacaatagaagggatcattgtggtgatggaactgctctgtatctttgccatggtggcagatacattaatctatacaggcagtgcaattacataaatcaaatacacacacacctgcatgaacttacacatatatacagacaagtggagaaatctgaataagattgatagactgtatcaatctcatattctggctgtaatattgtaccatagttttacaaggtattattgctgggggaaactggataaagggtacttagatctctacgttatttctttcaacttcatatgaatctacaattataagaaaatttaaagtttaatttatagaaaaggcaattttagatttgaaataaaattcctacattaactgaaaaattaattaaatataaatttaaaatcaaaattaaaaaccctttgacaactttagatctctctctcttacacacacacgcacacacacacatacatctaagctttattgtctttgctctactaacagttcagctccctgtaattcagtttctatccccacctctccacttacaccacacttctgaacatcaccagtgacctctttgatgtttaatacacttaagactcttcagtccttatcattcttgagctcttgcagcatttaaagatgttgactctatctttgtttcatttgacttctatagcaccgtacactctgggttttcttcctatcgctgtacacaactttctaccgtttttaatagatttcctctcttcattccttaaattctccatttttcttgagttctgccctaatctcccttcttgtctcaatctgtactcctgagttatttcatctgcttccgtgagtacaaatatcatctgtgtgctgagaactctctggccaaaatctgcagctggatctctctgtaagctccagatatgtatctatcattttagcctgcagtcttcatagattggcccataggcccacaaatgcaacagtttcagacagaacccaaggtgttcccttttaaacctgctcctctctgtgttccttttccatgaatggcattaccttgttgctccaaccaaaggcacaggagctggcctgtatccttcctcttccttcagtatcccctcttatccacttattaaccaatttctgacataatactttggcttcctttatatcttctttcatttatgagacaagttccttcagtgttttctagtgacttttcattacttggaagagacagttcatactcctcacactaccatgtaaagagctcatagccacatgcacacacatgcacatccacttgtgcacacatacctaaacacacacccaaaacagagagattgtctcatgcctgtggctgggtaaacacttgtccttgatggaatgtgtagctttcccatctccatcccaatcacctagccaaaaactctcctccttcaggcctccatttagacatcacttttccctcaagtatgtgtgattcttgtgccttatcctccccatcatcctgtaatagcatcctctgcttttcctcatcatagcatttagaagactgtatttaaattacctatttgacacatacctcagtagctatacattttccctaaggggagggttgatgtcttgtttctcattgcatcctgcagtaagcaccgagtaagtgtttcttgactctggggctgtactgagttgaagaaggatgacatcactgactacagaaccctttgtataagcatcaaaggggtagcagtggggtaaatgatcacatcctggctaaatggttccgattcctacaaccctgcagcacgcccccccggctctaaaccttttagtcatttcctgtgaatcttgccagcactcatttcattttttgttttttccattttcttcatctttcccacatagtatagaccagaatgaatcaaggtctaacttatgctgactgtccgtgttgcatcatcagtctttggggccccttctcagtttctgtggctgctcttgtgcctgctgactccatccctgtagaccttgctgttcctcccagtctgtggccactaacctcagttatttttactgaatgtgttacctcatccatagtgagtcttttgttgttgttgggttttttttttagcaacaatgtattttttaattaaggtatgtacattgttattttagacataatgctattgcacacttaatagactaccatatagtgtaaacataacctttactgcactgggaaaccaaaaaaataagtgtgacacactttattcaatagtcactttattgcaatgttctggaaccctttttgttgttgttgttgttgaacggttattataacatgtctgatttagaggaaagtacactgaactgaaaatcaggaaagctgggcccagggggctggccttgagcagctgactaagcctgtacatttaattcaaaaagagctactcaggttattcccttaatcggtcttatactttatgacagtaagcacttacctcgttctgtcacatggtgtggccagattatgcatgtactatgattcaaaacattcacgtaaataaatcttcctaacatacaagaattatgtgtctgtggtgctttccagcttttgatgtgcttgcaaacccattttctcatttaatcctcacaaagttggaaaccagctcacttacttattcatgtttacaggaataatcaacattgatgccaataattttgattatatattttaaaaatctcatgaaattggttttaaaagaatcatttattagacaaaaagagtgaacctatcaacaggcaattcacagaagagaaaataaaaataacaaatgaaccaatgaaatgatgttcaaattatttaaagaaatacagtttaaaatattattttttcattctcagaccagccggcatttataagttcaatgcttggtattggcaaaagtatgggaagcatgtactcacatgggcttgtgataggagtacaaattaatacaaccttttcgaaacaaaatttagcactatctttcaaaattttaggtgtgcactatttttgaccctgcaactcgatttcagacagtaggcgtatttgcataaaggcacagtggtattctgtttcagaatacacattgcaacatttttatgatagaataaaaggactagtaaaataaagtacagcaactgcatgcaataataacatggaggctatcagaaaaataagacaaatctatatatgctaattaaagacaccttaaaaactattttaggaaaaaacaaggtacaaaataggacataaaggatctgatttgtgtttgaagaaaaatttcaaacatgagtgtttatatgtgaatgtgtgtgtggtgtgtgcgtgtgtgtgtgtgtacatgcttatacaggcatgtataagcaatctgatacatgcctgtataagtattacccaatcttttagtgattatctctggaaaagagttttacttttcattctctacccttctatgacagttgaatttttgaatttttaaatgaataaatgtgtgtgtgttgtgtatttttaaagttaacatacagactgagcgcagtggctcacgcctgtaatcctagaactttgggaggcgaatcacctgaggtcaggagttcaagactagcctggccaacatggtgaaacccttgtctctactaaaaatacaaaaattagtcgggtgtggtggcgggcacctgtaatcccagctactcgggaggctgaggcaggagagtcgcttgaaccaggaggtggaggttgcagtgagccaagatcatgccactgcactccagcctgggcgacagagtgagactctgtctccaaaaaaaaaaaatgttagcatatagcgtagaattcagcttttcttattctaggtagcgatggtgcttttcactgctttgcccaacttaattgacccaagtagaaaagtcttcaaaaaaaaaaaaacgctttagaaaaacactttagacactttagatttatgtgacttcaaaagtcaaaaatggtaataatcctgcttaggcagaagccttgccctcagtcccaaaacatgatggacaagcgggtgacttacctgtggcttttcttgtatcttgcagtctgtcagcaatcatgaaatgtaggcctcagagtggaagggcccctagagaccatccattgcctctcaggagcatggtcattctgcagatcaaggtcctgctctgggagaaatgggtgcacactcactctgcgttctgtccagcccttctgccacctacatttctatgcttttctcttactgctaaatagcttcctaaaggaaaagtgaatggtctttgtgaattcaaacctcattctgttgcttccctatttaaaactcttcaatgagtccctcttcccaatgctctgtctctagttgttctgtatataaaagctaaacttcttcacatgtttctgtttctcttgtttatgcgatcgtttgtcattggccttgtgttggtgatgtatgttctgaatgaataggctccagcaattaagtgactgagatgaaatgcttttgtatctctctagcctcatttcttttttttttttaccactgtgatgcaaacacatggaactactgttctccattgcaccatgattagtctatccgtagtcttttgtgtgtgatctttctgtacctagaacactcgtcttgggcttttgcctggccagtacattgccattcttcaggtctcagctgatttttcacttcttccatggagccccctctgacttcacaagattgcgttgtcctgctcatatgtcctgctcagagcatgctgcatgtctcacttcatagcacctgttatttttttagtatggattttggttttgtttgcctgcaccccattccttgaggacagggaaagtttctgtccccctgttgtgttgaggacactattaagttccctgccattacctggtgcttaacacatagtagatgctctattagtgttggaatggatgagctctagtgagtaagcgcctaagacaacacagaccctaaggtcttctgaacccaaccaagtgccctgtttttgctgctataccaggctgtccttcttcccactgccatcctcctggttctgttctctcagcccaagcaccgtgtgtagcctaatcatgtatatctattctcagagtttgtaggacaggatacgagttaacgacttaacgcccttcaagattttgtgtaacagggaaaggagagaacacctggaatggttcccgcttggagaaacgtttttcatccttcttagtttcagctccaatcagatggattcagcctgtgacagtcaacatttacagcccttgggagcagctccatactcacctcctttgcctgcttaccgcaagctcactgcctcctcctcagattgtgccagacataccaggtttgctgccggtgagaagcaacaatccaaatcctacctttctgttcaggtcccagtaaaatcttcactggcagcattttagaattgccccttccctcttctctcaaagggctgctgttcagctggcaggaccagcttctctgatgcagtgcagttcagtgcaaaccaacggaaagcccacagtttttttgtttttttggttttttttctaggtgtaaacaaacctggttgattgtgaggcaaagaaaaataacaaaaacaagtgagaatacattagattaatttactctttcttttttcccgctcattcataatgtgattgaaatcagaagtaaagaaagtaaaatcagagtgagttccctctgctcagtcacccaccctgatcacaagacttttggaatactgggaggcactgcatttaagtaagtatcagctgtatggagagtatgaggttaagatgatgctggatttaatttaaagtctcctcactggtttgcgtgaaggaagatttttatcaagcagagtgaaagagacagaatcttgaagcttccgcagaggggaagaagacagggccgtgcactgcgagtcagtatgcctccagtccctctggtgggcaccggtccacatcacaggaagcccagctgtggtggctgtcagtgtcagaggggctggcagacagtagtagaggcccagagaagttactttgtacgtatcagtctagaaggaagagattatgaagattagtcaagcctccctttctcatttatcctttttttttttttttgagatgaagtcttgctttgtctcccagcctggagtgcagtggcacgatctctgttcccgcaacctatgcctcctgagctcaagcgattctcctgcctcagcctcattagtagctgggattataagcacccaccaccacgcccagctaatttttgtatttttagcagagatggcgttttgtcatgttggagagactggtcttgaactcctgacctcaggtgatcctcccacctcagcctcccaaactgctgggattacaagcatgagccaccatgcccggccactttctcattatactgatagcaaaattgagacccacatcagcgatctaacctgtcatttcaatgatgtcctgacataagagtaagcggccagcctgccctttaagtaaagcctactcatatgggagtatatgtgctttattaattagcagaagggtatccaggccttcttggaagctgtcttctctctgtatgggtaaatgggcaacttttctagccttccgtctaattgggtttaatatcagtgaaagaatctttaagaaggtgtgcccttaggtgctagggccagtattgtaggtggcaaccaggtacattagtctctgcccttgtggaactcatattcccatgtttgtaaaggagtctgggcctcttatatgtggtaaatgaagtgactgtctatgtagttgcctttgcaggacacaagtccttgccttagtttccctccagccaggactgccccaccgagactattcatagctccaacttaaggtgctttaataaagggcagaaatcatgacaagaaaggacgcttttcttcaggcaatgaattcagcctgattttagaagctgttttggagaggtctctgtaagcatattacattttattccctgcagtacaatatttatacatggataatttgtattgacagttgatagttacatagaggtatatctcactggttctcaactctagctgcattttagaatcaccaggagaattttctttttcgattctgatgcctaaatctctgccctagaacaataaaatcagaatctctaaaagtgaggcccagacatgggcagttttgttattatttatcattgtttaataataaatattacgtaaaagtcagacttttaatggctcatttgtagggaggagaacttgccatttcccaaagtatcaccagcataaaaggtgaatttgtattttgttctctaagtttctggcatattctgaaactgcaatttaagtgactctcctacctctgtcttactcccaatttatatttagctggattcatattagagggcaagaaggggcaaatagaaaaaaagtgatctttatcaaacccatttccttgtgttagaaaaacgatttgttggaaaaagccatcgaggagatttgagattcagcacaaaaaagaattcgatatcacctaatacaagctgagaagggctacctcagggggtccttgtgcacctcactaaggaaggtctttggcagaggcagagaccatgacaaaggttttttttttctttattggacaagagccagaaaaaaatggccccaagattatgctcagccccgggaacctacagaaaccatggagcagtaggaatgggtagctagccgtgttagaagtaaatttgaggccgggtgcggaggctcatgcctgtaatcccagcactttgggatgccaaggcaggaggatcacgaggtcaggagatcaagaccaacctggccaacacggtgaaaccccgtctctactaaaatacaaaaattagctggacgttgtggtgtgtgcctgtagtcccagctactcaggaggctgaggcaggagaattgcttgaacccgggaggtggaggttgcagtgagctgagatcatgccactgtactgcagcctggcgacagagcaaaactccgtctcaaaaacaaaacaaaaacaaaaacaaaagaagtaaatttgattaatgaaatctacctttatgtttttacccaaagtgttatcaggaaagataacgttaaaaaatacacgtgattttcttaatgtcttagtttgagcaagtaattctaactgctctagcaaacacatttttaaatctcagggatttaacacaatgcaagtttatttttgtctgacaaaaatcccccatgtttagccagtgcattccacgtgggattcagagactctgtcttattccatccagtggttccaccagtctctaaagcctagaggtcctatgccagattatgtgaattaaaattagaagagagtattaaggatcttctgggacagtggtgggatggttacagtttccagactcataaatgtaaaacagtgttccttctacaaatattctattggctggggctcattcactttcacacagtaacaaagaatgcttggaaatgtggccacactgtatacccccaaaagaagaggaattagtttggttcaaatttatctagtctctgtcatgctttcatcatcatcatcatcatcgtcatcatcatcgtcatcagctactgtggatcagcatactttcctgcaattttccaaatcgaattttgtggttatatattaacagagtatataaaattcattttccctacataatatgtattttattcctatatgtgttttctgcagtggtctgatttatatcaatgactaacatatagattcgatttgcaccaactagataatttaatctcttactcctccttgttgacagttggtggggtgcgccttatttttgaagaagaaaatgcttatccagttattcagccaatctcagttgacagcctatcacatgtcaggcactggaaattccgtggtgagcaaaaacagacaagtggcctgctttcaggaagtttctattctgttaagggagatggacagagtgttttaaaagaaaggagtattgtcctaagataattaaaacacaggaacctgacttagacagagattaagacaggcattcctaaggaagtgatacttcactgagttatgaggagtgagtaggagtttagacatctccagacagtgcagcacgctgatttgaggaactgaaagaaggccagtgtggtcagagctcagagactgagggagaagcatgatgcaggatgagttttgagagataaaccatgaaggacttaggccttgctaagcattttggcctttttcccaaaagtacaggaaagcctagccattttattattttataccacccatccattacaggcttttcctgaaaggtctttggcaataggggagctatggaagcaacatcatgagtaagtgactgggggaaccttttccctaagtgttgtggttgctagccacacaccatgtattcaacatctctccaactctcctcatcgtttcccagagctgaaagtaagatgagcacgaagaaaccatgtttagttaagaacatgacccgaagagtgaaaggtatttcctgttccaaataggagcccagtctgcattttctactacatgatttagtagaaagacacattgcatttgaaccatatttcttctgctagccaattccatcttatctacaactttttgataattattttgagaaatagatctagatcacagccttccaattcctaggccaggatactttccatttttctacacagaccccattgcagtcctcccttcttcacaatcttcaaaatatccttctgattgaaccagatatcttattcttcatcccgtttcctgccccctaaaatgacctatctttcccttctaaaacttccactaactttaaaattggagctcaaggcttccatctccacagactctgccctgacaacaaattggttggttttattttcttcccaatgaatagaatagccgttagagggaattgtcttcagctcttttcccccctcctcctcctcctcctcctcctcttcctcttcctccttcttgcaaatacaaacacagcagggctctatgcagctggttactctaggctctggtaacctaacatagcaggggaggacagaagtcaatagggtgagaagtctgtttttgtcacggatttgctagaagctattaaagtgttcttcctaagtctgttacttcataggttgagggaagtaatgcatcccacacaagaggactgggatatgtttaaagtagtaggaaggcatttgccactattctagtccatcctgcccatgctgcctaatgtttgttcctacagatcaaaatctcataatcttctagacttctagatacagaagagttggagagatcaaagccttgcctctgacccagattattcgatctcatctggcatatcctacactctagccatcctgacctgccgtgtgttcccctaaagctcccatccttttctgactttgcttttcctcattctgtcccctgcattgaaatgcctttcccacatctctatgtctaaatcttacatggccaattccaacgtaatctaatctctgaagattccctttgctccccagttagaagtagtcactccctgctctgctcactttttgacatatattaatttatatagctatgcatttatatgtgtatgtattatattccttacaagagaagcttttgagagaagggcctataacttttctttctatttgtgtttcccaaagctccttctggtgggaaaaatgctttgaggttgaattaagctcacattgaactctatgatgaaaccatttgcttatgaacttggacaagtttctttacaactctgaaccttctgaattttccaccaggagaatgggaatgaataagtaagaaaacttataagacagctcctggtgtagggcctgactcatgtcaggttcccaggaaggccactttatatccttcatacatttgtatgtctgtgttgacattgaatgtttgcatgacatataaaatataagtagtaatgacaaatttaatagtgaatacttacagtagtgcatttcatcctatgaaacgggcaatctggcccattctatataataggggagaaaatagaaacttagatttactaattagttcaagttggcacagatataaggggatctcagacttcaactcaggcagtcaggcagggcctatactcttgatattcctttcttgatactttctcagtatcaaattaccacataatagacaatgccactcataaatctagcccactctaggaacataataaggcctgttgagacattcagagatgtctccctgatcttcaaagatgaatttttattcttccctaagctgctgtctcttcagtctcaacatcctaagttcattttatctttcctcacaggtcaggttttcagctctaactgtgttcatcctggtggctctgccctggacatactgcagttcttttatgtacctcttatcgtatggggtacaatggctttcggtactgctcagtgaggggagagaaatagatagtgtagtttctgatgtcaaggaacactttagagagaccttaattaatgtagccatatgttgacttcctggagcactcataacaacatgggaagcccacgctgggaagatgctgagtaggaataagagaacaatgctaagagaagggaaatttcaccgtctgtgaagcgtctgtttagattttatgtttaaactttatgaactctgtcacttgctggtgaattttcttgctcagtatcttaaaatacagctgcagtgtgggttccaccctcttcacttaaaagggtgattaactgtttgtgatgaataattatttaattgccagttcagctacatgtgtgtagttgttttgcttctttcctcttcagtgtgagccaaatcttctcaataataaaaataatccagaattagtcaactgccttttatcatgttctcattcagcctgctggagcaagaacattccaattctacatcacctttagcttaaaaagtaaataaatagaagctctcactcagccagttgatagttttactctcacagcctctcctgtaactaataaagtcttgacttcatcttgaaccttttactctatctttggataaaaatttaatcagaaagaattattgctcttttaatacctgtttaacctttacattcgcgatgggtacaaaaccacttaagatttaaagctctcttgttatggacttgtatgctgacctacttttcctcagagatattttttgcaagaattgttgaagcttgacatggggatcactgcaaatgtctcagctttgccattcactgctttccattcctatgtcctccttgccctgttaattattttaacagagacttgctattttaaggaagctctttatcgttactaaatctttttttattgttaaactcctttttctttccagcatagaagtatgtcatgttttctgtcttcagaatgtgcaagtgcttaccttctcataaagtgtgcctgttaccttaattttatagtctttatcacaaaaaggtacgtaagtggggttcagaatagtgtcttgcacttaaggtttaacttaggttttagtttcttcatgcaagcaacttgcatatgtagagaggcagcatgctatatagtgcaatgttcttcttggtttttaattataaaagtgatttcttttctagtaaaaaatcaagttatgcacaaatatatagagtgaaagtgttttcaactcctctctctagaggaagccactagcagttggcatatttccttccagaatttgttgtgtattataaacctatatacgtgcgtatgtatacacacacagtagtacacacattgttctgcaccttgcttctttgttttccctaagaatgtatgcttgatatatttctaaaaataataatgtatatgggtctaagtatttttagtgatatagaattctataggatacatgaaccgtaactcccttagtcatttctctactgattagtatttaacattgtttcttttttttttttttttgccattaaaagcaaatatctttgtgcaattatcttcatgaaatgttgaagctttctttttttttttttttttgagatggagtctcgctctgtcgctcaggctggggtgcagtggcgcgatctcagctcactgcaagctccacctcccaggttcacgccattctcctgcctcagcctcccgagtagctgggactacaggtgtctgccaccacgcccggctaattttttgtatttttagtagaggtggggtttcatcgtgttagccaggatggtctccatctcctgacctcgtgatccgcccaccttggcctcccaaagtgctgggattacaggcgtgagccaccacacccggccaaaactttctgcaggatatatttttaaaatgggttttccaagtcaaaagtgtatgtatgtttccattttgatacctactgaaatagctctccaaaagtgaaaccaaatttattcttttcaatggtatgtaagaatgcctgattccccatactctcattaaccttgagcatgttccatcttttaaatttttgccaagaagattgtctaaaaatggaatctcattgtttgtatttgcatttttatgatttttggtggatttagcatcattttctatgcttagtaactgcttgcctattcatatcctttatccaggttttttgttttgttttgtttctttttggtttggttattcatgttttccttattagtgtattggtagttatatgagttttaaccctttgtcagtggctaatttggaactcctccacagatccctgggggtttcttagagcagctgactggctggcagagctctccatggccttacctccccttcctcttctccgaactcacacacacactgatcgaacagaatagaccaattattacctgcatttcatgttgggctttgtgcttgagattaaacaaaggttcccggggctaaacgtctaaaaaacattgccatggaatgaagagccctagattttgtcataaagtcatctgtcctaggctctacaatgtagcattttcaaattggaagagccttcagagattattttattaccaacacccatgtaatataaattatacagttaatatatgttgatatacatgcaatactgaagaaatctctaatgcattctatattctgtaacagtaatatgtattttattatttataatagcttcaacatatattgaaaactagaggcacatacgtctataaacagtgctcagggcgtattattttggtgtttatttatttattaggtatttattattttatttagtccatagatgatgcatttatctgagaactcctctgactcaaggcccagcaagaatctgctgcccacagttatgagtagctgaactgggccaagcttttaattctataaatagcgaatctatgtagacactcagctagttagtaccagagtggtacccagatccgtgatgtcttgactcttagtacagtgcacttttccccactttgccattctttgctggtgaccttgggtagatcttcttaactgctcagagcttcagttcttctctcttttaatgagagtaataatgcatgcattgatatcctgactaggatggagttggataaagactgttcttaccttttgtgaatagcatagtatcttacagaattgtgaggaattatccaagtagctattgcccctcatcatggtgttaaaagtaggattgctagtttgaacggtaactgcaggaattcaatgtgttttgattttagcatattcccgtatcatgtagaccagtgttaatatttttagtattttatcttagttcttttttttctgaaagtcttgatttttcccagttttattttttagatttgaaagaaaaagaaaaaggatgtaactatgactcttatgttttcaatctctctgaaatataacaaagtaataactctaaatggtcaacgtagtagtctgagggcattctcttgaatgcttagttctgtgttacttaggatccattcatagagcatattatttatattatgtgaggtttaactcttcattataactcatggaatcaatgatagaaatgcaggttatttatactgtcagtcccaagtatgtaatattaaaccaccaaaattcagtttaagaaacttgcaataagctaccacttggctcaaagcaaggaattaggatggtcaggttgaactttctttatatataaagaactgagtctctgaaaaaggaaaaagacttttaaatgacatccagtgaatgtctttttaaaaaataatagctttaatggctgggcacggtggctcacgcctgtaatcccaggacttcgtgaggccgaggtgggtggatcacctgaggtcaggtgttctagaccagcctggccaacatggtgaaaccccgtcactactaaaaatacaaaaattagctgggtgtggtggcaggtgcctgtaatctcatctactcaggggggctgaggcaggagaatcacttgaacccgggaggtggaagttgcagtgagctgagattgcaccaccgcactccagacctggggaacaagagcgagactttgtctcaaaagaaaaaaaaaagctttaaaatatatattgcatatggataaatttacatatcataaaagtatacttggctaagttctcaaaagtaaacacacttttataatccccaccctaaaaaagaaggaacattagcagttaattacttcagaagttttcttcatgacaacctggttgtatgcctttcttttttcctaaaagtgatcactatcctgacttataataatactatatattagattaaaatacttttgttgtatatgctttttttttttttttttgagacagggtctcactctattattcaggctagagtgtagtggcacaatctcagctcattccaacctccgcctccagggttcaagcaaatcttgtgcttcaaccacacaagtagctgggattacaggcttgcaccaccacagagagcaatttttaaaattttgactagagatggagttttgccctgttggccaggctggtcttgaactcctggcctcatgtgatccacctgccttggctaggattacaggcattagccactatgctcaacttgttgtatatgcttttatgcagttttcttttgttctgttatgttcatgaggttcttctaacattttaaatatggccatagtttatcttcttctagaagctttaataattttaggtgttacttttaggtgttttattgttttgagttaatttttatataaggtgatcaaattttgagtaaaggtatttttccccccatagggatgtccaattgttccagcaccatttgttgtaatttaattaatcttatgcagattgtaaatcagatgcatgttacagaccatataaaccatagatgggtctatttctggattctctattctgttccatcagtctgttaatatatgtctgtccattctccagttcacacactgtgtgggcaattatcattttgcagcaaatctagaaatcaggtagtacggtttgttctgctctttcaaaattgtttggctgttctagttagttcacctttgcatataaattttaaaattcgtttgtcagtttttacaaaaatccttctggggttttgattagaattgttgaatgtaggtgtaaatctagggagaaattacatcttaacaataattatgtcttccagttcatgaatatacatgtctgtatttatttagattgttaatttctttaattattgttttatatttttcagcgtaggaatattgtacatatttcctaaggtttataatgaagtattccatgttttggggtgcttttacaaatggtgatttaaaaatatgcaatttcaagtattcattgctactgtatagataagattgatctttgtatattgcccatgtgtgctgtaactttgctaaaattatttattctagtagctttttttttattcggggggaggtttaatgaaaaaaattatgttttcaatgtagtgcatctttatatatatatatatatatatatatatatatatatatataaaatggaatacaattcagccataaaaaagaatggaatcatgtcttttgcagcaacatggatagaactaggggtcgttatcctaaatgaaataaattagaaatagaaagccaaatactgcatgtggtcacttataaattggagctaaacaatggaaacatatggacatacagaatgaaataaaggtgggaggatgatgagggttgaaaaaatacctattggatacagtccagtactcactcttcggtttatgggtgcactaaaagcccaaatttcaccactacacaatatatgcatgtgagaaatctgcacttgtacccccaaatatataaacattttaaaagatttaaattacattttctgtgagtagaaacagtttcatttcattatttgaagtcatgccttttctgtttcttgcccaattgccctggctagggactttcagttagttgttgaatggaagtggtgaacatgaacatttttgcgctgttcccaatattaagagaaaacattgagtcttttgccattaagtgtaatgttagaagtaaggttattgaacatgctctttattaagctgagcaagtttccttcttttcattagttttctgggaggtttaatcatgaaagtgtgttgaattttgtcaattgcctttagacataagttggtatgataataagacttttgttctacagctggttcatatggtaggtaacactggttaatttttaaatgttgtatcagccttgcattcccaagataaaccccacttggttgtgttgtactactccttttgtgtgttattggatttaatttgccagtagtttgttgaggatttttgcatttgtgtcatgaggtatactaaactgtggttttcttttttggtaatatatttgactagatttgttatcagtgcagtgctggcctcataaaaggaattgatgagttccttcctctcttatattctggaagaatttgtatggaattggtattattatttaaatgtttggtacagtttgccagtgaagccatctggacctggaattttctttgttagaaggctttaatctacaaattttattcttgttaattgacagtttgcatctcttagaaaattggtccatttaatctcattttaatgtctgtaagtactgtggtattgtttccctctcattcatgatatttataattaatgtcttatttcttttttttcttcttggtaagtctgaatagagtttgttgtgatttttttttcacaaaagaattagcttttggtttcactgagattttctctattggttttctgctctcaattatattgacttctgctctttattattttactacttttgcttggcttgggttaagtttgctcttctctttctatttccctaaagttaaagattcagttgttgagttgagatcttttgtttttttctaatatgaacatccaatttcaaagtactgcttaagttgcattctacaaattttgatatattgtgttttcattttcattcaagatattttctaatgtatctagtaatttttttgacgcatggtttatttagaaatgtgttatttaatttttaaatatttggatattttttctaggcctttctgttattgtcttttagtttatttccttgtgatctgtgaacatgttttgtgtaacttaaattcatctaaatttgttgaggtttgttttatgtgctagaaatatggtatatcttggttaatgctctgcacatttcaaaaatatgtgtattctgctattattaggtgaagtgttctatagttgtcaattaggttaatttggctaacagtattgtacaagttctctctattcttactgattttctgtcttctttttcagtaaattattagagggatactgaaactttgagcataattgtaggtttgtctatttctcctttcacttgtatggtttttgttttaatgtattttgaagccatactgttaagtgcacatacattaggattgttatatcatcttaaccccatattcaattccttccttattacataatatgattctttaactctgaaaatattcttgttctgaattttagataatattaatttaactttcttttattagtttacaaagtatttttccagccttttgtttttagtctatcaatgtctatataattgaagtagcttgcttttagacagatacgtctttcattttatccaatttgaccatctgtattttaatttgtgtgtttacactatttacatttgatgtgattattgatatagttggattgaaattcacaatcagcttttgttacttttccatctgctatatttttctcttcctgcctttctttgaattaaatgtttttcacaattccatctcatttacactatttgtttattatttatactcttgattttaatgttagtattaccctttgatttgcaatatacacctttaattaactagagtttaccttcaaatactattatatcactgtctgagtagtttcaggaccttacaattgttactctcaatttacttaccatcttttcgtgttcttgttgtcattcattttacttatatatattctataaatacacagcacattgatactaattttgctttagaatgttatcttttagagcaattaaaaataatgagaaagctaattcatttctgctttttcagcactttatttttttgtataaatccacctttgtgtctgataccgtattccttctgcttgaagagctcccttcaatatttcttcaattctgtcctgaaacagtttttaattctccttcatttgaaaactatttttaccaagtagagaattggttggcctttttccttttatcacttttaagatgtcacttcattgttttctcacttgcatagtttctgacaagaagtctgctgtcaatgtctttcttgctttcaatgcagtatgaatttttgttttctgactgatctcaaacttttatcctttgtctcttttctaacagcttgaagctatgtttattagggtttttagttttagttttctggttttagttttagtgtttgtatatatcctgtttgtcagtcccttaatttcttggctcttctatcttcagttggttgtttattctttagaagatagccaatatctcttcaatttttattttgttttggtggtttgttgccttcattcttttatattttctctttggagttctaactacatacaggcttaatatttttctataattctttgatgctctgttctcttacttttcactctttctataaatttctattgacctatctttaagtttactaattctttccccagttgagtctgcttatgagcctattcaaagtattcttcttctctgttactatgattttcatttctagcattttcattttattttcataagacagaatgagaaatattctcatatgacagtctctatatctttgagatcatgcaaattttcttcctttttcactagagccttaaacattaatcatagttattttaaattccctatctgatcaatccaacatctgtcttatttctgagtctatttctgtttgttgctttgtctcttgacagtgtgttgttatttttacttcttggtatgccaggtaagtttttgttaaaagccagacatattatataggataataaagataggctaatatatttcacacctgtaaatgaacatgccttttcttttgttaggcctttagtgtggggtgtttgtgtcaatcttgtcagaagttggccttgatttgaattttttgttgttgttgttgctgtgattccccttagtgcaccacagatttcaaatatctctaatgttactttgtctttgtggtgaggagtggttttccaaaaggactttctcagtatttgctccaccctcagatttagatcttctttttgtgcctgtaccacagagacaacttctttttttgtctgtctcccaaattttgcactgttggtgggaatgtaaattagttttgtggttgaacttgattgctgttactttttacttgatgcttttgaggcagagggacattttctgctgttaccttcagttttagagaggcagtgtggctgtgagtctccgaagcaggctgtttcagtgatcctgcctctccccgggactaaaatcacttcttattcttttcccctacctatgatgagttatcactggtgccctaagagccacaagactcactgttattttcctggggctgaagacctttattccaaagggacaatccgggagaagtatatgggcagggcattaagcctttcccagagctgctgctgttccgctcctgaagcctgcaccacaacagatactttatcagtactcttttttgctttttattttattctattttactttaagttccaggatacatgtgcagaacatgcaggtttgttacacaggtatatgtgtgccctggcggtttgctgcacctatcaacccgttgtctagttttaagccccacatacattagctatttgtcctgatggtctccctccctttgcccccatcccccaacaggctcagatgtatgttgtgcttctccctgtgtccatgtgatctcattgttaaaactcccacttataagtgagaacatgcagtgtttggttttctgttcctgtgttagtttgctgaggatgatggcttccagcttcatccatgtcactgcaaaggacatgacctcattcctttttatggctgcatagtattccatggtgtacatgtaccacattttctttatccagtctattattgatggacatttgggttggttccatgtctttgctattgaaaaatagtgctgcagtaaacatacaggtacatgtgtctttatagtagaatgatttatattcctttggatatatatccagtaatgagattattggatcaaatggtatttctggttctagatccttgaggaatcaccacactgtcttccacaatggctgaactaatttacattcccaacaacagtgtaaaaatgttcctatttctccacagcctggccagcatatattgtttcttgactttttaataatcgccattctgactgtcatgagatggcatctcattgtgattttgatttgcatttatctaatgatcagtgtcattgagctttttttcatgtttgttgactacataaatgtcttcttttgagaagtgtctgttcatatcctttgcccactttttgataaagttgtttggttttttcttataaatttgttaagttcctctagattctggatgttagacgtttgtcagatggatagattgcaaaaattttctccctttctgtaggttgcctgttcactctgatgatagtttattttgctgtggagaagctctttagtttaattagatctcatttgtcaatgttagcttttgttgcagttgcttttggcattttcctcatgaaatctttgcccatgcctatgtcctgaatggtattgtgtaagttttcttctagggcttttatggttttgggttttatatttaagtatttaatccatcttgaattaatttttgtgtaagatgtgaggaaggggtccagtttcagttttctgcatatggctagccagttttcccagcaccatttattaaataaggaaccctttccccattgcttgtttttgtcaggtttgttgaagatcagatggttgtagatgtgtggtgtaaattctgaggtctctgctctgttccattggtctatcagtactcttattctgcctcaggtctttcgtgtgagcatctgctgagatctgaggaaaagagtataaattaaattccgcttctatctgcactgcccaaagattctgtgttttaatactaccctacaactagtctcttgcaactggttaataactgtagttttttttttctgttaccaatagtatggcattcagaggccttaaggcagtaaggcatctgccttagtgttctgcaagtgttcacatcctgtctctcctcagaggcatctatctttccttagatttcaggttacagtagtttccccaactcccacttatcagtagttttgccttctgcagtctcagttacccatggtcaaccacagtccaaaaataggtgactacattacaatagtcatgtagagactattgtctctctacaaagagagagaaagagagagagagagagagggagaccacatacatgtaacttttattacaggatattgctataattgttctacgttattattagttattgctattaatcttttttgtgtctaatttataaattatactttatcataagtatgtatgtataggaaaaaacagtatgtataggggttaggttgtatccacagtttcagtatctactggtggtcttggaaggtatcttccacggataaaaggacactacggtagttggttgttctgcagcctcagttctctatggattcaaaaccagttttagatttgcacactgtctggcttgttttaaattattgtatgggtgggagtggtgctcctttcattttctccatcttgtacagaagccataattattttcaattctatataatttttgattgaatgaaaaataccataatttttttgttctattagtagacatttgaattatttatggttaggttcatgacaacaaggaatgcttctatgagcacatgtcttttggtgtacatatataaaatatttctcaagggtatagatgtaggaatggaattcattaattgtaggagaatacatacgacacacacacatgtatgagttatagggtatatatatatgtgcatataatgatttcagtaaattattgatataaaaattttcaatgaagtataactcatagaaaagtgtacctatcttaagtggccataggatatcatttagactgtaacataagagaactatagatattcacatccccaagcattaactgagaacctgttatacagtgggcatttaggaaatgaaaagtgaaggaaaagttactgaccttaggggtcttgaaagcgagaaaatgattaagtgctgtatacacacacacacacacacacacacacacacacacgcacacacgctcaaagagtagggagagaaaaattatgattggggaaatcaataaaagcatattggagaagacatcatttgatattaacctttaagtatagcagtgtagatagtgcgtaagaattggattatagaacttagtcattatgttaggaaagaaacctatggccttgttttatagcaattactggggatatccaggtcttttgcactggaagaaataatcttagaaccatttattaaggacagacccttacagatcatggggtccaaaactgtcttggggtcgaaaactttctcatcttatagatgaggaaactgaggcttagggaagggaagggacttgcctggggtaaatttttgctagtaaatgtacttaatgagatctctcagttacactgaaacgtttgagtattggaacattgtgcttttgttgttttctttttctttaaatccttaaaaaagttgtggatacatagtagatgtatatatttatggggtacataagatgttttgatatagacatgcaatgcataataatcacatcacggagaatggggtatccatctcccttcaagcatttgtcctttgtgttgcagatcattagaatattgtcttcatcattcttttattccccaccaaagtttttgtaaggtagtaagaggatctttgtggaaagaattcttattcccttacgttcctcctggtctgttcctaggtcaaggttgagtacgtttatagatattctataaatatattttattttcaacattaagtgtagttcatatagttgatgatctaagcaataagaaataaagtaaaatctggataattttggttactctgcttttcctctgtgtgtttcaactacaaaattcctcactacaatgctccccaattccttttattggtgcttgcagtgccagtgggcaaactgaattcttcatgcaaccaaagaattccaaaaacgtatttcttgcagctagcataaatctccagttccacaatggtagcagtggtggattttacccaatgttttaatgatgaatgtaatcagaacataaaaagatctaaatgcatactttgaaggaatttgcaaaaatgactagaagaactgaaaaaagcacaattcagtttgtttctttagcatctgtgtttatctttccccttctcttgtgcatattgaggatgttttaaagattatatttttaaaaccaaataaatagtttccaaaatgttcactgatggggtaaattagcgttctctttgtagatgtaattattaaataaattcaaaggactaaccctagaatgacatttttccctcattcctgggtaatttttgagatttcccctcatgcccaggagctaattatactctctcactctccctctctctctctctctctctcgctgcagctttctgtatgtgtgtgtgtgtattatatctaagaaattttactccaaacatctaacattctgggtacgggtttgatttggggaaaaaattacacttttttttttatcctttagcttttctccttaaaaagtatcagtgagggcagggaaagggaaggagaatggacccaaactaataaaaggattgatcagtgattatgaacaaaatatagcttctgtatttccactcactcagtatgaagtttgctattattttccccaattcctggagccagttattgcagcaaatttagcatttggagcttatagactcatgctagacagacacatatagaatttacgaatcgaattagaaaaatggtctttgaataatataaattgtactccatgtatatttttatatatgaatgaacctactggactccagtgagattagcaaataccttagctatttcattgcaataaaaaccatttttcagtcactcatgtccctctgggttcttcagtgatattatttgatgtatgctttattctgtgccatttattgtactgagtattttgcatgaatgatcttatgtaatcatcagtaatctgttaaatcagtatcattattattcttgtttcattgatattgaaatataaaagtaggttatcataaattaaaaggctacgggtagtgataaaattttattccaggtagtatctccagaatatgaattcttaatcactactcgtgtttattcattccacatgtcactgaatgcctactatgtctagcaaagttctagattctcttgtagttgcattactcagttattggctagataaccctaaacactgcagaaagctgcactctgcccccttgggattgcctggctccataagattattaccgttgctgagtttggggacccacttgagcaaatctagcatacttaaaaggaagtttttattctggagaagttttgttaacaaaacatctattggctgggcagagtggctcataactgtaatctcagcacttcgggatgccaaagtgggcaaatcacctgaggtcagaagtttgagaccagcctggccaacatggtgaaaccctgtctctactaaaaacacaaaaaaattaggtaggtatggtggtgcacgcctgtaatcccagctattcaggaggctgaggcaggacaatcacttgaaccggggagacagaggttgcagtgagccgagattgtgccactgccctccagcctgggcaacaaagtgagactctatctcaaaacacaaacatacacacatacatacagacccacacacacatacagacacacacacacacgtctatttagcatctgtcccaggcagtgcttctcaatagcatgttaatagatgctaaaggacctttagttaggaggtcaactggtctacctctgtcacttagtagacaagaaggttgccctaaaatatacactaagacagtatgcattacaaaaaagccacaataaggacatagcttaggagaaatgttatgatctctcttcaccagtctccttatatgacactggttcaattcagaagtagaggtgaagatagttaatatcctaggaataaatgttaaatctcccttcccctttcctcacagtattatagtcaattctcataaggaaatggccctaagttacaacattaagcttttctattcacttctaataactgaaattccgcccaactgcctcctcacttgaattccatgtactttttttccaaataaattaaatgactttctctaagtcaaatgctattaaaattcttgttgttcctcaaactctgctttcttgtagtatcaggtttattgtgacttgaatgagacttatttgtaaatggatgtattttccattccatcttgctcttgcatacacacacatacactgaaattcagacttttctgctagctcttagaaaacaaaagcaatgtgtgattcatgtgtcacccactgtgggaagttggatgttgcattgcatttgtctctcagtcttaaaagtcaatatggcaaagtcattagcggcagagcccagaagatatccctgcccatgagctgtggagatctggacaagttactttacccaactccaagactcagtgaatgctcttatccgtaaaatggggacaatgataatatgtcttcctccctttgggtatttgatgattaaatgagaaaacacgtcacacagtcaattcagtgcttcgcgcacaataaaagcttaataaatactagttatgattatgtttagccaacatgtgttggcatctgacactaaataaatacttgtccaatggaaatgaccagaatttagtgcccctaacacttcactgtagtatttgccatatggataagcaatctttattatgctatttggatttagttccaaagctaaccccacctccttatattgaagccagctcctaggccacctggataacttttctggcatttcaatgaacacaccaatacaatacaagcataattagactttctggattttagatctattctcaagtatatattgtatagagaaccaagatgttcaaggactgtagagccagttataggtttggttttaaagcacttcatcttagactcatttcctttctggctgatgttagttaaaataatataagcctgggcttaagattgtatctctgagtgagacaaaataatagatgattctatctccctttagaaaaaaaagaaaaaaaaaaagcagcagcagcagtaattgactcttacgcttaggcaagaactccacaatggatttgttggggaaaaaaaaaatgttttcctgcttgtatgtgttggtttagattttctgttgtatgtgtgttgtgaaagaagactttggataattattgcgattttccaagcagctggtcttccaatggcattgttacagggtcagtctattttcctttaatctgaccataatgtcatagaacactggctgtttctttggcaactgttcagggaagactagctgttttctctacctcaagccaatggtggactgcaggcaggttctcctgcaagccacagggaagcagttttcattactggggtctttgtatcaacaaatcacttatttcactgtgattctgttgagacaggatccgaaagtaaatttcataagaaaaaaatgattatacatcaagctcaggtgactttaaaatttttcctttacattgagtaaagtttctggccacttttgaccttttttttcaaatgacattattgatatgaaatcagaaactataactgataaactacaaactgctgtatagacacttttctacacaatggtcattgcttttattctttatctaagcctgaattgtaaggcttccttctctttttttttttttttttttttgagatggagtctcgctctgtcgcccaggctggagtgcggtggcacgatcttggctcactccaagctccacctcccgggttcacaccattctcatgcctcagcctcccgagtagctgggactacaggcgcccaccaccatgcccggctaattttttatatttttagtagagacggagtttcaccatgttagccaggatggtcttgatctcctgacctggtgatccacctgccttggcctcccaaagtgctgggattacaggcgtgagccaccatgcccggcctgaatgattccttctcatcttctgggaggtttttctgacttgctttctcaattccactctcttaggcagagcttatacctcccttcatgtatgttacatgtacatgtattgagtcagtgcatcctcctaatgaaacttttcctgagatctctcttatttactttcttccttttctgaaattctctgctatttagattcagtgccaaagaaattgacatttttatttacttgctgaggaataaacagaactcgaaaggatttgggaacccaagaccaagttttatgaaataactaatcttgtcttcctaaatactataaaaatcttatataatccctaatacttagcatagtgctaagcaccgaataggaatacaagaaatattgcaatgatctgaattgcttacaaaatattgacaacaacttcttcattggtaaagaaaagctgcttttgacctttttttcttcctcaagagtaagtagtgagaagcataaagtacccaagagtttctttgcctttttgattgttgcatggaaacaagtatttgcaaataattaagatgggaaaatttggctccttgaaaaggcaggactgctttcagatatatttgaaatgaacttatacagaagccaacatggttatcagagcaattgggtctatttcctatcatctcttcatgatatcttgtaaaaatgccctgtgttgagagcactggtgatcatagcagtggggttggagtagaatctggtgcgtttcttcctctacagatctcctaatagcacttgccctgttttcacagagccttatcaaagtttgatgtagactccagtgtgtagtagtgggcagtgacctaccagatgacctctttgaacaagagctagtttgagccagtgtatagctctgaatcgatggaagatccattttcaaatttcaaaagggctgttaaaacacttagttctgtattatagagatacacaaatggatataacaaactggatgtctcttctgcagctgtttcaattcgtatgccatgttttctatccttcttgctcctggcaattttctttcctgaagcatatcacaccttcttacatttgacaagcattttcacagctactgccactccctgctgccaaacaaaacccagccctgtttgaattcttgagggctgagggatggagaggagacctgtttgactttgaaatggttttaacgtcactttgtatacagaacaaaaatggaaaaccagatcctgtgtttgtctaaaaactaaaatttcaaaacctaacctgaggtggagaaacagatactacagggcaaggaaatgtctgggctcaccgcaaaggaatgcagcaagggaaccacctgcagacacctgtttaagagtttacgtttttgttcttccacacgattattatcttagtatctcaactggctatacatgcttttaggaaagttgcagggatcatattctaaggcgtatcaaatatgttcagagtgcaagcatgagcagaatctctcctctctgctagtgaggtcctgtaggtctacaagttactaacttcaggcttacagaatgttagaagtaacgggtgcatatcctgtaatcaatcccggtattgagcaaacaggcacaaatgacacccagcaagaaaaatgacttgctcaagacaccacagcaagttcatggttttctgaactgaattccaagtttcataacttctaattaatcctcctttttttcccccagtacagctaatatgctttttgtgaataataacatataataggtgtaatctgtcagaactatttaatagttgatagtatgtatcctcagtttattgaggttcaagctcttctgagtattataatactttctattggtattttctctcttgagctattccctaccttgaatctttcagactagagatttcagaagattacgtagtgtctgtgacttcaactacacatggatagtccacaggactctggactttcacggttccatgtcagttggacaggtgttactctaaggccctgcaaaaatataaagtagtttgagaatcactctcctgttaatcttcagtaaaattctgagctatttatatgtgagattgagaggcagcttggtaggatggaaagagtttagactttgtagttctactgccccaggtttgtatcccagctttatttcctaacagtgtagccttgggcaaattgcttaacctctccgaggctcagtttcttcaaataaaaaaatggaataagccttcccttgcagagttgttaatattatatgaacgttatatatgtgaagtgcccaactccttgcaaatacctaatatacaccagcttccttcccaggcttttgctggtcagatctggtttccacttaactttggctgttggaagataagataatttattatgaagataattgtctggtaattgtcatgagaattcagttgatgataattgaatgatttgtttacctttctgtctaaagagttgcaactcatgggggtcgtgtgtgtgtgtgtgtgtgtgtgtgtgtgtgtgtgtgtgtgtgttacttacaatgtttttgccatctcttcctgtatgacagtatttgattagtcaggtcttaaaatgctaaacactttatccttttcttttaatttcaattttagattttgggggtacatatgcaggttcgttacaagattgtattgtgtgatgctgaagtttgggcttctatcgatcccatcatccacactgtgaacataatacctgacaggaagtgtctcagccctttctccccctccttccttccttccttttggattcccaagtgtctgttattcccatctttacatccatgtgtacccaagttttcgctataaagaaaaaaaaaaccctgaatacctattgcatgcctcactgtagaggctacaggattcacaaaacaaggccccataccctgggcattgataaaaggaaggaaaaatgtagctttcaaaaaaatgaaaattgactttgttgaagggtattgtaatagaatcataaaactgagtgaggaaggaatgtattctaactacacaattagggaatactttgtggaggaggtgggttctggattttgaagacggagtatgatctttgacagatggtgttcggtgggaatgaggaaaaagaaaggtgagcttcagccagggattggaggtggaaaaaatgaacacatgggtggcgatgattcaggcagaggggcaggaatgtgaaggaactaagacataaaagtagaaagacagtttaggcctggtttatgagggggtctttgaatggcaaactcacctttggtggtccacgggaaggtttgttagaactgcaggagtgtgcccaaacctatatgtcaagccactaactgccagccatcagtttgaaaaccgaagcaattaagatcgctgtccatcttacctgaaagggaagctttgcactctaacttgaagtagcctagaaatttcagaaggttacatagtgtctgtgacttcagctacacatggataatccacaagactctggacttattttcactgttgtgtaatagggttagttttgtttttagcagattctcccaaggaagtgtggtaatcacatttctcaaaccattacattaactgctgttagcaataaattattgcttatgtgctaaaagtcaaaaaaagcttttcccctttggaacttctttactatactccctgatatgttttgctgtcctagaaactggtgtttgtgtgtgtgtgtttgtgtgtgtatgtgtgtgtgtgtgtgttcaattgagtcaagaacagaggagaggagactcaggctgaaaatgtcaagttattttgagtcaaatatttgtacatttactttggaagttatcactaaaaaacaaaaagtgtgtgtctctttgtgtctgtatctgtgtgaatctgtgtgcactcattggtataaaaggaggaatactcttctcaaaagtacacaccaatgttcttgtccaaaagcctactttcatatatgtgaatgtgaattcctacattctgtgtgtttgcttctcctcactatagcccatttctaacatatcccaacttaatttcctaaatctgtcctatctacataccacaaagtgcttaactgagaaattaacttctgtgttacagataaatggaagttagattaaaaggataatacattttcatttttagtgttcttaaataatcctttttattgtaaataaatataacgttaactccgataagtccagactacttcactgagttcaccaccgaaatgttttcacaaaatcagcatcgttataccttggcttttataagaagttagtatacgaaacttgtataggaaaatgtctctgtattatctatgaaactgttaataaatatgttttccatcatgtccatgtcatcgtttacatatacgagatgatttcctcttagaattcattctaaacttctttaacagaaattatctttttttgattcatattctcccttttgtcctggttaccagacagcacaagtgaccatcatgtttagatttctgatacagttctctcttccattcctctctgtagcctctgatttttttttcagacttcagttggaaaaatcctaatgaatgtaacttttagttacaggttgaattcttttgaatgtgtatatttaaaataagtaatgcacatagttaaaaagaaacatgtttttaaaacagtggttctcaattatagctaaatatttagaattatctggatggttttaaaactctgatacccaggcagcatcctagatcactcaaatcagaatatctgggtttggtcacggacatcagtattttttttttaaagctgcccaatgtcattccaatgttaagattcattgttttagatattctttattatgatgttcatcatttttacagaaacacatttccaaaaggataaatttcaaaatcacctgtaaacccataatttattataagtcactcttaacacctaaaaatagctaacctgctaacctttttcttttgctttttccttcttcttttaaactaaaattacaataatatatgtgcatatatagtgaatgtattcatttatatattagacacaatttacatatttatgcttatatatatatggcatacatgtacacgttacaatatgtgtatttgttttattccaaatctgttttattctcagagacattttcccatatcttcccagatatattttctgagaacctggtttttaatgcttgtataacattaatacttgtagttagaccattttttttactcattcttctattcttacatattaatgttgcagacaacatccttaaacaacttttgtgtgactaatccaatttttttccttgggaataaattatgatctattgatttatttctatgtgggctgaattttgtccataagaatgaaaatggtagccccctaagatgctgtttgctccctgatatctcatttttctctagaatacgaaggaatggctgttttctgctcttcctaaagattcaggatgtaataatatactgtcacaggtttcagaagcatgggaccttggcaccgaaagggtctctactagctaagttgtcttggaaatgagtgggtccacttcctcttctgatacaggaagaacagggaggtcattaaatgatgacggggctctttgaagtgaaatgaagcaacattggagggtgtagcatgtaaaaactctcttctcggatacaaaaaaaattgagctacttgggctaggagaagtgagcctggatttggaggcttaaggtttcaggaaggtctgagacaaacttaagaagaaatgcatcaagagggttggaagggacagacgattgatgagagcactgaaattccagtgtgatttgggtcacccgtgtgacatggcatatatttatgggatacctggaaaataagggagaaacaagacatctatctctgtcacactttggggaagtatacgattaagttccacactctgtggtggaaagaatgtcctggaggcccccagtctttctcactgtgatgccatgctcatttgataacctcataaacacatttctgttcttattgccttacccattctgatgcactgatcattttttaggccatgtgaacagggcagagcttgtcattatgcctgggacatagtgggcattcagtaggtgtttgttgaatggaagaagcaggcacaatcacagctttcccttctggtgatctgctttatgatacaatttccaggaatgcattgtgtctaaaattggggaccatatgtacaggaaattctttcttatgtcagtgtgaaatccctccaaagtaaatccccctttatggttttttattggtgtttattcttttttaatacagaaaactgtaaactttttattagggcaggtttttttgtgcaaaagccttgtcatgggctagatgacatttcttttcctgtagagatacttggacattttacaattcaattacttccttccaaaagccatatttagaattccagccaatctgtgagccagaaaggagtgagccagtataataatcaaggtaatgtggcaagaaggtgtgaaatttcttagcctttctagaagagatgggtgaaaataaatgttttcagggtcagtaaataactttcccctagtagccagacagaaagcatcttactttgctcaagctggacctttgtcatttgaaggatctcctcctaatgccatctaagcttgagaggttcatatggctgcagcatggtttatcttgctgtttaaacattgtgtccattcaagctccattgtagacctttcttttaaagagagttcaccctgggatattaaataaaatggaatttggatggaaagttggcatcccagttcggaaccaatttttattgggcacagacttggggggagcagaaaaaaacaaacacaaagtctatgttgtaaatgataataaaaaaagaataagtaaaacaaatgaaaatgtttcgttttactaaggcttttttgcattcccatgacttcaaaatacttttgcattttatggcaatctataactgctttagtatagacagacaaagaacaaataaagttacataaatgcagagaataacagaagaaatatgtagaatgacagtggtcagttggtaaagattctattggaggttttggaggtttttgcataatttgtattagtccaaaaatattatgaaattaataataaattttaaagtgtatacgtttcttaatgtcttcaacttgccaattctgttgttagtcataaacttttatattcctccctatgtttatctttcccatctctccggcttgcttttgttattactgttgctgattctcaaaaccattagatcttaagtatattccactaccaaagtcattaattttaaggagaaaatgggaagttagaagccatgattttacttataataatccatttgtctcatactttcatctcaaaaatatgtatttaagtagaaagagagccagaaaaataaccgagagagttatattgtaattctggctctactgtatactagtagtgtgattttaagttggtaatttatcctctgtagcctcagcattgtcttctgaaaagtacgttcactcattcgggtggcgtgagatttaaaagaaatgactcctggtagagtagaatgaagtagaatgtagaatgcggtagcaatagaatgaagacatgagtattgatgatgtagcactggactgtgctatatgatagttaccagccacatgtggcttctttaaatttgagctaattagaattaaattaagttaaaaatttagctccttagtcatacgagccacatttcaaatgctcaagaaccatttatggctagtggctacaatattggacagtgcagaagaactattccattattgcagataatcctgttgaatagcacagacctagaatgacagctccgtgtagggcactgggaattgctgtttggggatggtatcaccttgagttggtctgtgacctgctgggagtaatgcagttctcaaagaactctaactctcctttaaccgcgtgcaaaattgtgaacctgggatgcgtgagggagtggttattttgtgctgaatggtatgtcagctacatcaccacagatgtgagatcagcagacttgcttattctgagtgccgtcagaatcgttaagtaccatatgtccagtgtcatctttggcacatttatctggcttcatctgagttccgaagtgaaatctcacagccgccttcataaatttagccatcaaagaccaaggtgatgatgacataccaagctttagaatcctcaagtagggtgggatattggtgctgggaatgacgaatgaagggacatctgagaatcatgctgcttttatggattagcagaaattcatcttacgtgaccaagagcagctgcataatggctagaaaacatttgccctttctgcttatgttttggttatcccaacacattctatgtgcaatgtctgagtttgaaagttctttttaaactataaaatcatttcccaaagttaggactgattatgaatatcatcaatgattgtttttaaatgtcattatggtaaagtcatagaatagtgaccatctgtgctgcctttgtctttgtataggtgcagtagtcccagcctttctttctctctctctctctctctctctctgtgtgtgtgtgtgtgtgtgtgtgtgtgtgtgtgtgtgtaggatcactggagtatggtggtgaagaaagctgtcacagcacagaagttcagaaggaggtactgtgaaggtcccaaagcattgagcttagctagttctgaaagcactaaggttaactagtcaactcgagagttgggtgtatatactgctaaggaagggttcaacccagggggctcttgctctcccaagacaggaaacatgtatctgaagtgtgaatctattgctattatcctcagtttggcaggcgacagggttctgagagtgagagagtaatggaatgtgtatgtctctgctcttgaagataccaggggcacctcgaaaactcccctccccagcccagggtcaccacagccttaaccgactgcctcctttgcaaacctttaccatgggtacctagaaaaagacatacacacacacatttcagcttatggtttttgttcgtttgtttttgttttttgtttgtttgtttgttttgccagatacttaagatttaagggcaatcttaagggaaatctcttctcccatcttgactgaggcacagagatgtcctgttcccatgctgttgatgctgacagacgtaggacacgtttttttctccgtgtgccaccacactcaagcagaatgtataagatattttctgtctaccaaggatacctggtgacataatcatacctagcctttctttcctccctccgccccctcagcctctcaccctgccctcccatgggtctttatgtgtgctactctatgtagagtacaactcataccggatagcctgttacttattttggttcaggagcagctgcagaggatgaactggagaggacagtctacttgcaaacacttgtagactctccagtggacaggttacctctaaagaaagagaagcctacgctttcctactcactgaagttttttaccatttgcaagtggatccaatatatgtttgttttgggtgaggggctaacaaaatgctctgcggtttctgcaggtttccttataggagatcctgttatcctcgtgtcgattcttgccccattagctttcagcagtaaatagttgagggtctcatctggaaagttctattattagtaccacatggtcagtacattttaagatagacattttaataggcagaaaactgtatacaaggagagatgtgcaatgcagaataactatcaaatgatatctagatatcttagattgctactctaggccatccatggtcttaccccatgggttcctctaactcccttcatcctcccttaacattagctgtaggttttctcatcactgtctttgctcacgttattttctctgccttgaattccctccctcaagctccccacaccagcaccaccagcatgtaccctgttctttaagactcaactcaaatacctctgcctcaaaaacatattgccctaattgtcctggctgaaagtgacagtcatctctggaccccccccactctcatctctgcacctctctatgtcatccttaatcactttctgacttgtgttcttacatagttgaatatgccttatctctactacttgatattaaacttcataatgataataagatcctatcttatcttctcctgtctcttccctgatcaggcctagggtagttcctcccacactgtactgttaagagaatacataatgaaaaagtaaatgaataaatggcagaaaccttatgtggaatgctggtgcaaacagttcctttgactgggggcttttaaaaagagactgattgtataggagatctgagcaattttcatattaatggaatggattattagagctggcatgaacatcaaaagaatctagccacaaccacctctcaggtcatcttcattttcaaatggggaatctaagatttagataggaccattccagatcacatagtgagtgattaatagacctaggactcatacctcatctgacatccaacaccacatgttcttttgaaataaggctggaataatagtgagacacacatattagacacatgattgtgagaagacagttttccaccccacagcacatgaccccatacgtttaagtccctgcctatacaaatagtacagacaaagtaacagcaactttagagggaaacatgactatttccatcatatggtgattctacagagcagaatcagaaacctgggtaaagagaaaagtcctactcagtttcattcttgttaaaagacttaatgactggagttcaaactggcggagtcattggcagcattaaagaagtggggttgaagctgggcaacatttccacaacagggagtggaacagagagacagaaaatattgggagtcttgtgccccatcagtagaaggagatgaaggccagagccaaatggtgggggcaggggtagggggaagattcctttctccagcatgtaacagcattatgggagtgaattcagagcttctgtgtgttctgagccaagtgcctgctggaatgtggactgtaaatctctcatcgtcctcttcactgacccacaagcaacccctgctcctcccatctgcttcccgaccacctgcctttcagtttttctttatataaaaaacgttttccattctcctaccttcctctctgtctacctttgtatggtacatctcatccctcttctaaatatttccatctgaccacatttttccctaatgagacaggctcacaataggataaagtgtaacatttattcatttatctgctcagcaaatattattgagcacatactgtgtcctaggcaccactttagttcttgagtggtcagcagtaaagaaaacagacaaaaaaataataccctggtggagtttccattctagtggggacacaataaacaaaataattggcaaattatatagaatattggaaggaagtacatgctgggagagaaataagctgggagggaaaagggagtgctgggggagaaggagctaagagtctcagttccagagttaggcagcctgagctggaattagaaccccagctgcatgcagtggctcatgcctgtaatcccagcactttgggaggccgaggtgggcggatcacctgaggtcaggagtttgagactaccctggccaacatggtgaaacccagtctctactaaaaatacaaaaaaaaaaaaaaattagctgggcatggtggcgggcacctgtaatcctagctacttgggaggctgaggcaggagaattgcttgaactcgggaggtggaggtttcagagagcagagatcacgccattgcactctagcctggcaacaagagcgaaactctgtctcaaaaaaaaaaaaaaaaaaaaaaaaaactcagctgcatccttcccagtcatgtgacctgggcaggttaagagaactccctgagcctcagttttcttgtctgtttatcaagagtcattagggaaactagtatctccttgggttgttgcagggattcaatgagatgacacatgtaacacaatcattacctcgggcctgtctcctataaatatagtgattgtcacgtttgttatttaaacaatattatatattgtgttttaggtattatgtatgtaatatatagtgtgaatatatgtatgcgttatgtatatagcattatctgacttcgtgcctctagtattacatgcttctcaaaatatctatagttttgtcggtatttctttctcctactagattgtgatcttttatcggcaaagaccacctctcgtttatctctataccccccattgtgcccagcacatcagagattttatgtttggctgctgaatgagaaacaaatgggatactgttcttctaagcacaatcatcttatattagcattcatttttggaactcttctctaattcctgtcatttttgtatcacatcagaagaagagctatattccctccaccgcctctcctcgcctattaatcaccataccttcccacctcttacgggaataccgaactaatggtccttgtctcaatgacctgcctatcctttgtcccttcatgggaatcttctcacagatcaagttactatgatctacaaggccagttcccatagcctcgttccacttacacacgatcttaaccatttctgtccagtgggagtcacccactcacctcctaaaacctctatgcatgccccatacccctagtcataatactcttatacaaatgtttaacactttgcagttgaagacccaatgtcatacatcttttcatttgatacttagagtcactgtgtgaggtacaaacttcagatattaccagttgcatgttactaataaggaatcagaagctcagagagggggaatgaaagaatccaagtatatgtggctaaaattggccacgtcgacacctgaaatcctattatctggggcaatatacatactgggtttgaaaaagttcacacttagcagttgaatgacctgagtcctcaccccagcttggctacttactcaccatgtgaccctgaatagtgccttgaagcctcagggtttttttacttctgtaaaacagtaactcttgccctcccggacacatgggatagtttgaagattaaaagatacattggctgggcatggtggctcacatctataatcctagcactttgagagactgaggcaggtggatcacttcagtccaggagtttcagaccagcgtggacaacacagtgaagccccatctcattaaaaaaaaaaaaaagatatattaagaaacttttgaaagtataaatcatctaaatcatcatgtataaatgtaagagatatgaaataagctctgtgaaaatataatggctgatggcgtccctgtgtgaaagatagaaatggacattttatgtaatttccatacacaccaaacaaaacaaaagatctttagaatttccaagcatgagtgaggttttacattgattgtaaagaatatagaatgcggaaactcatttttaattattaaaacttataggctgaaaaaaagagtaagcactatttaaaaaaaaaaaaaaaaggctcaaccaggcgcggtggctctgtaatcccagccctttgggaggctgaggcgggcagatcacgaggtcaggagatcaagaccatcctggctaacacggtgaaacctcgtctctactaaaaaagtacaaaaaattagccaggtgtggtggcacgtgactgtagtcccagttactcggaggctgaggcaggagaatcgcttgaacctgggaggcagaggttgcagtgagccaagattgcaccactgcactccagcctgggcaacagagtgaaactccgtctcaaaaaacaaaaaaaaaaatgcttccccacacccacccccaacgaacgaacaaacacacttaggaaatagggaagaaggttatgttttgggacaactttctatacactgagaaaatccaagaggtctccacatctacctataaaattcagtgatgctcagagctgacatgtcaatttttcctattacatagtaagaagctcagcattatgggccgagtttattggacactgcagaaattcatttacattgtgtgcttaccctggattgttgttgagtccagctgactgttgcttcacaaattaactgtcctttgagacttggaaatattgaaattgcatagagtttttgtgaaatctcaatcctgtagtattgtgtatattacaacaggtgctcaatagacttctggattattaaattgagtaatatttgtagcaaagatctgtaggctgaattataaagctaatctgtggggggatgccaagatttctctatcattctgctatgtttgccatggtctaccaggagatggcgcctggtaagagttccatattttaatgtattctggtccaaatcactggagttggcaaagatggagaaggaggaactgagcagttcatccccaaagacatgatgacaccactataagtgtgaagccagcaagagtgcaaagactgagagcagcgtggtcatacctagacatttatctggagagcaaaatcaagcactggggctcaaagggttcagtcccagcagttaggagagagaggagtctcctaggagtagttgccccaacagctgctagaaagtcctgatcctttttggtctgagccaaccaggtctcagcccagtcccacttgcctcaatttaaagtgacatttttggtctctagctgggtgcttccccctctgtagcatataacaaggatacactttcaaggcagggagcctggaggacaaggagataaccctgcaggcctggccacccaggctctttccggtgttccatgtacactgcatagattgagtggacacccaggttaaagagatctctcagtactcttggattttcctttaccttaattttgaaattataatattttagacataacttgtgcaggatcacacagtgagtctataggagaactggatgagaacccaagttttctgactttcaatcagctctctctccctacatgtaccttaacatgtatcataaagatgactgttgccatatgggctaagccctccattttctgagtatgcattaccacctccttccctcagaacaattaacagaggatctcataaagatgtgctatatatgtgtcccatagattttaatgagacttcagtaggtgggaaggtgtagtatttattctgggatattggaagagcaagttggataggaccttaaattttctacatagatacttgtggaggacaggctctagggtgacttccaatgacccctgcctcctggtgtttacatctctgtgtaatacctctccttgagtgcaggtgaatctgtaacttgcttctaatcaatagaagaaggcaaaggtgttggggtgtaacttaccatgattacatgttgtgatatacgagtccatctcagcagatagagagactctccttgacagcttgaggaaataagtgaccatatgagagaagctcatgaggcaaggagctgtgagcaacctttaggagctaaggacagcttccagcagacagccaacaaaaagctaggatcctgactcacatacccacaaggaaatgaattccgccaataatctgaatgtgcctggaaaagattcttccacagccaaccctccagatgagaatgctactcagctgacactttgattgcagcctgtaagactccgagtggaggacccagccagagtcatgcctgggccctcagaaactgtgagatagtaaatgtttgttgttttatgccactgagattgttagccaacaatcaaaacctaatacaataataccctttactgttttctagacagctgctatttagaaaagcctcccacccaataaaagagtcccctttatagttttccaagtaggtggttatcagggttctgcttcaccatcttcagtggcaaggaacttccatttcacagggcaaccatgtgtgtattacagaggcttgcatgttgtcaagttcagctgtggtcttcagcgggagcctaggacatgccagggatttcaaggtaggctggtgaggggttcctggttttcttggtcctgaaccatcccagtgccattctaacagttgcaagtctgcctccttcatgacaaaaggactggaggaaaatgtatctggcaagtcgataacactggatcgtttgctcccagctttaccacttggcatcagtgcaaactttcacccagttaaataacttaatgagccctgctctgcatgcttgcttcacagagttgtgacgatcaagtaagacagcatctatgacagtgtttgttggctgtaagtcagcaaatgattgcaaatgatgattattattaaaataatagtcatttgtcagtaaatatttgtcaaagctggtccacactgagggagacaggctctccagggaaactgctgatgcagagataaagaggagaccagccccagtttggaattgcatcactgattctgaattccccatggtacatttcaggtcttgcttcaggaatttgttttttgttttgtttggtaggaacaagaatcccctagagccagttatgttgtcatcaaacttagttgctaattaggcaccaaagcaaacctatgccagtgagacagagttgaaacttgaattcctttctgcaggtggagcgttggatcctagaggcggtgtatacagcttggctattttgatgcttctgcatgcaagaaggtttaagagaatctgagtaaagcaattagcatccctctgtctgcaggcaaaactggtttggacatgcttctctcttcttgaagggctgttagagccttggcagtgtatctgacgaaagatttcactaagcaaaatgtcttcacttacaaatccagccactttgcactctcagtcagcctcaaattcatttattttctttagagtttccctacaaccacgaaccaccaagaattaaattaatccccaagagcctgagcaattatgaggatgttgaatctatccattcaaggatgtcccagcaaggactgttcattcttttaacgtaaactatttatatgttttgattctcctcatttggaagaaagaaataagttttcatatatgtatttttcagggtgtattttatatatctgtttatattacactgttcacattactattaaagcatccccattttattgtaagtttattttgcctgcttcgggaagaacaagaccaagatcccattattaaaaccaaaatcttccacaaaagtttccttttaaaaacttagattaggaaattttcagtcagccagccaactctatagcctttgatacttggtcctacaaagttttcttcccctttggtctgaatgttttcctttgtctgtgcacactctattctcctgccagcatgataatacatgctgctttgatatcaagtggcgggaacatatagaaatgtgctattggtgctgcaatttgtatctttgttttcatcaaacttattatttaccattttaggatttttttgtttctttttgggtggttttttttttttttttttttttggtgtgttttgtttgatcttggttttggttttccaatctaggcctgaggtccagtgctaatttgatgctagtgtgaactctctgagcctggttccttgacgttccattgggtgactattgcagtggttcagatgtggtgctaccagccttccccaccaaggaagttgcctgctttctcatctttgatcctcttcaccaactaaccacaacacaccagtgaaaattttaatttctccattcagttcctcagtttccgccaccaggtggtgagttcctgcgatacagataacctttttgtcttgttcagtacaacctcagtgcctagcacaaggccttgcagaaagctgacattccttaactctttatttctgaaatgaattaatgttcttaggttccatgtctcgtggaccaaataatgcaatcctagatcttgccatagcatctgggacaccacgtatgatgatttaggtaatcagtgaaaatccatgtcagcagctgccaatttacagatgaattatgtccaatggtttggagatgaatgagttttacagttcatagagcatgacaaaattcatcttagccttccattttatagatgagctaactgatctctgagagaggaacgacctctgaatgtcctgggaagagcttgtggcagaagtaacttctacctagtagtgtattttccttactgcctgttctcatttgataacagacccatatatcaattatttgcatccttcaattaacccacaagaaggcaaatttaatccagtgttagataaaataattattcacagggtcataacactattaaagaataagctatggccaggcgcggtggctcactcctgtaatcctagcattttggaggccgaggggggcagatcacttgaggtcaggagttctagactaccctagccaatatggtgaaaactgtctctactaaaaatacaaaaaaaaaaaaaaaatcagctgggcatggtggcagacgcctgtaatcccagctactcaggagctgtagtcctagcattttgggaggctgaggcgggcggatcacttgactaccctggccaacatggtgaaacctcatcctactaaaaatacaaaaaaaaaaaaaatcagctggtggtggtggcagatgcctgtaatcctagctactcgggaggcggaggcaggagaatcactcgaacccgggaggtggaggttacagtgagccaaaattgcaccattgcactccagcctaggtgacagagtgaggctccatctccaaaaaaaataaaaagaatacactatgaggcagtgagatatagggcaagactcatgttaggactgccacagagcagtcagtagtggcaacaagaaaggaacgcccctacgatgtgacaagtctctaccttgatatcaatggaattatgaatgggcagagaggctgtgcccattcttacctaacagggaagctgtccataaataaggtagcaattcctgaatcaaggacaagccttctgcccagtctttatatgtaaagaaacagtagtttcatttgaagggaaaccattataattgtctcagatgtgcatcttgttccagggtacttctttgtatttttgatgaggaaccaaaggctttattatagatcttgtgaatacctgtcagccaggatttagaacaaatgcatttgggcaattttgccttttatttcagataaattttatatgttgtttctgtccagaattgtaggatcatgtttggcttttcaaaactgcaggaaatgtttattttacttttctttaaagaagaagacagtaatgaaaaatgtatcgactgccagcccactgtttttatttctctttgtgtgagctatggcttctccacatcttgagccttaaactctttgatgttgtctttttaagcataacataaaagattattccctttagtctgtaggcttggaggtgggcaaacatgacatattcctgggtattcatatttctataacaataattgatgcaggttttggggctgttgtatttgccgtagccttatatgataaacatttggcattccatgacgtttcagctttgtcaactttccaatcctgtatggagttccctcttattgtttctgtgtgaacaacttgacaagagtggcatccgtggtcagattcttcactctatccctgcaggacttttcattgtgctctgcacacgatggaggctcaatgcatgaatgaatgcatggatgaatttttcagtttgattccgtgagctgcttaattctattagatgcgctccctaggcttttataagacgtttaattggtacatgtttcttatcactttttaatactccataagtgttttgtgttctttgcagtagagtccaaataaatataaattaaaatgtttccaattacagaggaaatattttcagtatcttcccacaaataacactgggtttataaggcttggttcccgggtttcatggtcatgcttggttgactaactttgtgttcatgtggcataagattctaaactgtcagaactacgtgggcttttagagcccatctaaatccttctcactcacagacgagcaagctgacatatttgcctcatttattggcagtgaatgaattaaaatattgtgccttcatcaagatattgtgtgtatattcacaatgttgtttttcataaatatgtagcattactctgttttgtgactgctcctagactggctggttctagggataaagaagagccagagaagaaatctgggcttcccagcagcaccttgggaggccgaggcaggcagatcacaaggtcaggagttcgagaccagcctggccaatatggtgaaacctgtctctactaaaaatacaaaaattagccaggtgtggtggctggcgcctgtggtcccagctactcgggaggctgaggcaggagaattgcttgaacctgggaggtggaagttgcagtgagctgagattgcgccactggactccatcctgggtgacagaatgagactccatctcaaacataataataataataataataataataataataataataatctgtgcttcctgcttaatttctagttttggtattcctactatcaggcccaacctctgtcctttgtgttcacagctaaatttgatttgcgtttggtcagaggatgggagaacagagaacaatagtcaccctcatcagcaactgagaaattcagtctgttctgccaaccttgcttgtatcttttcatataaatcttgaaattgcctctatttcaagtctgatggtcagtgactaattattaaagccattacttgctttttttaaagcctgaaccttgctttccagaatcttttccacctttgagattattttaaatatcatcattactttgagaaaagcaaacttaacaaggatgccttaagaaatataaaggtgtcattgcccaggaggcaagaaagggaggcagaatggtaatgaaatgagacagcccttgctttggttttataagatctgggtctgaatcctggcagtgtgttctttctaactttaggtaattcaggagccctagaaacctcatctctctatctagtgtgggaaaacgtgaaacaactttgggccatagattgctctatgcaaactcaacatatgcaaacttgtcttattaaaaagcctatctctagtggttcctatccctagtcttgtttggttgggtagcttccaattaataacagcttcaaattctggctaatatttgtttagcacttcatggcttacaaagtacttcattattttaacattgtagtattggtaataatatcaaactttctgttattacaataaatgttccttttttactttattattccattactttattactgtttttcagatgtactgtgatctacattttacggatgaaaaaaagattctaggaggataagggactttgtcacaaaagttagcttctaaatgatggggggactcatatgcaccttttgaaactcctaaacccatgttgattccccaaaggctttggtggtcctaaacatttgacataatcagagtctattataaaaaggtatggcttatccagctcctggttcctcactgtctcctctatctcaaaatattctagaaaaaactttactccctgaaaatatacagctttaggataggtgcagctccatttcatactctgattttcattcctcatttgaaaagttgaagcgtaatttcttataagactttagaagttgaagtcaggactggataaagaaaatgtggcacatacacgccatggaatactatgcagccataaaaagggatgagttcatgtccttttcagggacatggatgaagctagaagccatcatcctcagcaaactaacacaggaacagaaaaccaaacaccacatgttctcactcagaagtgagagttgaacaatgaaaacacatggacacagggaggggaacatcacatactgggtggggcctgtcgtgggggtcgggtgcaaggagaaggagaggattaggacaaatatctaatgcatgtggatcttaaaacctagatgacaggttgatgggtggagcaaaccaccatggcacatgtatacctatgtaacaaacctgtacattctgcacatgtatctcaaaagtaaaattttttaaaataagaagaagttgaagtcagggtataggaatcacaatttgcagtgctatctttcacacttcttaccacctgatgaaaatcaccaaatagtatttcttcttttacctaacatctctaggaaagagagaaccctgactgcacctacaagtagggaaaggcatttgagttacgcaaagctgcttttaactctgaaactgtcctacagtgtagcatataaacagggaaaacattttattggtgttttaatagaatcttatctaaatatctggaatcttactgcaagggccgatcattactctaggtagatttcaaggcccacagctccattatgatgtcaacaaggataactgatgtttattctgtagttagagcccccaaggcttcagcaaacattttgctcatcacttgtaggactagcagtaaatgtaatcattgcaagactgagctaacacatctgctaacagggttgttcatttgagtaaacagcaaggtgataaggcgcagggacggaccattggattgagtcagacaggcccgagtacaaaaaccagcctcactacttaaatcttacatagcccattaagagtaagttgcttcactttgggaggctgaggcggacagattacgaagtcaggagatcgagaccatcctggccaacatggttaaacctcatctctattaaaaaaaaaatacaaaaattaactgggcatggtggtgggcgcctgtaatctcagctactcaggaggctgagggaggagaatcccttgaaccagggagtcggaggttgcagtgagccgagatcactccactgcactccagcctggcgacagagtgagactccgtctcaaaaataaaataaaattaaattaaattaaatttaaaaaagagtaagttgctcaactttttaaactttagttttattatccacaaataataaattataaattgctgctttacatatatgatataaaaatgcatcaatccagttaatttggggtaaatggtattattccagtcttacctcctagaatactcagaagacacaacggtgtatcactagaaggagatagttttgttttggtttggtttggtttcttcagtcttctttttcctattccttccttttccaagaaacccacgatttctttctttctttttccagctattgatgaggtcagggagtaatatgttcagatctttgttgtatctttgttccgtttagaaaccagtatctgggaattcaacagagaatttggggtcactggaagctatgttttacctacatacaactacatcttcctcttagacctagagactagatactgaaaatgcaaaaggaagccatattgacactcccaaggataagggaaggcattacatcatcctttgtaatggtgaatcttgtgcatttgtagagggctggactttggcttctaccatattgtttagctctgtcaaccccacacaaggactttatttatttatttagacagagtcttgctctctttcccgggctggagtgcagtggtgcaatcatggatcactgcagccttaacatcctgggctcaagtgatccttccacctcagcctctcaagtaactagcaacacaggtatgtgccacctcatctgactaatttctttttaattttatatagatgggatctcattatgttgcccagcctggttttgaactcctggccacaagcattattattatcctcatcttacacatgaggaaactaccagtgaagtggcttgcccatcatgtgaaattacatatgccagtactagcctgttctgaaatccagcaacattcttttccacctctagccttgtttctagcaccctttggcctccagagcaagctggggttcattttacattaaaagtagagccatctgatgtggcgggcatccaaaacacttgggaaaatgctactctgtttagaactcgcttttcttcctcccgggtcccagtgcaggaggtactgtgtgctatgtgggccatcagactgtccctggccatggcaggagaattaggagaccaccagggctgtagttaactgtaggtccttcattaagaccagccaattgatagcgtgtgttcatgagtccttgtgaagtcttttcatcagccacgtggaagaccccttagaaaaacaatctctgtaatttgtatttttggacatagtgctttaggaaggtggatgtctgaaggtgggctgggtttgaaacatctctcaatgccatgggacagtgtggtacagtgtcctgacaacttaagctcatcctgacaacttaagacactaaattctactcctgcctcttctagtctagttggtcacctgccctttctgaatttgtttttttttttttttttgagatggagtcacgctctgtcaccaagctggagtgcagtggcacgatctcggctcactgcaacctctgcctcccaggttcaagcgattctcctgcctcagcttcccaagtagctgggattacaggtgtgcaacaccacgcccagctaatttttgtattttcagtagagatggggtttcaccatcttggccaggatggtctctatctcttgactttgtgatccgcccaccttgggccactgcgcccagccctgaatttgttttcttaactacccatttatttgcttgaaacagatgacttaaaatattccttcctcctctgaagttgttctttaaacttttctatgtaagaaattgattgagctgtattcctaggtattttattctctttgtagcaattgtgaatgagagtttactcatgacttggctctccttttgtctattattgatgtataggaatgcttgtgatttttgcatattgattttgtacgctgagactttgctgaagttacccaccagcttaaggagattttgggctgagacgatggggttttctaaatagacaatcgggtcatctgcaaacagagacaattagacttcctctctttctatttgaataccctttatttgtttctcttgcccgattgcactggccagaacttccaatactgtgttgaataggagtggtgagagagggctaatttacattcccaccaccagtgtacaagggttcccttttctccacatcctcatttgttttttccagaagacagcatttgctattacctgtcttttggataaaagccattttaactgaggcaaaatgatatctgattgtagttttaatttgcatatctctgatgagcaatgatgttaagcagcttttcatatgcctatttgccatttgtatgtcttttgagaaatatctatccatatttttcgcccaattttacatcagattcttagattattttcctatagagttgtttgaactccttatatattctggttattaatctcttgtcaaatggatagtttgtaaatatgtttccctttcactggtttttgtcttcattttgtttgtttcctttgctgtgcagattaacttgatgtgatcccaattatgcatgtttgctttggttgcctgtgtttgtggggtgttactcaagaaatctttgcccaatccaaagaacattcatctttgtcaaatgagctatagaattaatgtttttcctatttttatttattcattttatatttatttctattttatatattcatataacaatatatttattcataatatcactttgaatatcatttgttttcatcttgcatttttctcatttttcattgaggcctaatttacatgcaatgagatactcagatcatgagtcgtagttttaggagatttggcaattgtatatattacccaagaaagttcccttaagttcccttattcctctttctattcaagtcccatctgccaccctcagaggcaatgactttctgacctctatcaccagaaattatttctatatgttcttttaaatcagataagaatcacaccatatttattttttgtatctggattctttcattttgtgcagttgtctgagattcatccatgttgttgtattagcagtcttcatctttttgttgtttagtatgccacgattataccataattaatttacccatttttcttttttatcataatcttatataagggaaaaacatgggaatacatgaactgtatctttggctcaaatccatcttctatcagttctaagggcctcagggtatttgccatgaggggctgtgacaccagcctggactattaggaatggacctttgcttctcacagcagtcatttattcctccactttttctactagcgtcatgtgaagtgggaagggtactggcccgagagttaggagactcgagttcaagtggcagctctgcgctggcttggcagtgtaactggccactccatcaccaggacttaatttcttcatcagtaaaatgtttggtttggactgaacagtccctttttcatctctgacatcctacggtcccttaaaaatccctcctctgggctgggcgcggtggctcacgcctgtaatcccagcacttcgggaggccgaggcgggcggatcacgaggtcaggagatcgagaccatcccggctaaaacggtgaaaccccgtctctactaaaaatacaaaaaattagccgggcgcagtggggggcgcctgtagtcccagctactcgggaggctgaggcaggagaatggcgtgaacccgggaggcggagcttgcagggagccgagatcgcgccactgcactccagcctgggcgacagagcaagactccgtctcaaaaaaaaaaaatccttcctctgggtacctcatctttttcagttgcccctgcagtccctctctttagcatttctgtgaggaagtatccaaagcattggattacttgagataatatttctggtcctcttcctctctcacactctacactttgcttttctagaattgaagcctggagaagaaatattgtctaaagagcttgctacaagaaaatttccctaaaaagtattgggtcttaaaatttcatctcattttcaagttcttagaatactgttaatttgcaaagctgattatggatggcatactttattatgctttttaatcatacttcaaaactgcactatggatttgttctttctgtcttcctcccatgcttaatcattatttttggtggcaccttctaaactgttgacttattttctttctttctgatttgtagtagatgttgtataatctaagtttaggcagagatagtgaaagtgctggcctgcctgtatttcagccagtcctgggttaatattattcatgtggcaatgtctgttttactttaggactcaacgtatttaatacttcctctcctcctctttacaatacatagaggaaaggcctttgaaacataatttctctccctatgggaaatgctttctataaatttttcattttcaatacaaactgcttcactttacaaaacagtatctgtccctagcatgaaaaaatactggagggatatgaacagtaaaggagaatatttttctagcttgtgttaaatcaataatgtagtgattccaagggaattgagaggttcgtgtatttattcatatattagtcaaaaattcaaaattctatctctaattaaaaaggaatttgagaagtatctaccatttttattgtccatctctttggacatatgctttgcagcacagtggagcggaaggagcgtagacctacagaaatttagagggctaaatttttaatattggcctggctacattgcctggactttgggaaaatcacttaagctctcttagccttagtctttttatctgtaaactgagaataataatgccagtttttcaaggttgcattgaggatcttaggtaatacatataacattcatggaacataaaatgtgaaccaatgaaggtgccaatgcaattacaccttcattaggagttgtcatttctgcggcttctcattagaacatcaaaattagttccttcaatctttactgaggcgcagagctttaaactctaactttgaaacttccaaaatgaagtgtgaaaggtctgaggccttgtgagtttgaaaatgcagttcacacttcattttagaagctccagaattttttaccaaattgagattggattcaggaaatcatattttaaagccctggttcatgccattttctaaagaagtacctagaaggccataatcagaatgcttattaagtgaccacactttgaactgcattgcagataaattacctctgtgtggggagatgtgtcttgagattctgcggtcaaggctcagacagccccagagctggaaacctcagagcatttatgcctctgtcactaaaggatggggttatgggggctggacagaaagcttgagagagatgaaaagttcagtgggcttgagggaggattactgaattacaataatatccacaccgtaaagtgaatttgtacttgcaagagacacattatttatctagaattttagaaagggtctcttttcaggtcactgtgtagattgcctgtgatttgttctccttgattgaatgtgagtgagtgtgaagcatatctaaacaggtctcacagcaagtttctttcataaatctcctctggtatatatgctgtgtacccttgacaaggagaacactattaatggcgacagtatgcactggaactcagagcactgacgtgggaattgggagctctcaggtctgttgtttctgccagagaatgactctgtgaccttgggacaagtggattcacaaacaagctgaaggagatcatatctgtcctagaccgaaagcttatctgagaaagatgctacatgactacaaagaggttatttagtttcttagttcagataaggaaaacactaataattagtccaaacttcgaggctttgtctttgtcttctaagcttgctttcccctgtgatgtccagtctctcctaaaccagataaggattcacactattaatctcgacaaaatcaattctttgcatttgtgcttttattaggtcagtcattagtcaatgaacacttattgcacgcctgctgtttgtgcagacactgtgctagtcaggggatgcaaaagatgagtccgtgctggtcccatttcaaagaactcaaaatatggtggagacaagcacgtatacaaaaccagaacacagtataatgaataccacaggagtatacccgcaaaagttatatgggtgaagaaagaaggattaattagttctgccagagaaggactaattcagggaaggctttggagaacagggcacacatgatcggagactttactggttcagtcagctatataagtgataaggataacatgaagagaggtgccaagggcaagaaagtataagatatgtgtagaggctgggtgcagtggctcatgcctgtaatcccagcactttgggaggctgaggcgggcggatcacgtgaggtcaggggttcaagaccagcctggccaacataatgaaaccccgtctctactaaaaatacaaaaattaggcgggcatggtggcgggcacctttagtcccagctacttgggaggctgaggcaggagaattgcttgaacccaggaggtggaggttgcagtgagccaagattgcaccactgcactccagcctggttgacagagcaagattccatctcaaaaaaaaaaaaaaaaaaagagagagaaaagaaaagttacatgtagagaactgtaagtaatcttatctggctagaatatagggtaccataggggaatgactgagcatgggtcagagttgtaaacatccttatcatgccaatgagttggatttctccagaaggcatagagagatctgtttatagtttctaggtaagaaagagtttatgaacttgcctgtgtcttcgaaatatgctctggcagaatagaaaaggtgatcaaccagagtaggacagaggccacacacatctgccctgaggtcagatacctgtacatttattgtgtttgatagccaaatgattttaatgtaaactagttgcaaacatttaaaatttgggaaattttacataaaaatctagattttcgagcttctattaagaagtagagtgcacaatatctgcctagcaagaaacagctgttgctgagaagtgtcttccaccttcagctagagcatgcagtctgacatttgcttttctggttcttgtatttgagtgtgagactcttggagtaaagcaaacccagggtcagaaagatcactggtgatgatgttgcagttgtactgtcaggactgatgaaaacctaaactaaggtggaagccttgaggaatgaagaggagggcaaggatggatttgctgattgtttagatgtgtcatggatgaaagagatggagaaatcaaagaagactctcaggttgtaattttaggtaactgggtaggattcccatgtagtcagaaacccagaaagaagagaaggctttgggaagatgacagtgtattcaatgtggctttttgtggttcaagactttggaaaatattgattagactgttgaaaagtacttataggtcaggaacctggtcagaaagtattgtgctaaaataatattgttatgacccaagcagttgtaaaaataacttttattgtctaactctcacagtttatcttgaactcttaacaggttgtcaggcaaatatctgttcttgaaaccagaaaaacaaatcaagaaattgggatatttgaaatgcctagagtgggcttataactgtaaatgatattttacaatggaaaagtagaaacagtctttagcagccaatgtgaaataactgggtaatgttatttaatagaatgcaaatttgaaatgagtgataaccattatggagaattttgttaggaaaaaaattaataaagtgaatgtaacacatgaagcagagctggaactaggaagaaggaagtcaggctcctggggaaccaaattaaggagacttcccctctcaggcacttgtgggaccctgacggtaagcatctccttaggtactgctcccatcctcatccttgccttgagtttttgaaaaatatatgttagaaatgtttatgattatatatcacaaactgttattctcaattttatgaaattccctagatatgattacaatagtcatttgagatttatgatcttatctaattgttatgtatgtacccattgtggggtgatacaggcagaataagctctgaatttgagacttgtgaaaaccataagagcctcgagtcttgtcttatgagtctccgggtagagctgaactggctgcagctccaatgagaggcaattgcttgagaactgtttccaccagcatactgcatggaatgggtccctctctgatgcagatcccactgatactgatgtcgcactcttgctgatgcagatcccactgatattcatgtcgcactcttgctgattttgatgggccagtcaatagcagggcagcgtgtcaagatgctggagcaaggaagtcctttgtactatttttctcactgctgtcttttccttatggcatgccattctgtcttagaaaatgtgagacctgaagtagacatttggcatcatctagtccaacctctttgatacacagatgtaaaaactgaggcacagaggaggggaagaactttgctcaaatcaaaaagtgtattaaggatggatgcagtggctcacgcctataatcccagcactttgggaggccgaggcggatggatcacaaggtcaagagatcaagaccatcctggccaacatggtgaaaccccatctctactaaaagtacaaaaattagccgggcatggtggtgcacacctgtagtcccagctactcgggaggctgaggcaggagaatcgcttgagcctaggaggcggaggttgcagtgagctgagatctcaccactgcactccagtctgatgacagaacgagactctgtctcaaaaaaaaaaaaaagaaaataggttccgggtgttgcagcaagtaataatgattaaacattgtttaattaaataattaaacaatgcttgcttctctcccactgaaggaggtagaaggcacagcaccgtggtgagcgaggcccagctttctgctgtgttcctctgccatgcctagcatgtgaccactgtggagtgatgccagacggctgtgccattccagtgcactgaggacggagggacccttttcctctgaggacacatcatttcaccttaacccctttggccagaacaaagttgcatagctgcaaggacgactgggaaatatatttattctgggcagccatgtacttagctacaatttggaggttctaaagaaagaaaggaagagaatggaaacaattttcaaggcctaccacagcaaattggtgccatttctaggactagtatcctatttcctaactcctagtagaatgttttttctataccacagatttttaattctcataaagatgtgatttttaattaagaagcctataagaacattttgaatatgcacaaattcatcattttatatgtccatacgggatgcagtgattcccctttgcttaagatcaatttttgtttttattaatcccttgatatatagataggagtcaggcagacccaagtttaatttctgtctaccaacttgtgactttgggtccatatgaataaaaaaatctatgctttgattttgttttttcctctctaaaatagtaacaacatgtcatcttggggttgttttaaaaattaaatgggatgatattaatgaaagagcctagcccagtgtttagtattgaataggtagatatctaatggtacagataccagtttccttctttctcctcacttccttaggttccctccaacctgaagacaacgtatgtttctcatagataattacaaggaatttaaatccttgacaaaatgattttctggctatccatagcggacatgtctagatacatactctgttcattttaaaagatgaggaggttctgacacaatcagagaactttttaaaagttatggatgcctgagccccagccccagagataatgattaaacaggcctagaggttgttagtttttgaatgaagtttttagtttttatctgcctgagtgagtctgatgtgctattgtgttttacacagatcaatatgatggtagaatgaaacagagaaaacggggaagctgagaggtcacttaggcaggtattgtgattatctaagtgagagatgatagaacaatatggcaaaagatggaattaaaatatttagtgggcaaaattaataggacttgatacctgatgagatataggaaaaataaacttaatacatctttcaacactagcaaaactgtagctcttgaaatttatctgacctgaactaattggttcggggtaaaggagaggagaaattgtgatatgtgaaatatattaatatttagaaaattcttccaacattattaatatatagaaaattcttaattatctggaataatgagccaaactcaacaagataaaatctaagagggtcaagtcaaatttcattcttacctttaaaagttagctatacaagtacatcatataaatgtcatttactttgatagctgtttatattttttaaaaaaagaaagaaaacaagactggtagagaagatagtctgaccgcaagatcaacaataataataataatgtaggaccacagaaaagtaaatgaaatcttggactgcattcatctaaagaggagcatgcagaacagggaagcagcagtgcctggagtgctgagttcagttctgggcgccacatgatgaagggaacctggataaactagaccttgggcagacaaaggtgcttgggagagtgaggtgacagaaatttctcataaggaatgatggaaggtatccctttattccaataaaaagaagactaaggaaaggcaatgttttcagtgctctttagggctgttaaattgaaaaggcaacagatttgtctggagaggacagaagtagggccaatggggaagaagatatttatgtcaaaataagaaagctctaacaattagacctaccagtggaatgaacgaaccaagagagtgagctgtccctggacatggtataagcagcctcaggggctggaaaaacactgactgactgggaatgttgtagagggaatttatagatcagattgattggggaaaatagccccaaaggttctcctctctctgacatcactctatgattctatgtgaagttctagctttttaactatttttttgtataattaaataatttgtctttattgattgagaactaatcattaaaaaagctactgtcttttcatgtctagagatgataagaataatactacatgcttttgaagaaaaggaattttatgcaaataatcccataccagtgtattacgcttttgcagggataatcaagagcttgcaaaatttgaaaccacattttcccctgtatggaggaggaaagtctattttgcatccgtactttatgccttgggcattattattgctcatatgctctaggatttttaataaacctaacctgcttcatgaaattacactgcattaattcaacatggccatgtccaaaatttaatattcattcatttattcaagtatttattcaacaaacaatccctactatatttcatgtgctattgtcagtgctagaaacatcaatttaaaaatgtttaaatcctagtcttcgaagagtttataattaaatataaaaatattgtctatgtgtcaattactgtagctccaaatacctatttactccaaaaattagtgtctgaaaggaacaatcatttattatctcttacagtttggtgggtcagaaatttgatagcatcttgggccaggcgtggtggctcatgcctttaatcccggcacactgggaggctgaggcaggcagatcacttgaggccggggagttccagaccagcctggctgacatggcgaaaacctgtctctactaaaaatacaaaaattagccaggcatgatggcacgtgcttgtagtcccagctacttgggaggctgaggcatgagaatcacttgagcccaagaggcagaggttgcagtgagctgagatcatgccactgcactccagtctgggggacagagtgagactctgtctcaaaaaagacaaaaagaaagaaagaaatttgattgtgtctcaagtgggcaagtttggcttggggtctttcatgaggtttctggtgtgaggtctctcaaaggctgcttctccttacacctgggccaggagtgtttgaacagctagtctggaacaacttggggtcttcaggtatctccctctatctgcatgtggtctctccagctttgggataacctaacttcttacatggtaactgctatagtttgaatgtgtcctttaagttaatgtgttggaaacttaattcccaatgcaacagtgttgagaagtggggtataataagagatgattaggttatgagggctctccccttatgaatggattgatgccattattttggaagtaggttagttattgagagagtaggatgttataaagtgagtttgactccctcttgctctcttgctgtcatcctctcttgaccttctgccttctgccctggaatgacacagtatgaaggccctcaccagatgctggcaccatgatcttggacttcccaccctccattatcataaaccaagtaaatttatgttgttcaaaagtgacacagtcagtggtattgtattatagcaacacaaagcaaactaagatagcaactgaggacttcaaaggtatgtatttcaagagaaaactatatcacattttaagattagcattaggagggctgggtgtggtggctcactcctgtaaccccagcactttgggaggccaaggcaggtggatcacctgaggtcagcagttcgataccagcctggccaaacatggtgaaaccccatctctactaaaaatacagaaaaaaaaaattggtgagcacagtgtcgggcacctgtaatcccggctactcaggaggctgaggcaggagaatcgcttgaacccgggaagtggaggttgcagtgagccgagattgtgccagtgcactacagactgggcaaaaagagggagactctgtctcaaaaaaaaaaaaggttagcattagaagtcaggcagcatcactgctatgacattctcttggccaggcagttgcataggttctcccaagacctcacctcttagtggtggactgttagtatcacattgtgagatgggatgtgttttggtgtagtcatctttgaaaattacaacttgccatagcatatgaacagataacactatacttgggttctctgctatggtgctgtgaaagaacagaagaggagagtgattaacagaagaggtaacattcacatatcatgggccatataatttgatgtatgtaacttgttaaggaaatacgttcaaggcaggggcaacagcagatggaaaggcatgaaagaacaatgagcacaaagtgtttaaaagcttgggttgacaggaacaaagactgagttgtaggagaggtgacaggctaggggcctagacaggggaggtaggacagcatcctgaagggccttgaacatcaagttaaaacgtttggctttggggagcagtcactgtctttagagcacaggcatataaactgatcgtctttggtaatctcttccatctacaatctttctttcctttgatagtaaacatatcatctctgttaaagttgcttcctagcttaaactgaacacagactccaaaccattgaagcactttagatttttttctttttttttttccttttcttttactcaccacaaacaactctagaatggcatgcatttgaacaaaccaaaagtgatttcactcttctaattttcagtgctttttggctaaatgcagagtgagaaattcatacctttttcaagcagtgtgggttctttttcccaatttctgtcatccatctggttctctggaggtcttggaatccaggaaagtgttagttcactgtgctgaaatccaaaaaagactgctaaactgtgaaagaaaatttgcattccagagacactgaaagagttagtccaccacccttttgcaacagcaaggagaaaacatctgtatttcctgcctctttgtctttaagcagttatagaatggaaaaccctatactccctggctgtgcgtttcatacctagttaatctaaatcacttttggcagggtgggggaggaatcaaaacatggaattattttatttctagtgtcagaaaatattacagccaagatactgtttaagggaagcaaattacttcaccagcttccttttgagctcctcatgaggtttaattctcatgaatgggtcctagagccgacatttgacatacacatcagcagtgccctcttcggaagggaaccgcacagtcacagccatgatgttggcatgtctttatggccttcctaagtcatgtgctgtcttttgtcttccattggcagaaatacaattagaaggccttgttctcaacagaagccaaatgattgccaaatctgttcaactgatctctagagaattgaagttagctcatggccctctggctgttctctttgccactcccaggagttataggcttaaagttatccctttcttttgaaagaggatcaagtttggttcaaagaagcttttctatcatccccaggagtacaaagagagcccttccatgaccctagttgtttggctcagaccacttatagcttactgtaatttaggaagtaattgtaattcataaagccaggtagataataaacatcttggcagggttgagtttcaggcagctctgaagggaaccaacatgtgagtggaatggtattgggaacatttctagtctctgcttgcagatcttgattctaatggatgactcaaactggtttaattctgatctgaaatgtgcaggcaggcagtcattactctgtatacacatagctgaaaacatcatcacttaagcatgggttttagacattctcctggatgagttagttacccatggtagacaaatactgtaagtaaaaagagcattctcctaatttctatgttgtgtgattaacttcagatcatttatattcctggagaaatatgtagcactattttttctttaaaagatatattcttgctgaggtagaataaagaacagaaaagttgtaagaggccttagattttaggttatttaatgtcatttaattttgtattcaaccaatacttactgattgcctgttatgtcttaagcgctgccgcagaggctgcaaatgcagtagtgtcttgaacaaactagtgtaagatgaacaataagcatggcagaagcatagtagcaactaaattcatgaagtgatatcatagtgataagcactatgaagaaagcaacaggataaagagacagagtctggctctggagagggggctgctgaaatagtgtggtgatgcaggccatctgaggatagtaatgaaatttgggggatgtctatgggagtagatgctgttggatgaatctttggagtactcccaaatgattgttcattcatttacttactaaaatatttactgagctccttctctgtgccccaggcattgttctggaaactgagggtgatgctttgaacaagacaaagaaccatgccctattgaagcttttgttcagccctcaaatcactccatttcaagggaccaaaagccctattaacttaattcccttattttatagctgacggaatttaggcccagggaggaaatgctttgtacaaaactcactgctggtggctgacgttggcaagactggaatacagcccttgacttctgctttatttctccttgccactgagccatacagagtctctgtaaccatctatgtcagcaattctagtttagtgctggggttggttagcactgtgacccaaagataagtctttttctctatcaaggcctcatgtctactcttaataaaggtaacaaaattgagggttgttaagatggggcttcacaggcgtgggtaccaggggctttgttggaccttgattacggttaagtcaagaaaatggaccttgccaagtataactgccgcaaactagacagagaactgtatgagacttcttattggctcatagacttctctgtacacactctaaatgcatggtatgtaactactccatcacttgataggcattccaggtatgtaaactaaataagatacatggcaagaaaaattacctgctgaagacaaaacaacaaaaacaaaataatctgtatttttccaaactcaatattcaatattcaagggagtatgggtacttgtgtatatattttatacttgtctacttctctccagtaataagaatgatagaagttggctcagttgattagtcagaggctgttgaaccaagatgtagggtcgatccttctgtgtaacagtaattctctccagcgaaaagagctttataacaatatctttatatctatttacattcttaaacagtgcttctcccatttcttataatatttaattctcattgttaagagattgttaaggcagaatacttagtatcccattctatagatgagaaaattgacacccatgtagcttatggaattttgttcaaggtgctgtgaattccagctactctggaaattcactgcctcaatgaaactggtctaaatgttggttaatagcctctatttataggttgctgatagtaggaattatgaaagctggacctaaggcttcctaatgtgaggctttggataggattatctgctctgagctcttagccagaaggcccccatatttatcagtgtgcaacaatcttgttttgacagcgacaaaacccaagtagtgtcacatactcagcttaacaatttttcattggctatgtaagtaattatgttaattttatcatattcttattgttaagtgggacagaacaccagggagatgtgttggtattcaaaaagggacctagtgtggggttgggagaagagcactgcatagaaaccatgccatctgcgtcctggactttttcacaaaatagtatatcacattgggcaaatataccacaataggcaaatcagcttcacaaaatgcagtgtcctagtatgtgaggtgagacagttggacaagatgattcggggaatttttcaagctcaaccaaactatgtatttatgagaggctatgggaaatctgcatgctaaagattattaactgcattctgaataattgcctttatacagaataacggagaaagatatctgagaaacttgttaattggaggacagtgtgaagtagaagaatgagcctttctctttgtactttagaaaacacaggttcaaatcctggctgcatttatagctgtgtgtcatgtaatgcggaaaagaattctaccattctacctcctataccagattgctctggagattagacgggctcctgtttgtgtacatttagtaaactttaaggattgtaccaaatcaaagtatcagttattatttttggtgtataaaggaatataaattacttttatgaagaattaagaaatgtatggatttggggtataataaggtttacacagaagaagagctttttcacaaaattcccaggaaagcagggggaaactcacttagaaatctagaagcccattttatattatgacattatccaattatcccagagtatcatatacacaattccttagataatccatttgttgaaaggacagatataaaatataggagaattaatggtgaagggaaaaaatagaaatacggtgcttcagtgtggtagttacattaaatgatcaaaggatgacaagttaattgaataaatgtcttagccccttgaaatttgtatagggaatttataaaactaacatttattatatagtcaggactgggttctcgctttgataatatgtgaactcatttaaacctcacaacactgcaatgtagacatttcagtctacaaaaaccaaaggccagaaaggtcaagaaaattgcctagcttttcgaacccagatcacctttttcctactgtttcactaattctcttactataatatggcagaccttctttgatgtctgagttaataaatcttcacatgacttatgttgtaaaggcaaaatctatcatttgacttgtctcggaaggaaaggaactcaattcttttctttctctctcaccatagtcttagtcttctctgatatgttcattatgcccatggcatgagggtctgacccacagtcctcagctcttaggccccttccccctgccccacatttttcaaggatcagaacacattcaaaagaagtgttttggaagacctagcatgtcacatgggttatgcattttaaagtaaaatattacctctccgggcattaaggtataaataaactaaatgttctataattgagattttcttttccgatttagtaaagctcagatcacaatcctaaccctagtgcttaagaataaaaaacagggcgtaatttactttgtgaagaatgtgatttttagctcatggcaaaattgaatagaacggcctaattgctgtgatctttttgttctttctgttggctttttccttatggttttagggcatatttctcaattttaaagccagtttatgtagtccaaatacaaacagaaaattttataagaaaattgtttttctaaattttattttgatagtaacacataggttttgtctgtgctagttaaaacatggatgttcggccgggcgtggtggctcatgcttgtaatcccagcactttgggaggccgaggtgggcggatcacctgagctcacgagttcaagaccagcctggccaacatggtgaaaccctgtctctgctaaaaataaaaaattagctgggtgtggtggtgtgtgtcggtagtcccagctactcaagaggctgaggcaggagaatcgcttgaacctcggaggcagaggttgcagtgagccgagatcgcgccactgcactccagcctaggtgacagagtgagactctgtctttaaaaaaaaaaaaaaaaaaaaaaaaaggatgttcatgtctggcaatattgagttccccttcatcagtgctgctcaatacacagatttcgttacaatattcttcctgtgaaatgaatttgtttcagtgcaggcttatctgcgactcctataagagtattagatattaaagactcttgttatagcacaacattaattccaaagtgggttaaaataagttttttttcaagtgccaaatccaatcccaactagaatagattcttaagagtcatagaccaccaccatactgcctgctctctcaccattcataagtaattactctcttctctgcgttcccatcattcattactcgtgcctcaatgatagcaatttgtcatgccctttgcctcgaatcagttgttaatagttgtgtccacctgtctcactgcattgagaacctttgagggcaaggatggcatctttatcttccatctcttcctctgtacctgccaggctgttgaacactttgttccattctttaggctttctgcaatattagagtaagtgaggaggcagctctgctctttagagaggcatataagaagtttgtttaaagagagtttataagaaaactgaggcaatagatgcaaaaagttatgctccaaaagattaacaaaaaaagttgaaattatttcactgaattttcagttctgtgtttcatagctgtcatcttcaggggtaggggggtgtgtcatgacatcaaaaaagtacagtttagagatttgatgctatctattaaattgtttcaaaacgtttcctatctatcaggaaaactttcatctgtaaaagaggaattttgattctaattgaaaaatcacagtcataggggtgggatgctgttaagcttgagattattattttcagtctgtttcaaaacacacattacatgcagatacaaatatagacttagattaagatatagacaaaggacattagaaagaccaagagaaatgttaataaaaagttcatgtctcacaggaaggcagagctgttggaaggttatctagtatagggtcattagaactaccaaggtaaaatgatatcttcacttgcaaagcaaacccaaaagtactgccatcatttgggaagcaatcttgatgaccagaatcaaggtagagaataagtttttattccataattaagttaggcaatagcagtattctgagttcagataatggcactggcatttcaagagaaattggctgagtcatagccctgctcctttactgtaccacattaccattctgttgggaacacctacacttgagctgtacttcccaacctttttcacatcccagttcatgtggaaaatgatggcattcattcagcacacggagtaagtggatgagatctctcctgtcctgttcctgaggcaaccgctcaggaactctggacacctctggtccttccgaatcctcccaaatatggtgcatccggaacccacttgaaacacactgtgtgttaacctgccagttgagaagttctagactggagaattgttttgcatggttaaatagaaaaaaaaaaaacttattttatataaagtacttacctggactttattaattcattaactaactgatatttgtggagcattaattttatgcaagcatactgttgtagatgcttgggatccaacgacgagttttctcttgtcctataggagtttaggagacaaactgtcttaagatcttaacatgttttctctatttatttgcatgtaacttgcagatagcaagcctgaatgtcttctttctatttgaaatacagtgtgtgtctaccgatatacagattccatataatgtgatgtagcagagagagtctccattggacagagaattaggagacctttattgtaactcccaatctgtcactagctgtgttctctatctataccttagtttcttgaatccagcagttggactagaatcatggttttcagatagtacaggttccatcccttcatgcccttcagccagaagtgattttgggctctttaatatgtgctttttttgataaattgtttccctgaagaaaggattatgggtgaatggccaagtaaaagaaggtgaaaattcctgggctagtgtaatctctaaagacttttcaagactgaatgtcttctaactctctctttttttctttttgttcttatctcaacaagacctaaactatctagatcatgagatgtcactccttatctttccaagagtctttcctgtttcacgatattgtttttgtacctaaaaaaggtaaagatgaatataagatcacattttaattttataaaatgaaaatgttgttaacatttccaaatggcagtaatcactttatagtcttctgaatcttcaattacttatgtaaatgaagactgtatatcttgattttaaatactcaaaattgaacacttacatatacctatgtaatatgtaaataatggtaatattcttattctttatcatctcattagtagttcacgtttatgttatctatatgcttcatttatattcatatgattcttcagctcttctgcctgtgagttacaagttatttatacaatatccaaagatagaaaaaaatactaccccattgtatctctgacttaaaaacgttgcatttgggggttttctgtacaaagttgatttgtgatttaattgttagtttcactgagtttttttgtttttagtcacaattgtattgccaacatttcagaaaaatttataagctgtgacttttagcaacagaatctgcttttttctgctactcttacgtcctttcattttaaccatactttcattggagtagcctaaaacatttttttatggaaaaaagtcctcaaacagtgcctgttgcaaaatgaataaaatttggattcttcattcagctttggccaaaggccttccacagctcgttaccaattacttactgtgtgtcatgaactttgtagtccctgggcaaggatgcttactattgtggataccgtagatagagtgtacaataggaataggaagtataagaagtataaggacttcctatactttcccacaggtgttgattgcaaggacacttcttgataactaactgtgtgcaaatctgcttcagaatttgtttcctaggaaacacaacctcagactatggcttcatgggaggagagaggagtgattgcagtttagtcatagaggttgacataaaccactaaatcaagtacattgtgttcagtgtcataggggaagcataatacaatcctatgggagtggaagaagttacttacttttcttggaatacaacagaaaaagatttaggaaagatttttcagaagaggtgacatttgagtttcactttgaagaatgagtaggcattctctaagcaaagtagaatacaagatagtctgggctggtaaaagaatgttgcttattaaagatgtggcagaaagctcagtgtggcagctgggaggaggagtccatgggaccacgatggagctggatcagcagtccagtcacaaagcacgctactgatattgaaggttcataagctggaaggtgctcttttcttttaaatccccagctatcaatgctggcaaccctactagacaaaaaaataaataaataaataaataaaagaaaaaagaaaagaaagaaagaaaaagaaagagagagagagagaaagaaagaaagaaaaagaaaaaagtgatttgaataggcatatttagagacatccctctttcacttatttgcttaaagactttcttttttttcaaaaccgatttatttgtcaaccatttcatgtcatgggttcagatgaatccaatatttgtatgaagcatgcatctttttgtctggctttaaaataatcatctataacacaaaaatatccctctatgatccttacaattttaccattagcaatttctagaattatcagtggaggtgcatagtaaaggtaatatagtccaggtttctagcaaatgaatgcccctttcaaacctctgataaggggttatccagttgtttttgtatatttctgataatgtaaacatgtatctttttctattgttgttaatactgatttatcacagattaatacaattacagagtttgaattaatcatttttcaaatgagaaaactgagatcgaaggaataaattatttacccaatgtcatacagcagattttgacaaagccagaaggataattcatattcttcacctagcaactttcctttttcatggccacataatgaattccttagctccctctctgcattattaggagtcaggtaactggggtaccagtcccacctctgcatctcatgctctccacaactcaggtccagcacatccattctcaaagtctgcctgctcacctgtggaatgagagtctggactaagggaactcccagccccctcctcctgacactgtgagtttttcctttctcgaaggctactggtaggccccactggagactgaaaggggaagattgcagtaaaaggcgcaggctgtcgaaggataacatgtccttctacatcattcactagcctaggatgccagtcaacttcattcttggaacctttattttccaatttgcgggcattttgcaataggctgattttaatcacattttatactttttttcctttgttgcagaaatgtttgtattacctgttctttgaatgcagcatctgtagaccacaaggtctttccataggaactaagcctgttatattgctgctagttttgagtaaatgagctgaatcttgcagccaagcctcagtgcaaacaaaaacattttctggccaaacattttctggttattcaactccattacagggctgactaaaaaaaaaaaaaaaaaagtaaaaacccacagaggagcaaaacacaagtcctgggaagacaatttccagccacattagctcacattgtcagggtagaaaagaaacaggccctcattcttcaaaccatcatcatctccaaactcttaccctgtgctcttctgctattttaatttcaccacttcaaaatgggaaaaacaaataggttaatagtttccatgcgtttagactgtgaccagaggcatacgaagcaatttcagaacctcaggcaaccacagctttgagggaaggatgatgatggatttaccaattcatcttgggatggattccagagttaagggagtcaggccagcactgtgctgccagagtgggatataaacaatattcattcgttcattctttttgtacacattcatctcaggcttatttctatttcagacagtatactgggtgcattataggacagagaaatacattcttaagacatagtctctgcccctaatgaaattaaagtctggtagaggaaatagacataagcacaaataatttaaataaagtgcacactgaaagtattgtaagcaaaccaaataaagtgctcaggaatgggagagaaagaagcaattcattccaagtgggaccattgaggaaggcttcactggggaatggccttctagcctgtaccctgaaaggtcaaaatggcaaattgcgatacatctaggcattagccaaggcacagaagtatgggagtttcacataggtttgaacaagagtgagtggtctgagatgttatgagaaccataaaggggggttggataccatgtaaagaataagctctttttacattgtgaagccattaagattttattatccagaaaggtacttgtatttgatcacatctgtgtttggaaagaaaactggaagtcattggagacaggggcaaggggagtattataagaagagagatacaaagaagccaaatcataggtcattgctataggttagacataaggacactagttacctacgtacagacacttcttgcttcatagccatttatatatcctcatggtaaaagagcagctacccctgaatttccacatcccattcagttctgcatctttctaataagatccacatcccgggtttattcctgattgtaaactcaatgagttaatccagatacctcagttgtaatatagcattttacatgtgaaacgtggttgtttgctaagagcatggaattaaagggcaggatggaaagttaacagccgatctttctgagacctgactcactaactggtgtctcttttaaggggtgctatatatttttaaagcttagaatatttttaaggccagataaatgtgtttcttaattcactttttcaaaccagctcccttgtacattcaacatttctgtcaagagtttgcaaactctaaacttggagatggtgtgtaaatcaaagctttaaatgatcagaagcctaattgattatgctgagttctgatttgggttctgcatttagcatgctctgtctcagtcatctgacaggctattctgtaaaaagtaggggtcttagtgatcgcactatggtctaagtggtcacactatgtctttgataatgaatcaagttttagaagtaatagtgaagcattcctcaatcggtgaaccagagtggtatagttcaagggtcaacaaactatgcccatgggtcaaatccagcccattgtctgttttttttttgtaaataaagtattactggaacacaagcatgcccatatgcttgcatgctatgactgctttccagctataatagcaaagttgacttgttacaacaaagccagaaatatttactatatgggactttagagaaaagtttgccatcacccatgctgtaggaaacaagggaaggaacaaggatagcagtcagaaaacacatgtcctcagttctggacttgccacctactacctgagtaatactagaaaagccacttgacccatctaattgtgtttccttctctctataacacacttctttggccagtttgttagttaattggccgataacacttgttttctatttgtaaggactgtattaaagctgtagatgtggtttgtaaatggtgataaatgccttccttagagtggtgtgataaggacctgagacaatctgttttgtaaagatgcctgtcatgcagtatggacccccttctgtcccagtctgacgtggtttctgtttccttccccagaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagtaggcaacctactctctcgtcaccaccctgccagtccttttggagtctgttcttactgcttggcatctgggcatacattcttctctctcagaactacagaatttcaggatttagtgaggcttttaaaagagcttattgatcccctcctccaatgcaagaattaatatcagacaatccatgcagtcatccagcctggtctctgtgtcaaggcttccccagagcttgtccattgcatctctgggtaattctaatgacgaaaaagctggctcagctatagtgtgtatgtgttagaaagaaacaggatcctggcctaaatatgaacaaaatttgtgacatttggcattgttcaacttatttgagctcttcagtttggtctttagatcaaaccctctctaaagctctctcagctgtgatgacccagagttttctcaagagctaatctgtgcatccctgccactctactgatagggagttatggtggacagacacagagaaccattcagtttcttttactaatgcaagcctctcacatattcaaaggcagtttcatgccattgtcaacatattgatgccattccctagccttttcttccacccaagtcttctctttctcaagttattttttaatagaattaatgaatgcaaattgtgtgttcttttgaggaggattaaaaaatggtgcctcaagatcaaggccagttattcatgggcccaaaataatctgtccccactacttcatttatctcctttttaggtccttctttcctgtattacagctggggtctttatgaaaattaagaaatttaaacagttttgtattgtgcttatttttatttgaccagtttgttacttaattattcaataacattcattttatatatatgtttatatatatacataataatatgtaaatatatttttatatattttatatataaatatatttatttatatacatgtatattattattgttattattttttagacaaagtctcactctgctgcccaggctggagtgcagtagtgcaatctcagctcactgcaacctctgcctcctgactcaagcaattctcctacttcagcctcccaaggagctgagactacaggcatgcaccaccatgcccagctaatgtttgtatttttagtagagatggggtttcgccatgttggccaggctggtctcaaactcctgtcctcaagtgacccacctgcctcagcctcccaaagagctggtattacaggcatgaaccactgtgcccagccaacgtttggtttatatttttaagaactgtactaaacctatagatatgatctgtaaatggtggactcaggtttctgtatgtgtttgctgggcagtggctttgaagacagcctttgaggctatcaaagagatgaagcttgtattgctcaccaggttgggtatccattctatggcttccaagtgtgaagtcttctgggttaattctcaccactgtgttgattgtcaacagccaggaagcacttaccccaaggagtttggagatctgagactcatattttaagaatgaatgtcctaaccactttccaagtagcaaagaaagtgaaaacctcaccaaaagacgtgaggttgaatgaattaaaaaatcccagaggcggaaatttgcaacctgaattagacaaggaaggactcacttttaaagggcagtcacagcataaattgtgcttcacattattgatatttttagcttgtaattacacattgaaaaatccctgcgtcttaagggaagtgaaaagatctcaatggggagtatgttctgttactgtttctctcctttcttagacttatcctaatccaagaaagactgatacttataatcggagcacacatgtttctgtggctagaaaagactgatacattacacccctcaattaaaacaggaaatcaattttgacaaatgccaatttatatctatgccatttatctttcatgtctaggggtagggagcataattagagactggtgactgatgacatcagtttgtgggtctgaaagctcccaaaaagcagacttgagcaactaaaagggggaaaaaaattaaaacccccagataaccttccccactcgttcaatgcatgttaaaacataaattaaaaatgataataatgttgtcttcatgattggcaggtatgtagggagagaagttttttgatcctttctccatttcctaaaggaaaataagaaactgttttatggaactcttatttataagccttaaaattactagaatacaaagcagctaaaagtccagcataggctaatcactgaaagaccaaagagagggcagacaaagggatattcctcctccagacagtttttggggccttgtttgtggtccttttgaatgggtctccttttgtggacctttagaaaatgcatgttaattcagttcaactcacatttataaagaaccctctgtgtgccaattgttgcattaaatgctgaaggagagagatacaaggagagaaattgtgcagatatatatagagaagtcactgtcagcaaggagcttgccaggaggagggcagagaaagtgtgcagacagggagaaagggctgaactccatgagacaggcacaggtaagggcttgcactgtcaaagtcagatcacctggctctgtggtcagaataggctttgtggacggagaatgtcaagagtgttttaagtgggaaacaaggagattcctggcagagggaacaactcaggcaaaaagcagaggcacagagttagtaaagggttctctgtgttcagggagatttgctttgctgtaactagagcagcctgggagtagagattaccttgagatacaggagacccataagaagggatttacctcacctgcttagcctgccttttatttatttatttgtttattttatttatttattttgagatggagtctcactcttgtcacccaggctggaatgcagtggcacaatctcagctcactgcaacctctgcctcccatgttcaagcaattctcctgcctcagcctcccaagtagcttggattacgggcacccaccaccatgcctggctaatttttatatttttagtacagacaaggtttcaccatgttggccaggctggtcttgaactcttgacctcaggtgatccacccgcctaggcctcccaaagtgctgggattacaggcgtgagccactgcacccagccttagtctgcgttttaaaccagtgcttcccaaactttaatgtgcctgtaatccacagagggatcttgttaaactttggattttaattcaggtctggagtggggcctaagattctggatttctgtcaagctcccaggtgcccatggcctgcactttgtgtaacaaggttctggaatactgtttttgagaacttgttaatggaccatcctctacataaacacctttggtcaatgttgactcatatcctccagcctactggacatgcaatctttcacatatgtcatttcagatgaccgctgcaaccactgcagtcttctggaagactatctcccctaccctaacacacacgtacacattttctcatttcacctaaatggttatctttaaaggcccaactcaattaccgtttcctggaagaaaacttctctgatctccacccctcccttttctcaagtttagatttacatcttaatctctgtgttttatagagttttataagtctgctgtagatagcacttaccacagtctgactggtatagaaatatacatatgtgtgtgtgtgtatatacatatgtgtgtttgtgtatatatatatataactttacaataatcatcttgtatcatttttgcaataaggatttgtatatataaattaatagaaatactgcagaaatatatagaactccttctcaggtctgtactggaagtcgttgcttattcttgtattcccagtgagaaaacccagaaaagcagatttctttaactgactctttgcatgtatggaggctttattcccctatctgtgctttcttatcaggaatattaccctcattcatttatgtatttaatcagcatccattagttgattgccagaaatgtgccggaatacaagatgaccaagatcatccctctctgagccttcgctctgttggctgtaaagtagaaatgataaaaatacttcctcataatgttgctgtcagtagaaaattacgtcaagtgtgtacagcacttaacagggcttggcacataataagcactcaataaatggtagctttaatcatcgaaagttgttttcatcaaatttacttttacgattattgtccactcagtgagctaagccttgaaatagaccacctgggattgtgagccctcctcgaattgctatcggaggaacactgtggggactatgagaaccacctcctgcctcttcgctttggtttttctcattatggaaatgaggccaattggtaggaaagaatcattactcagcaagaatacagtttatgtcttcccaaagaggaagaaccttgagattgaacataaagcccaactaatatctttttttatacagaaatatggcagattcatttcattagatacagcccaactttttttttctgcaccagtcacagtggttgttcctggagactcagagatggagcaaagtcctatcttgtggaaacttagagtttagtgccccataaatatatccaaataattactaccaaaatggataaattcaatgacagaattcttatcttagaggagtaaataattctatttggggaaattggagaaggcttatggatacactgaaaaggaaaacatacttctgctcccacagagtttggggaaaggaaattttgcagttgatcccagaagcctacttatttcaccactgatgacccagatttaaaaataatctggtagtccaaagcaattttttgccactgaatataaacttcttgcataaaataccaattataacaactctgattactgctgcagtggtaccatgatccttctaacttttctttcacagcaatcaattgatctgctgcttaattcatatttatttagattgcagccatacagatgctttttgggtgctgccaggaaaattaattacctacatatagaatataatgtatgtagaaatgctttgacaaccgtaacgtgctctgcaaagagttagattattatcattatttctttttaagtctcactacaaatagataaatttttaacatcgtttatcttaaaaccagtaccatgaaaaaactgagtcacagtctgtttttctttttttaaatctcttcagttcttatccaggtccatttcaaataatatgtcatttcataccttcacaaataccatctccaatttccagaagatacagagagatacatggcttatattttcagccaattaacctgtcatagaaaaaaaattgttaggtaccattgatcatattgagaaatactaagaaattaataagtattaaaagtatttaccagcagcctcaaaaacatatgcatatgcatatttatatgtatatgtatgtgtatgtgtgttagtatacactcaccctttaacagtgctaaaatcctttaaagaataaagaatttgatagctctttaacttttaatttttaagcaaaagtttaacacaataaaaaatgtaggaaatgcagacttggccatttttaagttttgtgtaatgtatatttaaacgcactaacctctgcccttttgaaaagctatgtatttgagtcttcttatgtcagttcctagaagtcaaggcaaatttccaagaaagaagctctaaaaggtgggaacaaggcaaagataccaacctcagactatttttctaggacctaaggagtgcatacaaaagtctagaaacaaaagtcagaaacaaataggggctggacaggactttgttctctcctccagttagcctatcccaagcacagggtttgcattcagaatctatctaaagatgaatttcataccgcgcaccatgcaggaaagagatgctagatgctcttcatgcccaagcaattcacacgctcactctctcacctcgccaaatatcacaatatttaccaccgattgatggaagaacctccacagtccctgagtctaactccctcaccttacggatgaggaagcaggtataccgactctcagtttccaccttttccttttacctctgcgtcccacctcagtgtcgacgcgcagtatctaaccagaactctctcttcactttcaggaaatttgccccgcgatgttctgtgtgcaaggagcctattatgccagccccgggccaggaggagactgtccgtattgtggctttggatcgagatttccatgttcactgctaccgatgcgaggtctggttgacagccctgccctgccagtctgtggcaggcgttgaaaggctcgttcgagctaggtttacatagatgtagcaattactaaatctcagaacggccttagtgcctgtactcataggacttgggttttagatttgacactagtattccgagcacatgctgttgaataagtcactgtacctctctcagtctgcttgctcaccggaagaaaggactcaagtccttaactcctccaaatatggctgtgagagtgaaatacaaaattgtatattaaaggacattgtaaattgtgaaatactaaattagtgagaaatggtgttattgaacatttaactttggctctgaggctttggttagaacttcttgttcagagtcatggagatttatttatttgttagcatgcactactaattgctcagtttcctgaacgcctctagagctgcagtatatctgcatgttcttttcagtaaagccaaacttcccgcagagtataaccattgctgctattgtgttctggataccccgttaacttaaatttcattctatgtcaaatgaagacatgaactccattgacctccttgccaccatggtagatagcagaggcgaggttcatagctgttgtggcctttgagagtttatactaaagttagcaaacacacacctcttgatgaagtactatgtatttattttccaaagaaacttctattttctccaaagacaaaggccagcatttaactgttatataacacttttcaaaatggaccctaagaggagctgtcagcggtagtatattcctttacagttatgcagttctttgcatttttttttttgatccattatcttctttgatcctcttaacagcttggtaaggtagaaaaggcagaagttattttcagagtggcagtcggcctgtgtgcattgaggcagactgtagcaaaactgtgggtggtgctcaggaggcctgtcccctggactagcaatctttgctctccacaatgctgtctcctttagaaagtacagcaaaccactactccccacaaactttaggattttattttcttactgcagttgaagtaaatacaccgaacccactggtggcccttctgcttggcagacatcagtctacctttgctctaggccagaaatggccaaaacattccattcctgtacctgtgcatgcattttgagagatccttaaactaatggtaaagggtaaaaaatgcatcggtggttagggacattcttattttctcttgttgagtgggggcagcaaacttctacatgggagccaagatgggtggcctcttctcttcttatacctgtatttcatatcaagtgagcttaggaggattatatttatgtccatttatatttatgtccccaatctctaattcaattacattcaagatatactatgttatatattgggagaaaggatacaggggattagcagaatgtaaagcaggaaggatagtaagtggccacattatggaggccttgaatagaaagctcaatcatgatgttctccacatgtgtacttaacgtttttacttatgtcgtttccatctgtctttactgttctaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcattattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtttcatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaaaaattataattttaatgatggcattttattttattccattgcagcttgataactttccttatagcaaaggaataactattgtattttcagaattttaacacagattaacacttagcctgtaagactaataatatattgtaatagttgatactaaaatatttttcagcaggttggacagcaccagtttttcttagatcacagactacaggcagaatttcccttcaatccagaaaaaaggacactaatttccttttctatttaattttcctggcccttgtgcaaaaaattgtggactctatcttagttacaacatgcatgtcccttattttgtggagagctgtgtgaaagatgcgttttttttctttttttcttttttttttttt

SEQ ID NO: 12506 - DNA, 19728 bp, Human
ctggaatgttgattttaatgtgttgatttttaaaaactttttattcaagtataatagtcatacaaacaagtgcctgcatcataaatgttcagcttgctgcatccttacaaaatgagcacacctgtataaccagcatgcgtgattaaatttaaagcataatttacatttccaacaaaacagacattagtactgggccagattcagaggacttttgagatcaagcaggcgacttggaatagtaaggctccgggactgagctgatgcagagtttaggggccctggattgagacgagaaagcagggggaggggtgcagcactgaggtctggggttcgggagggggccctatacgcgggaggaaacggagagagacggtgaggattgccttcggaggtgggtgaggcccagcgtgcgcgcccaggtaagcaggtaagaatgcagcagccgccaggcccaggcgcgggcgcgtcccgtccgggtgactcagcccgtgccaggaagcgggagttggctcagctctccagagctcccggacagcagccggatcccggccggctcctggggcactaggacagacccccgcggctagcagcccggcctggggggcggaacactctcttcttgtcccgccccaccttcctccgggccgcaaccaccccagcccatcgctgggacgtggccgcgggtgccgagagcgctgccggcgccgtgggggccatcccggtcctggccccgacggcgccccaggacctgcgatagccgtaagtagcgactatgggggctaggagagtccaagaagtggggagctgggacgcccggcctcctgcgtcccagctctccacttccagacccggctggactcgggactagaaaaggtggcctggtgccgccgctgccttccagtgtgctcactggccctcgtggcggggagcccagacgcggctcctaggcggccctagacaagtacggccgagacgctgtcaccccagggggctgccccacctgagcatcatcccacgggcccgcccagccccacctggagagccgcaggctccaaagtcttccccattctcggggaccaggttccggggtcgcgctgagggcccctgaaccctcttggactgcctggcagcggcttcttcctaccaccacggctcaccatccagacgcgccgcccggctggccccaccgggagaggctccctccctcccctttctccccgaaccctcatcttagaagccctcggattcagtctggatcccaaagaagggctgaattcggaggacctctctttgcccccaaagtcggttttctgacacacattcccacgcacagctggtaggggcaggagggtcgaggatgctctgggctgctgcggcacagggcaggctggttggtcactaaccggatttcccggacagacaactctggcgctgtgggcgggtggcctgggagcccagatccctgtccctggcttaggaccccgggaggagaccgagggggtgggtaaaacgtgactgagaaacttgatcgcgcccatctttggggcaaagagatttggaggccgcaattattcagacagttccacgaagtggttgaggtttctctctttctcctgattttccagaaacttttgcagagtttggacaggcaaaggaaaacgtgcagcccgcggatctccgggcctcagagagcagggagtcggggagactgaggccccgctccgagagcgcggaggaagcgcgcccagccggcttcctgtgggggctcgggcctcgggcgccccgcggacagacgtgtccggctcctggctgggccaagcccggcgcgggggaggggacccgcagaggggcgactgagaaggcgaggagggggcggggagagggtgggccagggaagaggggaggggagaggcgagtaggggaggagcgaggggggctggagggagagaaggaagaaggaaggggcgaacggcgtgagctggcgccgaaatgggagaaagcagcgagtgagaggggaaggggcgccaggcgagcacccgggagccagcgggacctgggcaggggcgcccggagcaggcgcgcatggcgggccccgcgcggggatccggctggaagagagcgtagcacggctcgcacgagtgagtggacgtgggaggcgcgcatctgcgggggaatcgccccttgcccgcctccggcgccgcccgctgagccctgttttccgcaggtccggggccgatgtaccaggtgagcggccagcgcccctctggctgcgacgcgccctatggagcccccagcgcagccccgggcccaggtaggaccgggagtggcgagcgaagctggacaggggcgggtgggcggctgaaggggccagttattagttctcctctccgtccccagacgcggggagaccgttccagggagcttggtgggggtagggacgaaaagtctgggtttgaggacttggtccaaggagagtagggggctgggcgagggaggcagggccctgaacagaggctgcggctgcgccaagttggctccaactccccgcaactcccgacaccagacacacacacacacacacacaaacacacacacatacactccgcggtgtctgtccgtctgggatttgtgtctcaactgtttctgcccagtgtgtaaatatttgtgggggcctggtgtgggggagggggcgttgtctgaatctttctctacttcccttcccccagcccaaccagagcccagcgcttcccgaaaacttttgtctgccgcgagcggctgcaggacccagcccctcccctctttcttgccatcccttctccctcgccttccttccctctcgtgccggccagtccccgccgcccctgccctgtgcacacacacgcaccccaacccagtgtcttcagcccaagtgaaatgccccgtcccgcgcctggcgccgtctgtaacctacccgcgattcctgggggagcctctcacgccaagtacggtttgtgactccctgaaggggtttggagtaggggcctcgccggccctggttctcagtcccttcccctcactggccagatgcctaagccgaagctcccaaatggaagtccgggtcaaggagaagtcaggaacctctgggatgtgttcagggccaggggaaccgcgtgcaggagtgtggacccggatttcataattggaatctccactgtctaagtcgttgccttcctccccaccagcgccattccccctttcccctctttgactctgaataatgaaggtctgttcctgaacctctgacacgaactccctgccttgccttggacaagctccttcccttctctggcctgagcctccacatgcgccctcgaagccggcctgcctgcctgttctaggaggcccctctccactccccacctacttggtatggacgcctagttgtggaggtggggggtcctctaaaccagagtgaggacaagtggaagatgtctggccaacagccagcacatagatgaggccagtgtgtctacagcccatcttggccaagcctcaaattgcctgctgtctctgtggggcccctgcaacggggccttctgcaggatgagcgcctccaagaattggactccttcagcccggagggacagctgggggcagggcacttggaagggtccttctctgtgtctgggaaccttccctgtcccgctgggcctccttcctgcctcctcccttcctcagcctcctgctctcccatcctcttactctctccagctttctccctccccttatccattttctctgctctccctccactacctccttccaagatccccttccttgttgaagccattctcagctccagcagcaagaggagagggctaactgcacacaaccggggccagcgtgggcaactgggagggttaagctctgggctgtaacttgaggccccccagcaccccagcagaccccctccccagcctgggctgggccagacaatgcggctttcataactcaaggcttcgctctgccaccgccttgggagaatgagcctgctgcccaggaagcccaaaccgcaggagacccagccaaaaccccacagatgcctgaatttgagaccagaatcccccacgctttactccctgagtgctgacagaacagcaaggccacagcgctgccccaggggctctgctggcaggacagccagggagcaagtcggcctcctccctcagccaccccagatgcagacagggcacaaggggactcagggcagatctggtaggggcaggtggccaagcccccacacccttggctctcctagtggcctcctccccacccacccctgagagccccgggagcctggctccctagcccacaggcacatttttgcccagcattggggcgtcacattcctgttcatggttctaaattgaatttcctggggatttggaaccttcagacctaaaataaaaccaacttgtcccagactaactggccagctcaggccctctttagttttcagcttggtggcctgggagtgtgaccattggattcgcatcaaccatgtgtgcatcaaaggagtccaccctctctgactttcttggggttcaggtccaggtgccacccctagtcttcatttctttctctttctccttcccctgacaggggcattccaaactccagaaagtactccccagtaggcatttgccgagtgccccctggggatgcagagatgaatatggacaccactccaagggagtgagttgggagggctgtagtctggttgagaagccgggatttcactagcaaattgtaattaacaagagggaacactggagctaaattcttagcaactgggtcagagaaagctgtctagaggaagaggtgaagtttgagcttggtccaggatgagttgggtttggagagtgggaggggtaggatcttctggtcaacaggaataatataagcatgggtggactggtcagaagatccggcaatggcccagaccatggggaggccggtctgcgtggaacacaggatcctggtacattgatagattgaaggtccggactgaggccttgaatgccaagccaaggaaagattgaggtgtggggttccagccaccactctctgaccatatgaggttctggccttccctctccagagacggtcagagttccaagtgggaagcccagatccacggtccacaaagacaatgacgagggctaaacttaaggcagtaggccgtggagctctggaacacaggcctctctccacaccagccagggattttttggctgaaactcccatgggcactgtgcaggcttgaaaccatcccaccggaaagaggttcccccctactccctgttggtccaggaccacccctcaacttggtggatggcaagcagagagaacccacagagtccttgctgagggtgtgagtctcggcctttcctcttgggctcatggatttaaacatggctctcccactcccatctggggcgtctttccagagctccaggcatttaccagaatcttaccccatgttaggaatgagagtgtattgaagcaaaggggctgttgcctttccgtatctcccctttgtagatagccacccttgagaggaggagtacagggctgggggcttctgctcggagccagcatgtgtggcacccggtgcagattagaaaaaggaacccccttggtcagatggagcaggtgcgcagttgggtgagcagatggcacctactaggagggcaaggacttcagccacatccgctcacccccttggcaggcaccttctgcagtacatgaattgcacatccacacggggggcctccttcacctttgctggccacccccttgcctcctgcccaccccacacttccaccctccagaagtttctcccctgagatgttctcccctctgtggctggacagcggtgtctcttggttacagaatggcaaagtgggctcttggcgcctctgccccatctgttccaagcaggagctgcttctcagtccacacctaggggtctgggccacccgggcagtgtctcctctgcagaccaggtcttcctgcagctgcttcttccttttccttctgcttccctgtctctggatatctggcacagctccctcttctgccctccgtgctggtttgctgggtcccctctgtggcccctcctggctccagaggttctctgtccctctgtgtgtctccaggtcaggattattggacttggttttctttccttcctcatttttcctccacggtctgatgcctggtaggctttctgtgggatgggcctcctcgggccttggtctgcactctgtaatttcctgttcccaccagatccaaggtcaccagccctgtaggtgactgtcaggagaggctgcccagagagcagagacactttgggtaaggcaggtggagatgtgaactccaggctccttaaaccctcttccttgccttcctccctctctaacactgcggggaggagggggagcagggcagggagcagaagtcctggctctctctaccataggactcacagtgtcacctctgtgagccctggtgacctcagcaggaagcctgggaaatgaccacaaggcctgtcatgccctgctatcattctaggcttcccagcctcaacaccaccccgcagcatgtggcttccttgctctctgtgtagcggctcactcgggggtcttgattcctgctgctcttctcaaaactccccctctgtactgctgattggtcaagactcagtgtgagtactgcctgccccaggaagcctgcttgacacactcagccatctgggctaggtgcccgtcttctgtgcttccaccattcttccagatgccccagtgtaactcttgcacctctgggtatgtaagagccaccagcccacctctcccctaaccgagaactccgaggcagtgagctggtctttctcactcgggtatacccaatacttgtcatattgctgggtgcctcgtaggtgcttaataaatgttaaaccacacagcacaggaaggagggaaggagggaaggagggaaggaaggaaggaaggaaggaaggaaggagggagggagggagggagggagggaaggagggaaggaaggaaggggaaaggtcagaagccaaactactcattaaaaaaaaaagagagagagaaaggagggaggaaggaaagaagagaggaagggaaggagggaagagtagtagggctgtgggtgaaaggctcgtgaacaaccccctgatgagcattttctttcctccttgaaaccctgtggcatgagattaggactgcaaagtaacccaaccctttccatgcaaagtaacccaactctgataatttgccaggctggtaactggtgaatgtagggcttggatcttctgcttctcactcaggtctttctgtctcattacaccctgtgggagagtcaggtcccccagttcagggcccagggccatagcaaggtgcctctgggggccagggtccggagctaggcaggcccctggtttcctggaaattaggaccctgagcctcccttttcatggcaacttggtcttagccttcaagagccatatctgagctggtgtagaccgggctcagggctaggagaggcaccatctagcaccagcgtctccacttgcctgctcctccttgtccaaatcctctgatcgtccaaaagctatttgatttcccaatgattaacccagctaagaggggagctctcaacaggcccaaagagcagatggagctgaaaggaacccacccctgcctccgtggagccatgggccccgggaagggttcccagcacataactctcctgccctgcacaaatcctaggagcgccagccctccctccccattgccccagctcctgtctccaggcaagccctgtggtttttccctgggcaggtgagagcatgcctgctgggcctgccgccctctgtgcttcccacatggggcctctggggcgtccattcccctggctgtgggggaccagaccccttggaacaagggtcatgagggtcactgagggtcatggccacagaaggctgtgctctgggcccagggaggcagctgggccacaggatcttctcctcagcatgcttccaactcccatcccccaggcctgcatgcccaagcctccactgatccctctaattacctccctcctctcttctttgatctctcatctccctctctttgcctctctcccccacccccactctctccctctctgtgtcaacccctcactattctctgtgattgattccatttcaattcccaagactaccctgtgtctctctgtgtctctgtctctgcatgtgcctctttctggtctctctgtggggtgtgtactctttgggcttccctgctgtttctcatcatctccctgtctgcccgtgtccccctctgtgtcactctgcctctccccgtgtccccctctgtgtcaccctgcctctccttgtgtccccctctgtgtcaccctgcctctccctgcgctcttttggcctctgcatctctgagtctcttgtttctgtgtctccttgctccttctcccaacatgatatttggggagggggcaggtggaaggccaccctctttagacccctgtccttccaactaactgcataggctgaggtctgatgagaggcccaggctgcaccctacaccctttcattgccacagcctgggcccgcccctgacccctggctgagtgtgtggacgctcggacccctttcttcctccctccctcacctcccatcccccatcccttttccccctgagcctaggggccctagtcctgcaggctggggagctgtgggtttgaaggtggctccatttctgcctcctgccgcccctgcacagagccactgtaattacatgtggctgcggttcacctcttccccagtgctccggccggctccttgtcctcctcctgactgtagcccctccctgctcctcacccccaggttcctctgactcctctatcatcatcctctctgacccagtttctcccgtctccctccgcgctctgtatcacacagtgctaccttctctgtcgcctctgcccctgccccatctctatctttctctccattactgacttccgtgctattgctgcgtctcactcccgtctcaggctgtctgtcactgggtcactgtggatcccttttccgtgcccaatctctcgcagtccgatgctctatctccctttacctctacctctcactgtccctttgattctccctgtcactctcgatgcctgtccctatctctccgttgctgaccgtccgtctgttctcccgtgttgtgtttctgcctcctctccctacttctctttatattctgccatctctgcccctcccgacaccacatgcacacgtgcacacactcaaatgcatgcacacccttgctcactcccagattgtggtttgggagctttctattttggagcccggtgctgttgtcagctagagtaagggctgcataactgatgcagacagacaaagaatgagggttcggtgggcatgctgggctgtggggcggggcccacggctgggcaaacaggaaggccccaggaaaatggacctcagtcatctgcttttttcctagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgtgagtcctagggggccaggaggttggatggcaacatgtagggttgcactagggaactcaacccaaatgggtcggcaaaaatgggtgcacccgcttggccagaaccttgagtgtggcagcacaggcagcagaaaggggaagggcactgtcactgtgctttctgtcaaggggaagacctccactgcaaagtgactaggaagcagggagtgtgggcaggctccaggcaaaatggctcaggacagagagcatgcggctacctggagagaggcaccccctgcctcaggaagagagctacggggctggggtccggcagggagccagggcctgatgcatctccatccttccgggaatcagggataaaaggaagaagcccccagttgctctagggcgaaaggaacaaaattcagctccattcccaggcctggctcgagttctccaaggaggtcctggggggagggagagaattttccaccttcaccctcaagaacaggagaagcaacagctgggatcattttataactaacgaagatttgcccacatctttagacacatttttactttccaactttctttccctgagtgggctcacttgctctcctaatcagcctgcaatgaggcagcaggatggctactgcgaagcccattttagagatgaggaaacaggcacagagaacggcccaccctggtcccaagctgggaaactcaggtctcccggcccaacactctttgcagtgcctgcctgcatgcccagctggcatggctgagctggaagcctcctccagccagggcatctggggctaagctggactccctggaagtcaggcttactaatcccactagtgcacggccctcggtctcctccagcacacccactagcagaattgagagaaagaggtcagcgccttggcagtggaggagggggtctggtgggaatgggacagacactcctgtgtctgtgagccctgagtgtttgctctgtgactcagcccccacggccatggccacagacaagctctgtgtctgtccacgtcgcccagatccttcagctcaccacacactcccgccctctggtcagtgtgcccatgtttcggcagaagggcaaggggcaccgaagctggccaaggacttggcccagtcaccctgtgtggggccaagaggtgggggcctgatgattcaggcctggccactaaccatagccttaaccctgtttatccagatgcaggcatcagccacacctcttgctggaggctcccagcatggagcctctccagaaccctgcttcccaccctcccccgatcccccaccttgtcctcagctcctttctcccaatcttcatgccctccccactccacttcccagctagaggacctttggcaagttttcccctctctgggcctctgttttctcatctgtgaaatggggccagtagtagatctattgcgatgcctaaagaagctgctccacctactcacgcctgtaatcccagcactctgggaggctgaggcgggcggatcacgaggtcaggagatcgagaccatcctggctaacacggtgaaaccccatccctactaaaaaatacaaaaaattagccgggcgtggtggcgggcgcatgtagtccctagctactcgggaggctgaggcaggagaatggtgtgaacccgggaggcggatgttgcagggagccgggattgcgccactgcactctggcctgggcacggagctagactccgtctcaaaaaaaaaaaaaaaaaaaaaaaagaagctgctccacctaaagcttctagcactgtgcctggtacataacaccagttatgagggtagtgattgtcgtggtagtagcagcttattcctcagtcgcttgtctcccagcctctgcccccatgctggcctctgccctctgagccccagctcctaatctctaacacttgctagctgtgtgaccttgggcaacttactgtacctctctgacacttgctagctatgtgaccttgggcaacttactgtacctctacctctccgggactcagtttcctcatcagtaaaagaagactagcaatactgaggggatgcgtgagcagcaagtacttagaagggctggcgtgcaggaagcaggcagtgtgcaatgttgtgactgctgccgtcactggaagacccggcctcttcagccaagggaggcaccgaggccaccctcccctctccttgggctccagggcccccaagacatctcctacacaattcacatacacagaccaggcctggagggagatggggatccagatcccagctcctgagggactgaagtgccccccacatttacagagggtccttgaggccacagggtcctgcccaggagtcaggacccctgcacagctgaggggccccagagctctcagtgacccctcttcagtccctccgcactccccccaccatacacacctcccctcatctcttgagagcagaactgagccagctggttctcacccagaactgaacatccctgagcgaggagcaggaaggaattcggggtttggggggtctccagggtcaccttgcctgtactccattgataaagctgaagtctggtccctcagcctgcaatggggacccgggggtcctggcttcaggggtctccccactgcccttcttcttgccttcttccctccctcctctcccagacccctctgccagctgcccatagaggcaggatggggttgagggtgcggagggcagaggcttgagtggaggcaccaggtggaaggagcaggaggtagaggggctgcagtgaggagcccctggattccagagccaggcgttcatctccaaacagatgtttccaataaatcacccagtgcgccaagggcaataacagctgggggcttggcagaggccgaggtgaagattaacttcttcactgctgcgctcccaaccccagccaaaccacccctcttccccagcactgccactgccaccactctgccaaaaccccaggatgacaagagcaggagaatggactttgtgtgaggaacaaaggagaggtccagggctccgagcccctgcccttatacatctgtcatttctggactgagcactgaactgagagtcaggagctaggcccaactcaatttcatggcgtggctctggactagtcatttcttctctctgggcctcagtttccccatctgcaggatacaggtctggctgggtgctttggggtatatgtaagaatgcagcaggcaggattcgagcatagctctgggggccgaatgacccccacccttttcccatcacactttctcttcatctctccaggccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaaggtaagcacccatcccatctctccctgggagaggcctccaaagccgggttcctcgaagcatgacgcatgggcccactggagcaccttcaccaggctgttacttagagatgcaggatctcagcctccttccacgcctactggattggaatctctggtggagcttaacaagccctgcagggaacctgacgcatgaccaaatcttagaaccttgcaaagtacacccgttgggtaaaggtgtacctgccttctcaaggccacctccccaccccaccccaaacccctccccatcccttctttcccagagttgctgtgacaaggaacggagccacctgggttgatccatcttaagccactctgtttctggaaacagaaattttctgttaagggaggaaaaaagaacatgtagcagaataaaatggtgccagggcagggctgcaaggtgcagtaggaggtcagaggatccagacacccagccagccgatgtgcctacaacacaaagatcctctgcagggccacaggggcagccagtcccctcctcatcagccatcaattgaacatggccaacagctgcctgagctcagtgatggcctgacctttacctcagaatgttccagtgattcctgtccatgtgaagggaccctggcctgggcatctgcaaaacacacttgcacataacatgctcagaaaccttcccactctgcaaagcagattctgcccaacagtctttttccttttttttttttttttttgagatggagtcttgctctgtcgcccaggctggagcgcagtggcgcaatcttggctcactgcaacctccttctcccgggttcaagcgattcttctgtctcagcctcctgagtagctggaactacaggcgcgtcccaccacgcccagctaatttttgtatttttagtagagacaggatttcgccatattggccagcttggtctcgaactcctgacctcaggtgatccacccgcctcggcctcccaaagttctgggattaccggcgtgagccaccaagcccagtcccaacagtcttatttatgaaggagccatttattcatttaaaatgtcctggccaggcacgttggctcacttctgtaatcccagccctttgggatccaccgaggcaggtggatcacctgaggtcaggagttcaagaccagccttgtctaaatggtgaaaccctgtctctactaaaaatacaaaaaattagccaggcgtggcggtgggcgcctgtaatcccagctactccggaggcggaggttgcagtgagccaagatcgtgcccgagattgcactccagcctgggcaacaagagcaaaactttgtctcaaagaaaaataaaatgaaatgtcctaggcacctgctatgtgctggaaacctggttcatgacctcataaagctctcatgagagacgtagataggtaatcgccatacgatgtgataagtgcaatgataaactcacgcagaggattacgcaaacacagggggaccactcacaccagcccagaaatctggggagggaatcctgggaaggcttggaggtgatgtctgaacatgccttaaaagaccagaaggaggctccagccaggagagcatgcgcacagagctgagaaatggccagtgtggctggagggtgaactgccaaaggtgagactcctggcaggcaggggtcctgggaggtccttaccaaccaggcagtaagcctagactatctggagagcagtagggagccactgaagggttttaaacaaggtggtcacctcattagatttacatttgaagataactaccctatccagtttggagagagatcacaagaccctagttccctccacacaggaatgcaggagaacagggttagaccctccacagcacagtgaacctcccagggggccccctggccaggagagctgcacgctttgccccatggcctggccccagcacacggagggctgcaggacgtgggttctagagccagcagcctggattcaagtcccagctccaccacctcccagctggtgcccagcgcagcttcatgcatttctattctattcactgagcacctctatgtgtctggcgctgttctagggacttgtaatctttcattgaacaaaatgggcaaagatgcctgccctgctggagcttacatatccggtagaaggagatgacaatgaatatgaggaaaccgtgtagtacagtgggaggcgatgtcctctgagggaagaagaaggcagtcaggtagggccgggcagggagtgtgaggcagagccagccggttgcggtattgaagcgggtggtggaaggcctcggtgagaggtggcatttgggcaaagaaggagatgagggactcagccaagcacgtgcctgtggcaagattgttccaggcagaggaatcagcgcctgcatggccaaggagcagccaggaggctggcgtggccagagcagagtgatctggaggagaagagtgggagaagagaactaagagggcacagggaccacactacagggggcctcagaggccacttcaaagatttcagcttttatcacaagcgacatgtgaaccatgggaggggtctgagcagaggagggccaggatccaacaggtatttctaaaggatccctctggctgcggtgtggagtggagatgccaggtggcagtggtcaaagggagaccagtaagcaggctgtcgaaggtgtccaggtgagagatgagccaggtggtaggattctgggtgtagacttaactactctccctctcttttttttttttttttttttttgagagagagtccagctcttgttgcccaggctggagtgcaatggtgtgatctcggctcactactacagcctccacctcctgggttcaagcgattctcctgcctcagcctcccaagtagctgggattataggcgtgtgccaccacgcccagctaattttttgtatttttaatagagatgggatttcgccatgttggccaggctggtctcgaactcctaacctcaggtgatccgcccacctcggcctcccaaagagctgggattacaggcatgagccactgggcccggccgacttctcttaacctcagtctcttcatctgtagagtggggctagtaaaggcccctgcctcatagagtcattggaggcctaaatgaatgtaattcatgcacagcactcagaacagtgccaagaacatgtatcactccatatgttggttaaacaaataaacagagggtggctaagagcaaggatgatccagactgcccgctccgatgtgcttaactgtctgtgcctcggggtcatcacctagaaaatggagctgtggggacggattcgtgagcttcaggcacacagtgaacactcagcgtccctgctgctgccgctgccgcgggcccccacacccccggctatttcacacacgctcatccctcccctctctcacccgtccccctctccaccgccaccccgcagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacctgccctgcgacctggactgcggcatcctggatgcctgctgcgagtccgcggactgcctggagatctgcatggagtgctgtgggctctgcttctcctcctgagcctctgtcgggggctaagccagcctggcgcccctgcagattccagcagggtccctctgagtggggccaggcccaggactgtcacacaaggcttgagaagccccctctccctggtcctctcctacccacccatgtcctctcagaaccccagccttgaaaatagtggggggcactcagaggggccacctcctcagccgtgggtggtgggcccatggcagagaagcctgaactctttactgggttaccaggttcatacattgctgaggacctgacaggacaacctaggggcagggctggggtggggaccgcagggggcagccagggctggggaacactgtgaaagttacttggggagggtgggccggtggggccgtagctctctacctctccctgctcctggtgcctgcctctctcctccaccccaggcttagaggacagaaaaatgtgaagagacgccccacccaccctcagccagccctctccagtctcctttcctaggcttttttgggggcctaacccacgcagtgaccccagagggcagggctaggcgagagcctggggtggggcgggagggggaacagtatggaaaagactggaaggggaaaggaagggaagggagggagggtctgttctatctgttgctgtaaataaagatatttgtccatctcagatttcctcaggactcatgactaattgccatggaccctgactctcaaaagcaaacgccccctaccaccgctaaaaagcacccacatgggtgaggctgccctgccctctgggggccctgcctcttctgctttcttaccccagaaactgccctgcccttcacgttcccctcccttcttcatgtttcccactaagggaagaaggttaagggggtgctgtctcccaccattatttccttcttcccaccaaggggaggggaagcccagagggaagagttaaccttggcatggaattaattaacagcagatgtgttcgggttttgattaattaatctcctgctgacttcagcttctccagctctatcccatgaagtcgctccaaggcataggtgatgcccatgacagtgccagaggggtgcctgggagggggctactccaggcctggggcagcccagacttgcccctgggcttcactggaggcccagtgggggtcacacacccagcctcaggcatccccctattgccaggcgtctgagaaagaaggaagccttgtcaggactgcatgggcccctacggccatctgtggggcggccttggagtgcagagggaagggcctgagaagcaatggcggctgtgaggatcgcagggccgcactgggggcagctggaccagcaccccccacacatatcctggacctggaggaggccaggagaggtccagggggcatgagaggctctgggacagttggggcaacttggagaacactcagctgatgaaggccttgagacgggggctgcaggggtattagtgggcactgcttccaggaatgaaggcttggagtggttccgagggattctggaaggaaggagtggggactggggaaaagggccagatgaaatccaaactctcttaaggaatgtcacaggagggagcagcctatggccttgggagtgggtttcattgcagcaggaggaggaggttctaacaggcaacgcaaactagccccccaccccctccccactccatctccacgcacacacgcctcacttcaccagcttcaaggttttctgacctctgagagcacacaagaaattcaggacacagagaggaagggacctgcctggggtctcacaatcaagccggtagagggtccccgaggcacccccagcactcatgtatctatttgtgcgtatttttatatattttcttagttattgcctgcccaaggtacggaaggtttgaaagtctgatctgtgcacacacaagcatttacatgtatgtgttttctttttttacgaagatgtgaggatcctgtacacactgcactgtaccctgtttttcccacctggccatgtcttggggagcttccttcccagcacatggagagctggctgagttgccctggatggatgcgccacagtccagggacccccagctctgcttaatccgctctcaagcgctttggtacaaaccaggctgagcgaggcacacccttttgcatgaatgagctgtatcggcagaatgttcgtgaatgtgggattgctggacctaccattgacaggactgcccggctttcctctgtgagggtgttccagcctcggctcactcagcctcgggggcatccacttctcccactgccctcgagagacaacggtgggagggtttcccattcagtcctcaaggctggggtctgaagggcgttagggaggccagatcagggggtgaaggggctcctgaccagctcgatatctggtccaggtgggcaggaaggcctgctcctggccctccctgctccgcagggctgtggcaggaagaggcgcctctgcaatccaaacagcgatttcctgctgcaggctccaggctgttttctttaggacagtggctgaaaccctagaggctaagctgggttggggcgggacaggggaaggatttagccagccccccagcacacacacacacacacacacacacacacactcacacactcacacacacacacactt

SEQ ID NO: 12507 - DNA, 119214 bp, Human
  misc_feature (1)...(119214): n = A,T,C or G
aatttgttagtataaaaagaatacttggcagtttgtgtttttcccgcccccagaggaggtgtccgtttccaaatagaaacaaaatcagggtcataataattaatactgctgaatcagattcaaaagattggtgtttctgtggataaattaccattttcatttgatgaaatggatttacttggggattggttgaatcaccggatcatgcaattctaaattattgtgttagcattataattgatcctggccaataggagcgaggagagagatagctttcctttttctacctgaatgtcctgctctatcttcaagcaagaatgtagcagggctggattattgtttgtgcacctaatccattgagcagtgttcactagttgttgcgagaagtcagggaccccaaacggagggactggctgaagccatggcagaagaacgtggattgtgaagatttcatggacatttgttagttccccaaattaatacttttgtaatttcttatgcctgtctttacttcagtctcttaatcctgtcagctgaggaggattatatcatctcaggaccctgtaataattgcattaactgcacaaattatacagcatgtgtgtttgagcagtatgaaatgtgggcaccttgaaaaaaagaacaggataacagcaatgtttaggcagcaagagagataaccttaaactctgactgccggtgagccgggtggaacagagccatatttctcttctttcaaaagcaaatgggagaaatatcgctgaattctttttctcagcatggaacatccctgagaaagagaatgcgcacctgggggtgggtctctgaactggccccccgggtgtggtcgtctcttatggtcaagactgcagaggtgaaatagactccagtctcccatagcgctcccaggctcattaggaagaggaaattcccgcctaataaattttggtcagagaccagttgatctcaaaaccctgtctcctgataagatgttatcagtgacaatggtgcccgaaacttcattagcaattttaatttcacctcggtcctgtggtcctgtggtcctgtgatctcgtgatctcgccctgcctccacttgccttgtcatattctattaccttgtaaagtacttgatgtctgtgacccacacctattcgcacactccctccccttttgaaactccctaataaaaacttgctggtttttgtggcttggggggcatcacggaacctaccgacatgtgatgtctcccctggacgcccagctttaaaatttctctcttttgtactctgtccctttatttctcaagctggccgacgcttaaggaaaatagaaaagaacctacatgaatattggggcagattccccgataactagtgttcctttattaatgtgaatcatagacagccatcagtcttctattcatttttgtagttttgtgttaatttcattgttccctttaaaatatagctagctagtgaaaattacaaatatacacattgtattgaaatacaggtatattttatggtgataacaattatttcacaattttcttgatgaaaacaatatggtgaacattttaaactatttaaaacaagtttagtttattgaaactagtaagttcaataggctatacgcacagtacagataaatataaagcataacatgatacagaggataggaaaatgggacctaggaaaccaatttttgaatctcgcgatgcaaagaatattactgaacatttgagtaatacttcctgaagaaaaaggattcgtaatagtagagatactcagttggctgacgttttgttttattccaaataaatgactttttaaaatttaattttcatttaacagtatttgtggagctttctgctaggaatggtgttgagtgctagaattttgtataatgtatatttaattcagctttggagtcaagaacaataatgcatctcaaatttttttcttttttaaggaattgcattttgtgaaaaaagaacaagaattttctgcaaggatcatatctaagtgcactttttgctgatacttcatttctagtaagacattttttcttttctatgttaagtagatacaatggaaatgtattttaaaaatcaggctgttcttgtgagattgaatggcagttattttagaggttttcttgggggcgaggggggcttaatttagacccagttgaggaaatttgtaaaattcggttgaaatgcgtaatattgtgtagtggcagtttctcttatattttgtctgacgctgctgaaatcatctcatattttttcatctttcacacttcttccatattctctatcagttaacctctatttgaagaaagaagaaaaaaaattaagtaggtagttggtagttactgagacagttaataggatgaagggagagttgggggacatgagttacatgagctgaggaaagattttcaagtgaaagatgacatgcatgtctagccatatctcatgaagcatgggaaaggtcaaatagaaaaagcaaattttaggggatcttttaaaaatgtggacatttttaatgacttggaatttactgccttaaattaatgggttcatatttgcaaagctcaggaggagactattttgattaaaaaacttacattggcctaggttaacattcacagtatctcagtaagatgtgtagtcctcaaaagttttcatatgtgtagtcctcaaaagttttcatgagtgaaaccttacctgaattccaccttctacttaaaatggaaaagaagtgaattatattaatgctagaatattttaaaataagtaattttgaaaaatgttaggggatattctgcagtgtgttataataagttaacattagcattttaaatattagatatcattgatccaggctgatgattatgtcagtaaaaatcttggaaaaggtatcttaaaaatttttattttgcccatttcaggaatacttttgctacttaacataggtctaaattttttttcttgaatgattaaatagtagaaagaaatcacattttacaaacttagaaaaatgagttctttgttgaagtatgatattctgacatcagtttcatatggttatatatttttcttgttataacttgactgaagaacagcccatttaatgattgataatctttagtttaggagactaggagaaaaaggcctgtttatccaactgatgcaaagtaccttcagtttaaaacttgtgtatgtgtaggtgggatgggaacagtggagtttaattctcattttaaaatataaaccttggttagtcttctgtaaatctttttcttttctcatcattacagttggccctctctacccataggttcctcatctgtggatcaaccaactgtggattaaaaaataccctatacttcaaaacaataaaaaataatacaccaataaaaaattttacattgcattagatattataaatattctagagatgattcaaaatataggaggatttatgtaggttgtatgcaaatactgcaccatttttatataagagacttgagtgtcctaggattttggtatccatggaggatcctggaaccaatttcccactccacagatactaagcaaggattttacttaaatttctcacctgtttgttttgttcattaactgctggaaactgagtgatatgagctaaagcactcatgcccttagctgagaactctgtactttctctgaacctcagtgatggctgtgggtataacttcagatgttatattttgagtcatgtttagattttagggaattctctatgctgcttcctctactagtctctaaggatgtagacagtgtcttatccttcatgacgggccttctatggttctatgggttgtgcctgagttaataactacttgtttaggagttactcttgagtgtttagattggaaatgtcctttctttttgaatagattcgtatgttaactggcgaagctcagattagagattttctttacaattctgctgcagtagaaattgaaggtttgtcatagggattagacagaatttctcctggctttccttcatgtcttggaacttctttggactactacattgaggtcagtgatccattttgaattaatttttgtatatggtgtgaggtaagggttgaagtttatttctttgaatatagatatcatattgttccagcagtttttttgaaaacattatattttcccctgttgaattatcatggcaccattgttgaacattaattggccattatgtgtgggtctgtttcaggactctgttctgctgatctatatatccttatgacagtgcttcactgtcttgattactgaagcttttatagtaaatcttaaaatctggtaatgtaaatcctctaagtttgttcttctgtttcaaagttgtttcttctattctggatcctttttatttctttctatgtagtttagaatcagcttcttaatttctacaaaaaaagcctaacaggatcttgattatgaatgtttttaccctagagatcaatttgggagaattgacctcttaaggatattgaatcttattaatgcgtgagcttggtacctctattcatttaagtcatctttactttttctcagcagtgtcttgtagttttcagtgcaatggtctgacacatagtttgttaaattcatctctaattattttaactttgttattataaatgggaatttaaaagaatatcagtttccaattgattgatgctagtctacagagatagaattgatttttatataaaactttataatttgtaatattgctaaattaattattagtgctagtggcttttttgtagatttcttcaaatcatctgtgtagatcattatcttctctgtgaataaagactatcttatttcctccatttaaatttatgcaccttttattacttttgcttgctctattagactggttagtagtcccagtgcaatgttgaatagaagtggtgagaactaacatccttgccttgcttctgatcttaggtggaaaactttgagtttttcaccaggtcttggtcagagttttttttttttttttttttcgttttcacgagtaggtgttgaattttggccaaatgttttttctgcatctattaatatggtcacctacctcccctcctgtttgtctgtgcatatggtcagttacattgattgattttaaatattgaaccaaccattcatgtattcttaggataattatcacttggtcatgatgtgttatactttttgtgtattgctggattcacttgctaaaattgcgttgactcttttaaaaagtctacattcatagaaggcattggattgtagtttttgtctgttttgtgtgtgtgtgtgtgtgtgtgtgtgtgtgtgtgtgtgagggtaatgctggtctcagaatgagttaaaatttcttgttcttgaagaatttgcatagaattgatgttatttcttctttaggtgtttggtagaattcaccaatgaagacctctggacctggaggttctttgtgggaaggttttaaactgttaccagcggtgaatctgcatgggtctacggcaacctcagttcttgccctctcagaagaaagaattcaactgaggggtataaggcagaaggagagaccgaggcaagttttagagcaggagtgaaagtttattaaaaagctttagagcaggaatgaaaggaagtaaagaacacttggaagagggccaagtgggcagcgtgagagatcagtgcgtggtttgacctttgactcggggttttatatgttggcatacttctggggtcttgtgtcccttctgccctgattcttcccttggggtgggctgtctgcattcacagtggcctagcacttgggaggggagcctgtgcagtgtgtttactgaagtcgtatgtatgcttccttgaggtattcttcccttaacagtccaatgtccctaggaagtcatataccagttaaacgctaccattttgcctcttaatgcgcatgctggagcccatatgtccaactcctgagatgttatagggaagcggctgatcaccagcttcaggtgttttctatctgttgggagactgcctttcactggcttgggccgcgaccaattatcattttagagagacagtttaacaactgcctgaccgtcacctggtggttgcctgacattcctggggtgtgtgtgtgtgtgtgtgtgtgtgtgtgtgtgtgtaggggtggggagctttttgtgtgtgtgtgtgtgggggtgggggtggggagcttttcgtgtgtgtgtgtgtgtgtgtgtgtgtgtgtgtgtgtgtgtaggggtggggagcttttcctgccctgctcatgtctgactagctacctactgtaacaaaactatgaatttggtttccttaactgatacagggctatttggatttatgttaattcttgttaaataagctttagttgtttgtttttcaaggaatttgtctattttatgtaagttgtctaatttattggcacgaagttgtattttagaatccctattattttacatttgaagaatctgtagtgatattccctctttcgttgctgatatttgcaaacttccttctttttctaaaagagtatttaatcttttaattttcctttgtttgcatcctacaatgttagtaatgttgtgtgttcatttacatggagttcagagtattttaaaatttccattgtgattttttttccttgacccacgtcattttcaaatatttggttaattttccagatttctttctcttacaggtttctaatttaattctactgttgtccaagaacatactttgtgtgatgtaagttcttgtcaacttgtggagatttattataagacacagttgtggtggtctgtgttagtaaaatttttttttttttttttcaaagacagtctcactctgttaccaaggctggagtgcagtggcgtgatcttgcctcactacaacctccacctcctggctacaagcaatcctgtgacctcagcctcctgattagctgggactgtaggcatgcagccatcacacctggctgattttgtgtgtgtgtgtgtgtgtgtgtgtgtgtgtgtgtgtgtgtgtgtgtttggtagagatggggttttgccatgttggccaggctggtctcgaactgctgacctcaagtgatctgtctgccttagcctcccaaagtgctgggattacaggtgtgagccaccatgcccagccagtgttagtaaatgttttgtgtgtacttaagaagaatgtgttgagtggagttttctaaaaatgttaactaggtcacattggttgatagtgttcttttaagacttctgtgtcccttttgattttctgtttgtttcaataatttctgaaagagaagtgttcaatattcaacttcaattgtggatttatttttccttttactggttcatgtgtttggaggctctgttactaggtgcatgcgtaataagggtttttatgttttcttgatgaattaggtctttgtcactattaaattttgtgaaatagtttgtgaaatagtttgcatagtttctgacaaaaagtctgctgttcttaccttttgttcccagtatgtaagttttctattttctttggctactcttaagactttattactaggttttagtcatttgattatgatgggccttgtatggttttctttgcaataatgctgcctagattttttagtttattgtttaaaaccaaatttggaaatgtttcaccactatttcttcaaatatcccacttactccaggtttttgtttttgtttcccctgtaattttagttatatatttgaaatattgtctctcttggcactgatactgcttttgtttttcattcttttctttctgtctgtgctttattggttggttaacagtaccatgccttcaagttcactgatcttttcttctgcattgaataatcccatccagggtgtttttaatttctgaaaatcatttttcatttctggaagttttatttcttccattattctcttcatgttcttatttttctttgtcttctgtaacatactaagtttatttataatctttttttaatgcccttgtcagttctgttaactttatcatttttgaatctcttcatattgattgacttttattatatgggccacatttttttgcctcttctcattccctataatgtttggatgctggatgttgtggtttgacattgttgggcttaggggttttgttttttttttttggtatcttctatatagtgttggactttgtttttgtacgtgtataagttagtatcagctgaatctttttgtttaagcttgtcagtgttggtccagagaagccttttccgtggggttaatttactgcccattaaggttatatccttttgagggctatactccatgctcttctgaggattattctcaattcaaagtaatcccaaacaatattccaaaaattttgttagtttatctgcttttgttggagacagagtcttgctctgtcgctcatcctggagtacagtggtgtgagctctgctcactgcaacctccacctcccaggttcaagctgttctcttgcctcatcctcccaagcagctgggactacagtcacgcatcaccacacccagctattttttttgtatttttagtagcgacggggttttgccatgctggccaggctggtctcgaactcctggcctcaagtgatctggctgcttcagtctcccaaagtgctggaattataggtgtgagctgctgcgtcctgcctctcttccacttttaaagatgtgttcactttgagccaacccagataatccaaattaatttacctattttaaggacaaatgattaccaactttaattccatctgcaaccttaattctccttttccatgtaatgtaacatattcacaggttctggcaatttaggatgtggttttctttcctgcataattattctgcctatcacaacttccaaagttgaactatattgtgcaaggtggacatccaagctaccaacaatgttgaaagcttagatttgttcaacacatttacagacgttacattcttctttatgcctgaaaggtagaccttatacataaagcatgaacaagtaaattggtatgcttttttgtaggattcttggctcagggcccaaggagctttacagtactttttagattttagatttaaaaaaaaaaaaaaaggggctgggtgcagtggctcgtgtctgtaatgccagcaccttgggaggccaaaggtgggtggatcacctgagcctaggagttcaagaccagcttgggcaacacagcaaaaccctgtctctacaaaaaatacaaaattagccaggcatggtgacgcatgcctgtagtcgcagccactcagcaggcttaggcaggaggatcacttgagaccgggaggcagaggttgcagtgagccgagatcatgccctgtgttggattttaaaggaaattttgtggcccaagaatagctaaagtagtcttgaaagaagatcagagtggaagaactttctctattaaaaacttatataaatctacagtcactgatttcatgaaataaagccacaaggataaacaaaagaaattaaatgcctggaaaagggttcacatgtacacggacacttgctttatgacaaaacgcacactttagtagggaaagaattagtcaataaatcgtcctggaacaagtgataatctgtatggaaagaaatgacttatgttccataccatatgcaaacatcagtttaagaatgattcgtatatttcaacatgaaagacaaaactgaaacttttggaagctaatatagatgaacaggttcatgctctttggccaggaaaatatttcttaaaaaaaaaatcaaaacggcaagtattaaaaaattgataattttgactaccttaaaattaagaaattttgttcttgcaaagtcaccattaagaaaagagaggcaagtcagagtagagaagatatctgcagtacctttaacagacaaaagacatgtatcagaatattcaaagcgcttctacaaatcaatgtgacagagacaatccaatagaaaaatgggcaagagacatgaaaaatacttcacaaaagaaattcagatatttaagaaacgtggaaaaaaaagtgcttaaccttattaataatctgggaaatgcgaattaaaaaaaactaggctccaccatatgcccactagaatggctgaaattttaaaaagggatttatagtacaagtttttgagaggatgttaggttatgggaactcagccactttaagaaacatcttgacatttacataccctgtgatgcattaatttcttttcatgggtatacacttgagtaatacatgtacatgtgtgtggagggatgtgttaaagaacgttggtagctgtttgtaatagcctcacactcaatatgatgttcatcatagttggctacataaataaactcatgatacattcatacagtggagtactttacagctgtaaaaatggaataactatagctatggataaatatcacaagatgtttctcaaatgaagccagaaatcacacattatgtgtgattccacgtatataaagtaaaaacaaaacatgcaaaaataaaacaggtaaaataagctatgatgattagggatatgtgcttatgccatgaaacggaaaatgaataacagcaacaacaaccacaaaagagagttgctaccacaataatcaggaaaattgttgacttctaggtgtggtggaggagggatttaatgattgttgaatagtgggtgattttaggagtgctcatattctcttagatctgaattgtaacttgagtttgtaatcagtccttgaattgtgaatttttgttttatgtatttttacatctctgatatatactcaaaatcatatttgactgaataaatattgataaggttagacttagagcacatttatcaggtttgattcagatgatatgaggttaaaaggttttaatatatttgatatttgaatcatgatgtagagaaccgagattatttctagtaatgataattcatctttttgtatgatttaattatttgtaaaacattttttcccccagtagttatgacatcctgagaagtatttgagataggcataagtatctgcattttacaaatgagggagcattaattatgagagtgagttgttggtggtagaggattagaatctcattttcatttctatgccttgccttgctgtatcctttatttctcttttgtgtcccatgtgaagacaggacgttgttctttatgttggtgtaattaatctgaggatgaaagagcatggatggaggggctctcctcttaacagggcagtttacaaagtctcctttctaatgattttcgtaatactatgcttatctctaaggagttcaaggtgccctgtgattatatcatcagttcttataatttcctgtaggagttttgagccatagtcttgctgtgctttgtagaaatgaattgaggtagtagaagacatgaatcaccgaaaatcaaattataattcattgatacatttgatattttatagactggtcatccagataaaaattttgaagttagtagtttggatgatttaccatgatcaactaatggtttatgtagttttaaaataatcatatgtcctgtttaaggaagcccaacttaaaaaaactttgaacttcagcagttaagtgaagggagtgattattgacattacaaaaaaaaattacttacagctttaatcaaatttagttaatttcactgtgaatgtaaggtacttgcactatatttgctattcattgtataaaacatgttgcatatttcactaatagtaacaggctgtaaacagtttacccttaagcttcttttatttttcaacattcagctttgaatgtctctaatctaaaaacactgtgtggaagcatacaaaaatatataacttgttattaatcagagaaatccaaattaaaatagaaagatgccatctttcaaaccatgttttagatttttagatgatttctcccctcctcccatcctgtttttgttttggtgtattgactattttacctaaaacataagaagtaaacacatgataaaaagtaatactttgggcgagcgtggtggctcacgcctgtaatgtcagcattttgggaggccgaggtgggtggatcacctgaggtcaggagtttgagacccagcctggccaacatggtgaaaccccatctctactaaaaatacaaaaagttagctgggcgtgatggcaggcgtctgtaatcccagctacatgggaggctgaggcagggtaatcacttgaacccgagatgtggaggttgcagtgagttgagatcgtgccattggactccagcctgggtaataagagtgaaactccgtctcaaaaaaaaaaaagaaggtgctattttgttgttctgattttaggcaaaggtaccagtattcagtatttcagttgtcttaacttttctaacaagtagatagtttagaggtatcatagctagaccacagctagtctttgcaaagttggaaaaggcccctctgattttaagtaaatagtggcttctgctacagttaaggtgctagacagtggaagacaagttggctttcagaccccacctgctcactcttggccccaggcccatgtgcatggcatgacattgttcataatggctttgggtcatagtgatttcttgctctcttctagttagtaagggattatttttctcaatgctgtgtgtatttttgtatgtttattgatcttatttcttgaatcagatgttagtatttttgaattttacctaaaaatgtataataacctaatttaattcagaacttcataaaattagtgtgagtatttgtagggtatgttctgcctttatgaaagttacataaagccaaactgcactttcaggtaatgaccataagtctatgagatttatattcaaagtacagtttatgtttttgttatcgaatcctttctttatggctgtgattgtgtttgtacgacataatgttgtattttaaaaacatatgataatatagcatgtacaattgaggctcaaatggaataccttagtcattttccataaaataatagcttatgatagtctcaggctaatttagaatttgaattttgcctggatttaattgtaaacattaattaaaacatcttagtttagtgggaacaaagaaaaattatcttatattaaaagtaattagaaaataattccataagggtaaagaatctgccattgtgttacaaattatagaataattctcctcaagcttgacaaagagagtatacagtatgagtgggtttttatttatatattttataagaaaatatatggcatcatttttgtgtgtggaatgtagttgccttgtcttatattaaaactgggattaaaattaattggcatttcttgattctggtttttcaccatcttttagcaaagtagacagccacttgggtttcttacttagatcaattttttttcattctagtggatactatttagaggacccagggtatcatatttaaatacagtaaaaattttaaattaaccatcttttatattactggaagcatttgaaatcaagaatcgtatagagcactggcagtgaacaatccaaaaatgaaattatgaaaattatatttatagtattatcaaaataatacagttcttaggaataaatttcacaaaagacacagagcacctgtacactgaaaactacaaagtatcattgacagaaattaaagaagacctaaataaatgcaaagacggtaccatctttattgattggcagatttaatcttgttaagattatagtcatcccaaattaatcaacatatttaacacaattcctatcaaagtccactggtctcccccgcccccgccccccccccccccccgaaattgacaaactgatcctaaaactcatacggaaattgaagatacttagaatagccaaaacaatctttaaaaaggataaagttggaggcctcccacttttgaatttgagaatttactacaaagctactgtaacctagacagtatgttactggcataaggataaacagatcaatgggacagaattaagagtctagaaataaacccatgcatttatggccaattgattttttttaattattattttttttcacaatgatgccaagacagttcaatggagggaaatagcctttttaacaaatggtgttcagacctctaacactatatacaagaattggctcaaagtggatcaagtacttaatgtaagagctaaaactatataggctaagtcttcatgatcctgaatttggcaatggtttcttagaaataacatcagaagtagaaataaccaaagaggaaataggtaaattggacttcagcaaaattaaaaacattttgcttctagggacactatcaaggaaatgaggccgggtgcgttggctcatgcctataatcccagcacttcgggaggccgaggtgggtggatcacttgaggtcaggagttcgagaccaacttggccaacatggtgaaaccccatccctactaaaaatacagaaattagccaggcgtgatggcagggacttgtaatcccagctactcaggaggctgagacaggagcatcacttgaacctgggaggtggaggttgcagtgagctgagaatgtgccactggactccagcctggatgacagaacgagactctgtctcaaaaacaaaacaaaacaaaacttgatgagtgggagaaggtatttacagatcatatatttgtaagtgttagtatccagaatatatgaactcttacatcgcaacaatgaaaagacagtaacccaacttcaaaaaggattttctccgaagaagataaataaatgaccaataggcacatgaaaagatgcttaatgttatagttgttagggaaatgcagaattaaaaccacagcaagataccacttcacacccaccatgatggcataataaaaaaagacagaaaataagtgttggagagaatgtggagaaattagtatcctcatactttgctggtggtaatgtgaaatgcttcagactccttagagagtagtctggcagttcctccaaaagttaaatgttgttaccatatgacccagcagttctgctcctagcgatatatctggtagaattgaaagtatatgtctgcacaaaaacttgtacaccgttattcatagcagcattatttataatagtcaaagtggaatcaactcagatgtctatcacctgatgaatgggtaaatgaaatgtggtgtatccatacagtacaatattattcagccaaaaaaggatgaagtactgattaatgttataacccagatgaaccttgaaaacatcatgttaagtgagagaagccagacacagaaagctacagattgtataattgtatatttccagaataggcaaattccatagagacagaaagtagatgagtatttgctggggactagggagaggaaggagtggggaatgcctgctaatgagtatcaaatttctttttgggatgataaaaatgttctataattagatagtggtaatagttgcactgctttgtgaatacgatttttagaaaaacaccgggccgggggcagtggctcacacctgtaatcctagcactttgggaggccgagatgggtggatcatgaggtcaggagatcgagactatcctggctaacagggtgaaaccctgtttctactaaaaactacaaaaaaattagctgggcgcggtggtgggcgtctgtagacccagctacttgagaggctgaggcaggagaatggcatgaacccgggaggcggagcttgcagtaagccgagatcacaccactcactccagtctggatgacagagtgagactctgtctcaaaaaaacaaacaaaacactgaattattcacttttaaaaggtgagttttgcggtatatgaataccattcacataccatatttaaactcaatttaaaaatcatatagaattgaagacaccaccctgaacaacacagtgagaccccatttcttcaaaaaactttttttaaaaattagcagagtcagggcaaaggagaggagctgagatgagagggttccttgagcctaggaggttgaactatgattgtgctactgcgttccaatctgggtaactgagtggaaaccctgtctttaaaaaataaataaaggaaaacagtggtgtacttctaataaactgctatcaaacctggatacttttgacagtgaggggtcttacttaatagttacacctgtctcaggtaaaccagaatgtatgttctccctactttggtgtgttgaaactatttttccttcagaaatgtgaagaatataaaattcttctcatattcttctttagcaagtgaaaaaaaaaaaaggaaaagaccaagaaagccatgtaattcaaggaaacgggagagagagatttctctatggaaatgaaggccataaatgtgtgtataaattgcagtgcgtagatataatgcaatcaggacttgattcatttgtatgattttgctacttcactcttgtacatagccaatcagtgtttgaataaagagtgtaatattgtaatataataaaacagaggctgtgaactaaagacgtacatcatcgtaatctgtggagcttttaaaaagtactcttgcttggatattagtctcaattatgatttgctggttttattgtggggctagggcaagtttgtgcatgcagagtatatgttttagttcctcagttgaatccggtgttcttttaaattgagaaccactgcattagatcagtgagttttattgatccatttattgaactatctagttattattgttttatgcaacaatagtaaacggcagtaggaactgagagaacctcaatctaaacaatacacactttaacagtccccgcacccacccctcctagggccatccctgtgggtaatctagcaattgtgattcctctaagtctttaataattgagattgagaggagtcatttatttctctttttttaaaggtaccttgaagcaggagtagtagtgggaagtaagaagctcaagttcctttgcaaatgcttgcaactacagtatatccctggaaggcagggaaaggttatcagcgttgatagcagagcaggagggattgggaaatggagacctttgaggaggtcagaactcttaaattagctgataagtgctcaaggcatttgtattttgacagcccatggtagcatcagataaattgccttttaacggggaacgtattgacatgtagtggtccttccacatgctctagtttcccttgtgcagccatacacaacttagtagaaattgttttaatattctactactgaaaagtaccataaactcatgaaattggggttagatggctccttgaaggttttatcacatcagtggcatttttaaccactatttaaatagttccggtggtgataatgtactgttatggaaaaagacatgatattagggccaaaatttcaactctgcctcctagtgtgactttgggtgagtactgattgtttttactcgcagttgcttcatttagaaagtggaacagatgccatctacctcacagggttattgttactgttacatgagataatatatattaaggtctaacacagctactgataaatgtagaagatatttaataaatattaagttaccttcccttctgcagttcagtgaagaataacttctttttttttggagatgaggtctcactatgttgctcaggctggtcttgaacttctgagctcaagtgatccctcacctcaccgtcccaaagtgctgggatcacaggcgtgagtcaccgcgccaagcccaacaataacttataactccaaaaaattggttcttagagaatgtccaatagcctgggattgtgaaatctcatactttgacttttgctttcatttgttaagcaactatggtagcagctgaggttataggagtaaatacaacagacttgatcttctcccttggttacagtttggttgggggaaaagaaatcaaacatttaattgtataaggaagtaattacagttgaggtaaatgccataagagagaagtacagtctgttaggaaagtgcattagaaatcctaacatagtttggatgttagggaacatttccttgaggaaataatggtaatactgagacacaaaggatgggtaggactgtcagtaaggagaagggcttgggataagagctactgagagagagcaaggtggtagtatgtatgaaagccctgaaacagaaaggagttaggagctttctaagtacataacagcttgtgtcaagaagcttgctgggcaagaggaagtgtggcatggaatgaggagttccatgagtagaggagtgacaggataaggcagagccttacaggccatgttaaaggcttgggcttttaagaacagtgataagtgacatgattatattggcacgttaaaaggttgctgtaatgaaaatgaggaaattgcactggagggaaataaaagtgcctgctgagaccagttagggggctgttgcaatgcttagggtaaaggtgaacagtggctggtacagaaaaggaacaggcttggtgtgtttggtttaagaaaatgttgggttttgagatacctgtagggtatcttaagttgagtagttgagaatgtggttggatatagccagttaggctagtgaggtagctctggctgaggcctttgcagtaggctgataagctgagtttctggtatttgtcttttatgcagacttaacagcaacttgagtgcatgtgttgtgagtatttttatactcattattttacagtttttaatattaagtaatgattatcacttaagtaatggatattgcattattttacagtttttaatattaagtaacggtaataataatggccaacattgagcacatgtgcagattactaggccaaatacttcatatgtgttatctcttaatctttacaagtttatgagctttattattagtccagtattttaaagatttggcatctgaagcttagagaaattgagtaacttctcaaggcaacccatgtagtaagaggtggagctgaggtttgaatgcaggcgggcatgctgcagaccctgtcctgttaaccatgttaaccactaccgtatgccacttctctgtgaaatttgaaccaaccagacaaaccaaacagaatgactgagggaccatttattagtgaacttttatggaagacctgtgtatactacacgttgtactataggtgatttgatacagtctcttatttacatcaacattcacatggcctgtgaagtatggtttttgcctcattttaaaaatgaagaaactgtggctgagcaagtaagtgacttggtcaagatcactaatagctatttagtggaacttggattcaaaatggactcttctgtgttatactacttaaaaataaaaactgtgttgacttaaaaataagaaaatttcgctggggaacacaattagatttagtggttcccatatatcaagccacagtcagactagttcttaaaaaaaaattagatctcaatgtttaaaattatagattgaatttagagaacaaacagctgagaaaattgagatacttaaaaataaataataggtattttacgtgtatacaaagtaaagactttattaaaattattttagaaaagataaaatgagaaaatattttctaggaaatgtgtatccattttataatatctgcgaataggttagacaaaattacaatattgatgactgggttttttttgtcaatagttaattgttagcatttgtataggactgcatcttgatcttgctgtaatcactctgtcctttaaaatttcttctgtttcttccttagttttgagaagacaaatggaaattaagtcaatgaggtaacatattataatgcatcttaaatattggcttcttttagcatcagagttaagactcatcttaccagtactttctactgcctactaaaaattaataagaggcaattaagcatagtattaacagtgtagctcctttgggatctggtttttggaatactctgttttcagtaagccctttgcagagagatttagtcttaggtatatactaaaataaatatatatatatatacacccatcatgtgccttccacttttttactgacagttgatgatgagggacatcttttgggtaccggatatctgtaaagtaatgttatatttggttttctttcggtcgatgggtacaccattgagagctgtggccatggggcttgttattacagtaagaaaaagcctatctcctgaggctagcagaacctgtctgaaacagataattggattttgattggttggctggatgtgagagcctttttgaagcagtcttataaggtgcttttgattttaggaagccaaatcaacaagttactcttccactgtctcctgccttgtctttgttacagtcatttatttgtcttttttcatgtgattatgatctgtgtatcttacgagaattgcttgctcttctttgaatgctgtcttctgtcacccagcactgctgttcagcagtttttgaggacttaactcacacatcatcatttcttataaagactgccatactgagttacctataggatatcagaaacagtcaacttcagaactgtatgagaagtttcatttttaaggccatatatgtgtttggtttttttttttttggtatggtctgtatttatttgtaaggtatctttgctttctatttctagctttctgtatcatctggcattttgacttagatgattttggtcttcttgacactttagatatgttattagtacagtttttatggctagaatagaaaatataagatgaaatgacagagcagagaaagaatatttatgatttgacatgaaaatgacctacctaaaacatttttgaatgatgtataatctccttgtccttttgggaacagattataatcagctcttaaattatcagcatgtatgtatcaggatactttctgctgcaagtaacagaggctaatcaaaacaggaaagattttaccatctcatataatgagaagtacagtagggtggttccagggttggttaactccagtcactctttcatcttttctttgttattttcattttcttccactctttcattctaaatttttttttgttaaattgcccataactattagcatagtctctaagcagtgtgtggttgacataaactgtgtttatgcctgtgggggagaagaagcagtagtcataggcttctttgctctgaattgtttctaatgattctagtgtattttctgtttcatcttttattctcgtagttgaacccaaaggaatatgaattgttgtctagatacctaacagtgtttatttgtaaattacatgtaaacatttaatgaaacaaactttaaaaaagcacagaaaatcagtgtttctctctgtagtcagaagccccacagacaataaagcatcctgtcagtaaatccattgcacttactgtgatgtcccttgagttgtaaaacatactaatctttgcttagcagaaattataatcttcaattaatattacatattacatttttagaagtgctttatagatattagaaccatggaatgttagagctatgttaccctaagaaggatcgagaatcacttgtgtagtattttggctggaacaatcctaaactgaggaatattctgtataatgactggcttatattcttgaaaatgtcagtgtcacaaaagagagaggccaagaaactgctctagattacaggagactaaagagactgacaactaaatgtgatatataatcctgaattgatcctgttactgaagagggtaaaaaatgccctaaagaacattattgggataagttacaaaattgcaattatggcctgcgctttaaagtactgcggcaatgttatatttattgaatttgataactgtgcagtggttatctttatattagagaatattcttcttaggaaatttcgactttaaatattgaggtgtaaagggcgtgatatatgcaacttacccacaagcggttcagaataatacatttatttatctatgtttatatagatgtgtagtacatatacacataaacatatccatgagagtgagaagagagagaatgaaagttaatgaaaaatgttaaaaattgatgaatctaggtaataggcaggcattctctatactgttcttgtaacttttcactaagtttgaaattatttttaaaatgcaaagttaaagttgtaagttaaaaagtaaaataaaaacagtttttctaaatggttgcaaatatgagtatacttgctaaagacaagctttatgttttaaggcatgtgtgaaatttaaattgtgaaaggataggtatactggatctaggaagatctacattccaaagtatgagcaaataggaggtggcagcacttgaagcttgaaagattataacacctctggcatggctattgaggatggaagggggaaggagggaaagaaccaggctgtgagagcggtggtggatttctttatgtcgctagggtttatagtcaacgctcctttggcagcagtgagatgaggatttctgtggtagggctgggcaagtagcagccagactccttaccttggggagagccctggatctacagtccctgggcaaggctgctgcattgcgcctcagactagctgctccgaaaaccaaggcagggctttagcttctcaccccctcatgaaggcagcagaatacagcggttggagtgctcttctggaataccacagacctgagttgtcttggctccagtatttagcatctgcgaccttggcggggtgatatttactgcctagtcttcagttatttttcagatttaaaatggggataataataatgcctgtcttataaagaggttgtaagaatttaaaaagttatgtgtgaagtgtattgctgttgttactatgcagcagggccctagaaaacctttctttctccattcagccaactgattactcattttgttttcagatcataaatattcacatcataaatgttaatgtgttctataccatgattgaaaatgtgtgtgttagtattgtagtaatactgtcttttggacccctttcttcaaaatatttgcaaatgtgtggtattttattctggcctcatgtggtacatataatgcatataattggattttcctgttataaaaagtcacttttacttagaaattgtcaggtgccaaaggttatacagctagtttagtgacaggtttggggctgggatgtaggttttctcacttggcttgcagtaaaccttctcagtcaggttgtgaagaaagagtaactggaaattgcacaagatagtaaagtagaagcaacatttcagtaatgtttaaagttttctggcattcaggatgtttttcttcttaaccttaaaagcatccattagttcttgttttgtagtaactttttttcgtaccacgacagtggtgtgtattttagaaaaaaggaaaataattttttaaattgcctttaagttattattttaaataacttgagtatatgctgctagtcttttatctgtgaacacaatatctacagaatttttttctttgacttttatttttggttcaggggtatgtgtgtatgtttgttacatgagtaaattgcgtgtcactggggttttgtgtgtgaatattcatgtcacccaaataataagcacagtaggtgatagtttttcaatctttacccacctcttacgctcctccctctagtagtctccagtgtttgttgttctcaactttgtgtctatatacactcaatgtttagctctcactgataaacgagaacagtgggatttggtttctgttcctgtgttaattcgcttagaatgatggcctccagctgcctccgtgttgctgcaaaggacatgattttgttctttttatgactgtgtagtgttccatggtgtatatgcatcacgttttctttatccattccactgttgttggatatctaggttgattctgtgtctttgctatcatgactagtgttatgataaaacgtacatgtgtctttttggtagattagtttattttcctttgggtatatacccaataatggaattgctgggtcaaatggtagttctgttttaagttctttgagaaatctccaaactgctgtgcacagtggctaaactaatttacattctcagcaacaatgtgtaaatattccccttgctctgtaacctcacaaacatcttttttttttttttttttgggacattgagtctcactctaccccccaggctgaagtgcagtggtgtgatctcggttcactgcaacctccgcctccaggttcaagtgattctcgtacctcagcctcccgagtagctgggattacaggcgcctgccaccatgcctggctgatatttatatttttagtagagatggagtttcaccatgttggccaggctggtctcgaactctggacctcaggtaatctaccctcctcggcctcccaaagcgctgggattacaggcgtgagccactgcgcctggccagcctcaccgatgtctatctacagaatatttaataacaaaactagaactacatttttcctacccacaacaatacattgtgaacatttattgtacagtgttccacctttttaatggctacagtattgtagggacaggccacctctgtaggcttctatattattcccctgccatatattcactcttttgattgtgttgggatgaacatccttatttgtatatttttctcattttttttttcttagactaaattcttgaaagtagaatggatttttcaggggaagctgaaattcatttctttttgaaatactaaatttttaaatgttgcccaaattgtttaaaaactttatatctacaggatgatttgggggccattcatttgcaacagtagtaagtgtttctgttccttggggctgagtttgctgttttcattttacattttgtccctttactattgtctatatgcccaagactcccaatgcttatttttagccctgatgtatgagtcttatgtctagtttcctatttgacattttcacttgtccatgaccatctcaagtttcgtatgtccaaaattaaatccttaagttccattcttttaaaaaagtaatagatccttaaagattttcttttgatagagatgcctgtttatttcttaaaggagttcagttgttgattgtacataatcatttttattccaaaaatcatttgctagtttaaaaaaaattttaatgtgtagttgattggccagagtcatcaaaatggggtgttctgatgaactcagtgattggtgttaataaggactcagtttaaaaagtaaagtttaccccctgtttaaagtccatgctcttaaaatatttatttacttaagcaacaagtttctttaaaacagtaaacaaaattgagtttaaaagactgtgaacatttgtaatcagtattagtattaaattggtctgaatatgagtgctagattctatgatatcttttaaattaagacagtagagcccatattgggaatgtttttaaaaatctggttcctgattttttaaaaacatgacacatttttttcagttacctgagtattcagtttaaagtaattttttcctgcattcctgttgcctgaataacagatataggacttgggatttaattggagagattcttttttccctcctaggaaaagataacattagtttatgggagaaatgcccatctgttttctaaaggtagattttaaatgttgccattttgagtaaaactcctttagctttaccatattgaaaaatcagtacttgcatgatttaaaaagttagtggttagcttgaattaataaaatctgactcctggaattatttgaaagatatatgcatttttttcagtatttgaatattttgaaattgtacataaattttttgaaattgtttgaaatttgtaaaacatacttaacatagaatttaccactttaacccttttaaagtatataggttagtggcattaaataaatagacattattgctgtacagccatcaccaccatccttctttaggatgttttcttttctttttttttttcttttttgagatggagtctcgctctgtcacccaggctggagtgcagtggcgtgatcttggctcactgcaagctccgcctcccgggttcatgccattctcctgcctcagcctccctagtagctgggactacaggcgccgccaccatgcccggctaatttttttttgtatttttagtagagacggggtttcaccgtgttaggatggtctcgatctcctgacctcatgatccacccgcctcggcctcccaaagtgttgggattacaggcgtgagccaccacgcccggcccggatgttttcatcttctcaaactgaaactctgtactcattacacagtgacaccctcctcttgaccctccctgcaacccctagcaactaactaccattctactctatgtctctgaatttgactactttacgtacttcataccaatggactcattagtagattggtccttttgtgattggtttatttcccttacctaatgtcttcaaggttcatctctgttgtagcatgtgacaggatttccttcttttttaatgctgaataatattctattgtatgtatgtaccaccttttagtttattctcccacaggtggacattcaggttgcttccaccttttgactattgtgaataatgcttctatgaacattggtgtacggatatctgagttcctgctttaagtttttttgattatatgtctaaaagtggaattcttggatcagatggcaattctatatttaattttctgagcaaacgccatactgttttccatagcagctgtactattttacattcccaagaacagtgcacaagtgttccagttttccacacccatgctagtgcttgctgttctgtttcttaatagccatttgaatggatgtgaaatggcatctcattgtggttttgacttgcatttcctaatgattagtgatgttgagcatcttttcataggcttattgaacattggtttatcttctttggtgcaatgtctattcaagtcctttgcccatttttaaattgggttatgtttttgttgagtttttaaatatattctggatattaatcttgtatcaaatatatgatctgccgtttttttttttttttaattgagacggggtttcgcccttgttgcccaggctggagtgcaatggtgcgatcatggctcactgcaatctccgcttcccgggttcaagtgattctactgcctcagcctcccaagtagctgggattacaggcatgcaccaccaacccggctaattttttgtatataatagagattgggtttcactatgttggtcagtctgatcttgaactcctgacctcaggtaatccacccacctcgacctcccaaagcgttgggattacaggcatgagcatggcgcccggccgtgatctgcagttattatctttcatttggggttgctgttttactctgttgatagtgccgtttgatgcacagaagtttttaattttgataaaatgtagttttttttgttgttgttgttgatggtgcttttggtgttgtgactaagaaattattgccaaatccaacatcttgaagcttttgctgtatgttttctaagagtttatagttttagcagttgggtttaaatctttgatctattgtgatttaatttttgtatatggtgttagataaacatccaactttattcttttccaggtagatataccattttaccagcatcatttgttgaaaagactgtcccgcattgaatggtcttagcatcctttttgaaaatcatttgaccatatgtgagggtttatttgcgggttctctattctattccactggtctttatgtctgtctttatgccagtaccacactgttttgattactgtagcattatagtaaattttgaaatcaggtgtgagtccttcaactttgttctttttcaagattattttggctatttggagtcccttgagatttcatacgagttttagggtgaccttttctatttctgcaaaaataccattgggatttagtagagattgcattgagtttgtagatccctttgtgcagtattgatatcttaataacatgatcttgaatctattaatataaaacatctttccatttgtttatgtctttattctttcatcagtgttttttagtttttagtgtgcaagcttttcaccttcacctccttgtttcattttctaagttcagacgatacccaacttacagtggtttgacttacgatttttcgactttacagtgttgtgaaagtgttgaattaattacatgaggtagtcaacactttattttaaaatagctttgtattagatggttttgctgaactagactaatgtaagtgttctgagcacgtttaagataggataggctaagctgtgatgtttggtacgttaggtgtattaagtgcatttttgacttaggatattttcaatttatggtgggtttatagggatttaaccccatcgtaagtcaagtagcatctgtattctctttgattccattgtaaattgaattttcttgtttcatattgttcattgttaatgtatagaattgcagctggtttgtgtgttgattttgtattttgctactttactaaatttattagttctaccatttcttttgtagaatctttaagagttttctacgtgtaagatcatgcttgctcatgaaaggattctaggggacaaaagacatcatgtcatcttaaaacagatatttatactcctttttttctaatttggatgcctttatttctttttcttgtctaattgctctagctagagcttccattacagtgttgaatagaagtggtgaaagtggtcatccgtatctcatccctgatcttagtggaaaggctttcagtctttgatcattgaatatgaagttagctgtggaatttttatatatagtatttattatgatgaagtagtttccttcttttcctagtttggttgagtgtttttatcataaagggtgttgtattttgtcaaatcctttttcagtactaatttagatgatcatgttttttttccctctttattctcttatgtggtgtgtcacattgattttagtatgttgaaacatccttgcgttgcaggaataaatcccacttgatcaccattataatccttttaatattcggtagaattcagtttgctagtattttattgagggttttcgtgtctattcatagggtatattggtctatagttttcttgttgtatctttgattttggtattagggcaataggacctcatagaatgagttagaagatgttcctcttcagttttttggaagagtttgaggaggattggtgttagttctttaattgtttggtagaattcatcaatgaagccattgagtctaaagcttttctttgtcaggaggtttttaattaccaattcaatctccttactagttattgctctattcagctcttttttgtttctttgcaattcagtcttggtagttctagaagccttttgtgtttctaggaatttgtccattttatctaggttatcccagttgttggtatatagctgtttataagtaccctcttacagtctcatttatttctatagagtaagttgtaatgcccccactttcatttctgattttagtaattttgagtcttctctttttcttcctagtcagtctagctaaaggtttgtcaattttgttaatcgttttgaagaatcaacttttggcttcgttgattttttttttccgttgtttttctgttatctatttcatttatctctgctctcaaatttgttatttcctgctttctgctagctttgagttttcctttgggggaaaatcacagcatcttaatttttatggctttatatagtatgtgtgtcttttagctttatcattcaaggttttcttggctattctttaacctttgtatttccaaatgaattttagaatcagcttatcaatttccacatacaataagagagaacccgctgatatgttgatagggtttgcattcagtctgtacatgaatttggggagaattaacatctttataaagttgaaatttctgaaattctgcaaatatagatttgcttattattttctacattttaaatttctctcaggatcaagacaagcaaagtcatctaaccgaaagcgaagatgactgatgcatgttggagatgtaagcagagagaatatggcataaaataatcaacaaggaattgggaaatggaaggtttctggaaatggaagattgtaatatgaagggaatatttgaggtttaaggttcatgaccttcatgaacttaaagtgagattaattggcttgattggcatgctaattttttttcacctagccatatttagctacatggaagctggtcttcaggggtcagattttgcaacaaaatggaggcaaggggttggagccaaaaggaggtgagggtgtgaatatgtaactggataaggaagatagtaaggaacacgaagtgggttagggccagtgaaaaagtgggagtttgagatcagcctggccaacatggtgaaccccgcctctactaaaaatacaaaaattagctgaacatgatggtggatgcctatagtcccaggtactcgggaggctgaggcaggagaatcacttgaacccaggaggtagaggtttcagtgagccgagatcacgccactgcactccagcctgggcgacagagtgagactttatctcaaaaaaaaaaaaaaaaaaaaaaaaaaaaaagacttgctataattgtagacttgacttagtttttttggtgttggctttatatataggcataccctgtttcttagctgaagtttatttaggaaaagtgtatttttacatcacaaaactcagtagtctaacaaactggtatatgtgaaaagtcacaaattatattccaagtatagtttgtagaatattagaattacatttaggcattttgaagcatgtaaagggaatgtgcatctctgatgttgctggcaataagctagacattacaatattagaagcctttgagccattgtcttccatgtgtgtttgtgctaaacatttttctaattgcctttcatatttagcccttatttttgcttagatttgtagaatgcacaaaaaagttgaggaagtgttaaattgtggagaaggaaaaaaagccagtgagaaagtaactgcatatgaagtcatgtagtaagcattttacatcccttagccatggtaatttactataaaaggggatttttttgtgtgctgaattttaaaagagaaatgattggggattatggttgatgtgtaacgtattataatttttccctacttgaaataatgggaaataaatttctggttatggtttttgcacagaatatctgattttcaggagcagattcctaactgtaagtgttgttaggtacactcagatttagaactgatatgtcttcctggtgaattgaacttttattgttttgaagtatccttctatatctatccatgcaatccatgtatatgtatctagtgtctgcctcctgcattcaagtttactatgatagccacacaactttcttttggtttgtgttttacatggtgtgtctttcactatgcttttactttttttctgtatccccatatttaagatgtgtcctctgtaatcatcatataattgggatttttaaaaatccacttctattatcttcttttaaaaattgaggtttagtttaatcctatttaatgtaattacttacatatttggattaaatctgtcatctctgtttgctttctatttgtctttcctttcttgccttcttttgggttatttattaatccatttttccccctcttagctgtttgtgcttttactgttcttgccatagttacccaagagattaccacatgcatccctgactttaaggtctaaagtaaatgagcattttttctacttcctaatcaatgaaaggattttaggacacttttatttcattttgctatcctcccctattatgtactattactgttatgtattgtaacatttgaaatcccacaaagtattattgtttagtcagtattcctttattcctttggagttactcagtgaaccctctcaaccctgttcattgcacttcatcttttgtgcatatccaagctgtatatagggttcttttttctttatacttgaaaagtcccttcaatatttcctgataacagactctgtttgtttgccttaaagttgcctctctattttgccttcatttcagaaggatttttttttttttttttgtcagatacaaaattttggtttggcatttccccaccagcattttgaagataccatttcactgtcttctggcttttattatttgggaaaagtcagctagctataactcttattgttgcttcttgaagttaatctttttaaatttttctggctgcttttaagatctctctgtctggctgaacgcggtggctcatgcctgtaatcccaacactttgggaggccgaggcgggtggatcatgaggtcaggagatcgagaccgtcctggtgttaggaataacactcaaaatcctaaggaaattgaacactcgaacaaaggattcttagcaaagcaatttacttctgcacagaggggtgcctcattggccagtcgccatgagagcacacctgaacaaaggggcacgagagcctttattcctgacgcaagtcctgcccctgtacctttttcccattgtctggggtcgggtcgtacaatctaaactaatcccggttggctaaacatttgatttttttttagataaggtgggcatgtaaaagaaagcggagaggaaaggggaaggggtgtctgtaatgagctagaaagttagtcctctttccaaataaggaaaggaatgtgagctggtactgataacgcctggtactgtggcgtgcctgggcatctaacaaaggcaaaaggagaaaaagggaaaaaggccggggtgggggtactatgagttaaagaataaaagattgatcatgttatttgaagagaaacttcattgtatcccatcctggctaacacagtgaaaccctgtctctactaaaaatacaaaaaattagccgggcgtggtggcacgtgcctgtagccccagctacttgggaggctgaggcaggagaatcgcttgaaccgtggaagcggaagttgcagtgagccgagatcacgccactgcactccagcctgggtgacagagcaagtctctgtctcaaaaaaaaaaaatctctctttgggggtgggggacctccttctccctcccccactcttgcccccgtccctctcttctccctcccctctttctttccttctccccctctctcccctttgatgttcctaagtgtggttttctttgtatttattttgcttgaggattgatagagcttcttgaatctgtggctcgatgtctcattggtcagttttgaaagttcttagctattatgtcttcagatatttttttcttgcctatatgttttctcctcccctctgagactccagttacatgtactttgtatccgttttccatgtgctgtaatttctcattcttttctatatttctcattctctttttgtgcttcagtctaggtgttttattgtttcctgtcttctgggttgattctttcttcagctgtgtctaaagtattattaaaaccatccatcacttctttttcaaaattgtattttttgatttcatgttttccactttttgtttatgaaaattcttcattttactttttaattccttgaacatttaacttgttttaaacttttttctgataacaccattatctggatctactgtgaatctgtttctattgccattttaaaaatcttggtttcagttgggttttgaccggttatattttgatttccagacatttatatgaaacgtgaaaaaatgtgaatttctagatgatgttatctttctgctgagaattacttttgctactggtatgcagctaggccaataagagtagttggcccggattgccttaatcgaatgagggattgagatgatttaaagctgtgcttctcttcctgcgtgggctagtctgttgctagttcacctttatacctagagtatagttctttggagtctgtccctatgcctgatgtgtttgccagggctgctcctccttggcagaccctaaatccaagttttgtatgtccgcccacaggtctcttgaaagctctgttaactttctcagtctctcgggcagtagttttggaatctacaggcagatgagtccagagactggtctcacctatttcttccagatctccgccctgcagattctctagttttgaaagttctctagtgtataaaacagattatcttgtgtttttcttttctagttgttctcaaaggaaggttggtttgaagcaaactactccaccattgtcaaaagcaaaaaatgcccaaatatgttctggaattaagaattttttaggtgatataaggtagtacactgtatccatcttacagccattaaaatatcttgcatgccttagcgatactgtctctgtagtaaaatgtattaatatttctcttgcctactacagtacaagtgtttatattgggaattggatacaatgtgatctgttaaaagaaatattctacaacacagcctgtttgattgggccccacgagtgactagccatctttcagttcctctaatgtttcctgttcccttttgtcatggggcttttgtacatgttgttctccctgcctaatatgtatatctcatactcaagtttgagtatgagacacatcctcaggggagcctttcctgaaccataaatttaattcagataaatgaactttctagtttggaattatgcaaactcatttgcattatggtttgattaatgtctttttcttctactagactctgaactctgctagattaggaatcatatccttttttttttttctgaccatgttatcctctgtgcatagttcagtgtttggaagtacatttattagaagtaggtgaacaattaataggttatcagttaatagatgatcaactactgtttgtatcaatgaagaaataaaataatgagggaagataaataagaaatgctgtgctgatgttagtgctggaaatgataagaaacgaaaggcttatagcttttgagcaaaagccagatttaatcacacactggatttgcacagtacaattgaagttttattgatacacatgtacagtattgaaaatacttgcataaaattcccatgggaatgtattattatgactgttgtattatagcattcatgcccccatctcctcgtatttttattatgtaagtctgaaagcactaggtttttaaaatgacacagccatcattcagaacatgacaaactatatcatttccagtcatcctactacacagaataaatggaataaaaaacgcttgaaagattttttaagtcttgaaggaaagcagacttaaaatttatacacacacacacgaaggtgctgtggtttattctaccaagggaaattgattttcacttcatctggaagtgcaaactgaatcttgactgataaggaggtgttcattaaatggccaaaggaatgtttcatttaaatgcatatttttacgaaagtatatagtggctttgtgaattgacaaatagtgatttggctggaggctagggcaatttgcaagaatttgaaaagacagattggggctatccagattagttcattgtttggtatggaggtcatcagaagtttttaaggatattctgtgttgtgaagaacagaagtgctggaaccagattccctgagtttataaccccaagctctgccccttactacgtgaccttgggcgtattgcttaatttttctgtgtctcagtgtctctatttataaaatggaggtaataattatagattgctattaggattgaatgagttaagacatgtccatgcttaggaaaatgtctagtacatagaagaatctcagtaaggcttggctcttgttgctattattgtatacattgagaaaacctcaaacattattgttgcattagtttaaccagaactagagacacaaagagattcaagaggtattttaggggtaaagttaacaagacttcaacttatttactaattttgtataaccagaaatttcaactaataatgctgtgtgcagtgtaaaagcaaatttgaaatttgtataacacttacatgatttgtaaacttacagattttaaatcttctaatttgtgttttcttttagatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtaaatgaaaattttaatttatttaattgatatgaatattcttttaaaaaaagaacataggacagaatggttgggtttttcttaaacttaattttaagtctaaatatttttagttacagactaaatgaaaaattctaacaatcataaaattgtatcttttcatcatctgctttaaagagacttccttattatagatatatgtcaccaaaaatatagatactcaaaagtaaaatcaccacaatccccaccattaccaatccattgtatagatttctcataagatatttagtcttctatgtatttgattatatatttgactgttagtcttttttatattgattatttttaagttatcacatctgtttttataattagctaagttaactataattatcagtgaatgtgttctagtcagttaaattttctggttaaccaatatgtaatgagaattttttatacttattgcaaatatttttaaatttatatatgtacctcagttttaattgataaaatatattgaagttattttatggtaccagtgtgggtaaatccttacagattcaaggtaattataatgatgctggtatatgaagaggccagaagttttaagtgtctaatgttggcttaacaaactatggtccatgggctggccatctgttattgtaaataaagttttattagagcactgtcatgctcattcatttacatattgtctatggctgctttcgcattataacaacagaattgagtagttgccccagaaactatatggtccataagcgtaaaatgtttactctctgacacttttagaaaaagtttaccaactccttagttcagaagaaagaaggaaaaataatttcatagcatattataaaggaactactggagagatgctatctctgggaaagttgcgtatcaggagaagtttcaagaacaagtggtttcagaaagtttaccaggaacagaacgaaactgaagatgtgttctgcaaatctgagtagtaattcactggaatatagatataattggagataaaactcaactgagcagcctgtaaggaagttggtgggagagatgagggttgcccatagactgaattaaagaggaggccctggtttcaactcatgaagattgttcaacaaagacataaggcccacacagtatgattcattatgaaggttggtacaatagggaagattggtaaactatccatgctattattccaaaggaatcattccaagcaaggctgcaaattatcttcccttcacaatctgaggattatgaagtgtagaggaggcatagggacctgcttcatggatatatgcagtataaatataaaatagggtttattggggaataacatacaagcaaagaactggaggacacataaaattttcgagcccttattattccatagatagtcgtgtttaaattggacatagctaaactggacctacctatggaagggattcacatttgtagagagaaagagcagctaggaatgtgtaggtgacggtaatggaactttttgagttgaggaaatgaccttgttgaaaagatagatactgccactaagcaactagaatgaggctgttcttacgttggacttagctgctgtgtcagcttcttgcctagctgccaaatggggcaaggactatctgaatttctgtctcagataattttggcaaagattggagaaaagacataaaagaaataattggacagtttatttttcaggttaaattagacacagaaacaatttgtcacaaactaaaagagtatctttattgattttagaatttgattctgatttaaaagtttcatgtttcttcatgaaagggagaaaaactgtatctttgcagaagaaaagagatgtcatttatttgtccagattcagatatatactatatcccaagagactgtgttaggtcctggaaactcactaaaaatatatagcctacataggagatctaaatatgtggcaaatagaaataatatcagatactgggagagtttatagaagaaaccgctaacttctgatggagtggtttagggactattggttggaggaggtagtagcaaataagagttttgaattacaggtgtgaactagcaagataaaaatcacacttcattattggaacagtacacaaataatcttgcaggtggtggaggggtgacagtatcatagacttaaagagctgcttcactttacttccacttagaagcctctggtgaaaccttatgtttgttcttccttatctagaacacttttaaaaaagtaaaccgtattaaagtataagattaagaaaaattcagaaatcctaagagtgtggttcagtgaatttttgcacaaagaagaagaccgtgtagccagcatatcccagagcaccacccgagaggcactctatcctgtctcccagttgtttccccctgccccaaggaaggtcattatcctgacttctaacactatagattaattacacctgttgttgagtttatatgaacagtgtgtcttctttcgcacaatattacatttgtgaaatttatcagtggtattgttgcatgtagatatatgtaagtatatcttgtacattttcattgatgtataatctattgtgtcagtagaatacaatttatgtatttacttttttctattgtaaatggacatttggattgttttctactttggtactattatgaagactgtaattttgaatattctcgatagtatacgtgaacacttgggtaaataggagtgcggttgctgagtcataagggtatgcatttggttagtagttgacggaagttttctaaagtagttctactggtttacactctgctggcagagtgtaagagttctagctgctccggtcttgagcaatactgggtactgtccttttcattttagtcattctggtaggtgaacaatagtaatttaatgttaagtttccatgatgtctaatgaaggtgctcactttttcatatttttattggccatttagatatatatcttctgtgactagtctgttcacttcattttgttttcttctaatgggctgcctgcttttttcttattaatatgcattctatataatcaggtgagtgttttgtccatgatatgcattataaatattagctctaaaactatggcttgccttttcactttcttttttaaaaattttattttagagacagggtcttgctgtgatgcccaggctggagtgcagtggtgcgatcataggtcactgtaactcaaacttttgggctcaagtgatcctctcatcttcacctcttgagtaggttggactacgggcatgtaccactagggccgacccattcttttatttttttgtagagatggtgtctcgcctagactggtcaggaactcctggccttaagtgatcctcctgccttggcttcccaaagcactaggattacaggcatgagccaccacaccaggcctacactttcttaatgttttaaaaaatcaataatattttaatggtttcccatttacctttttttccctttcctttatgagtagtgccttttgtgtcacgtttaagaaatctttacttaccataaggccataaagatattcttctatgctttcttctgtaaggactctttttttttaacctttcatgttttagacctgttatccatttggtgtttatttttgtgtttggtttgaggtgtaggggtcaggatttgttattttccagatggatatttagttgtcccagtacaatttattgcataaaaccatcctttcctcactatatgacagggttgcctttatcatgagtcgagtaaccatatgtgtgtgaaactgtttctaaattctctgttttgttccatttgattatttgtatatccttgcttaattctgcactgttttaattactataatttgatatctggtggtgtagttctgcaccttttttttttttttctcagaaccagctgactattcttgccctttttcagaatatccaaatgaaaccaagtgtcattgttcacttaagaaaacaaaaaacctactggaatttagatattttttttccactggatgtagggatctatttagggagaattgaaatctttacagtgtcaagtcttgtaatctatgaacatgtttgtatttcatttggttttcattaattctctccataatggctgatagttttcaaaataagtcttctacatttttgttatatttattagtagatatttgattttctaaagcattattaacatttcttctcaaattttattttctgcatatttgctgctaagtatataaaagtatacttaagaattgctagatgacatggtaactcttaagtttaacattttgggaaatgccagactgccaaagtggctgcaccattttgctttctgcctgccatgtgtcagcattctaagttttccacatcccagccaacacttgttattgtctgtctttttttttttttctgtgtaagacggagtctcgctctgtcgcccaggatggagtgcagtggcacgctgtcggctcactgcaagctccgcctcccgggttcatgccattcttctgcctcagcctcctgagtagctgggattacaggcgcctgccaccacgcccggctaatttttttgtatttttagtagagacggggtttcatggtgtcagccaggatggtcttgatctcctgacctcgtgatctgcccgcctcggcctcccaaagtgttggaatcacaggcgtgagccaccgcccccagccctgtcttttttattgtagccatcctgatgggtataaactggtatcttgtggttttagtttgcatttctctgatggctaatgatgttgaacatcttttcatgtgcttattggacatttgtatatcttccttggaaaaatgtctattcaaatcctttgcataatttttaattgttttttagttgtatgatcattttgaaagctgtttttattggttgtagaattctagattggcagttttattctcttagtactttgaagcagttgtcttccaacttccattcatttctgttaagaggccagcttttgatcttaaaaaaaattttttttttaaagataatgtgtctttcttttcttttgttgctttaaagccttttgcttttcctttgttaatatacatttttactgtgatggacccacaaggggcatgtgtcttcagatattgcttgtgtcccatttttttccttctctgggattctagttacatataacggttttgtatcccatacatttcttatgtattttgtcctcctgtattttttactctttttttctctgtacttcagtttgaatgttttctagttattttctagcaatctattttctagtaagcctttctcctgctttttaaaattaactgataaaacagcctagtacgttcttaatttctgataatatagtttcaattctagaattttttgatttttcatttttatggaaatggcccatcttgtcatccattttctccatttttaagcttttttttaaatattagccatagttatctttaagttcatgtctgtgaatagctatatctggattacctgtaagtccatatctgatccctttttctctttgttctcaattatacgatgcagtcttttgacatgtctagtggtttttaatgagccttcagaccttgtatgtgaaagagattatagaatcttagcatctccagtcttcctgctttagcagctttctgatgtctttaaagaggtatttgttgtatttcatcctgttttactagttgatttcagtgggttctttggtcttccaacaactactccctctaacctaaaagcagacatcctcatatacttaaaaaaaagaaagaaagcagtttaaaaataaaagttttttccaaaggttccaaaggtagagtacagagaacgatacttcaaggtttgctatattcattatccagaagtaacatatgtcagtgctgacacatttgttatatgtatttttatttttattcataaagtgaaaaaaattagagatttactgtcctctttataatttttcctggtctcttcctactttccttctcataaccactatcatgaatttacattgtgttttctttatattttttaacaggtattatttaatattgtttcaacatgggtttaaagttttacatagtgacgttttcatttgcacttgctttttcactcagtgtagtgttttgagatccatctgctctcattcaatacagctagttttaggaataaatattcttaattcatcaatacttctatcaaagaacaactatgttgtttctaattttttactgttataaatggtgttgcagtatacatctgttgacctgtctcattatacatgggtaaaagttgctctgtgatagtttcagaaggaattgctaggctgagtatgtccatcatcagctttaccatgttttcaagttgctttccaaagtgattgtactagctacactgcagtaagtttgtatgataattcctatttgcccatatactttgcctttccttctttctgtcttgtctgcctttcttttctattttttctgtctttgtccctttttaaattttattttattcttttttctggtcttaggaaagtgaaatgcaacctgtttttgtggtttgcttattttgtgctgggttgttggttttggtttttttctcttagaagttctttacatattctggatattaattctgtatgtattgtctctgtttcagatagtatctttcagtctttaccaaaacactttgtaaacacttttatgacgggacttaccatagtgttgtatattgcccttatttcagtagattgtgagcctttttaagtgtgttaagacttgctttatttcctaaatcaagattggtttttttaaatgttccgaatggagttgggtaaatatgtattctttgattgttggatgcatgcatctccatatatctttcagataactctcattgttgtgttctaaccttccgtattctttgtgactttttgttttttgttcattgagacttatcaataattgtatgtaccacaatggtggatttgtcaatttctctgtatattttattgatttaataatactgttttatacattttgggactatttcgttaggcttgcacatatttagaggtgatgtaccttcttggcaaattttgcaatacatattgaccatctttatcctcagtaaggcatgtttgtcttaaatctaccttacctcaccttgatatagctacatatttcttcctttccttttctttttttcttttccttccttcctccctctctccctccttcactccctttctcccctcccctcttttctttcttttctttttttttttttttgagacagggtcttgctctgtcacccaggccagagtgcattggcatgatcatggctcactgcagccttgacctcctgtgctcaagcaatcctcctgcttcagcctccagagtaacatgggtatgcgcaccatgcctggctaatttttgtactttttgcagaggtgaggtctcaccatgttgcccagactggtcttgaactcctgagctcaagtgatcctcccacctggccctcccaaagtgctgggattatagtgtgagccacggcgcccagccagtgttttcttggaggtctgaaactctgtgttatctttcaaccttactgtttccttatgttttaggtatgtcttttatagatagtatgagaggctgcatattggttttttatctagtttgatccatctcttaacccaccagtctagttgatgtttattccctgtgatctcgcacgtatttgcactagtttgcgtgatcccagtcgatcatataaatgggttagcgggtcccagccgtcgaaaaagccatagtgtccgcaaagaactctgattgcagctccacacagagccccccagggaagaggacatcggaagaagatatttcatctacctggcaatccaccaaacgtggaggttctgagtaagaatggttgagaagtcaccctgccagaggttagtcagtttctacctgatgtcttcaactcctatctccagcagagcttttgtactgcccaggtttcattctggagggcgtctgtctgcatcagcatggctgccagttctcttgtgatgtagcaggcattgagtgttccaggcagcggaggtgagaagcacaagctgaacccaaactgctgttttaaaaatttgtcttctcggccgggcgcgttggctcacacctgtaatcccagcactttgggaggccgaggcgggcggatcacgaggtcaggagatcgagaccatcctggctaacacggtgaaacctgtctctactaaaaaatacaaaaaattagccaggcgtggtggcaggtgcctgtagtcccagctactcgggaggctgaggcaggagaacggcatgaactcgggaggcggagcttgcagtgagtcgagatcgtgccacttgcactccagcctgggcgacagagtgagactctgtcttaaaaaatttgtcttctcataatcccactggccgatttcttctccaggctacaagcctccacatccctgaccccgtacattttccagcataccctctggggtttctcactttttcttcattattcctttacagatttattcaacaaatttgtttagcaccgcctcactgccacacagtagctttgttttagaagctgagcgtgcagcattgaacttttttcaacttatgttctactcagatgactggttttttttgtttgtttgtttttgttttttcagcaagtaatgcttgttggtttttttgcccctaacaagggcttgtaggtgttatacttcctgagtttttttatgtttgaaaatgtttattgtctttatacttgaagtctgacttggctaggtctaacgttctaggtataggccctatttcttttccccagaacatcgtagagatttggtcttctgactttgaatgttgccagaattctaacaccagactgagttttttcccttcttaaaagtcactcacttccttccttggtgtacatggtattctttctttgaccttgacattcagtaacttaatctgaatatgccatgaatttgattattccttatcacttttttgagagattgtatgcctttctgtattttattttttaataaatatttttcctttgctaaatgctctgggcttttttggtatcttcattatctgtcaacaatacaaacaacttttttctattcattttagttttctgttttgattctttgattttcattattgtgctaaaaatctctgttatgatttgattttttttctcttctcattcatttccgagccataccagctcacattttagatctgttatctctgacagtttttggcaattatattaagtatgagttaacagaaatagctttcctataaaattattttctttatttattttggtttcaccttccctggcattctacatttagaacaagattcttcacttatttcatgggcttctgatacttgtgaatcttgtagcactaatcagaggatcctctcagaggacactgccacttttgtgaagaactcagtgtgaattctctgaatccactttcattttcttctaaatttcaccaaatctggcagatgaaaatttgtagttagggattcttactttccttgaagaaaacccagtctcttttttagtattatgtatgtgtatgtatgtatgtgtccatgtttttagaggagtagagaggagtaaacatgactttattccattttgaatttaaaactaacttttgtgatttcttttgaagttaatataaagaatttacatcattttaatgtaattgaaatcagtttaaaaatattgtcttagaataataaagttgagtcttgagttttaattatgtagttagtattctgtagcctaattttagattacgttacctctttcatgtcaaatttatgaactgaaacgtggctgtattgtaaaatactaattaacactctactaattagttggcttttactgatttttcacttttagatgtcttagaaagctagtatgtagaaggaaaatctctgtatgacaaccaaaaacttactttgaactgaaaacactaaaatcaagggaaaatgtactcttaacagcttgttttcttgctttgtgacttgttatattttgttataatctaatcttctaggcatatactcatgtcataagtgatagtatttttcattcctttccttattgctttcctccattgtattctattttgtttttgtttgttcccaaatgtatttgtaaaaacaagtacatcaacagatgcggaggtttttctacttgtaatttctgttttatattgagaatttttttttttttttttgagatggagtctcgctctgtcgcccaggctggagtgcagtggtgcgatctcggctcactgcaagctctgcctccagtgttcatgccattctcctgcctcagcctgccgagtaggtgggactacaggcgcccaccaccacgcccggctaattttttgtgtttttagtagagacggggtttcgtagtgttagccaagatggtctccatctcctgagctcgtgattcgcctgcctcagcctcccaaagtgctgggattacgggcgtgagccaccgtgccctgctgagaattttaaagtatcaaatatagaccagtattcaaagatgattcataaaaggtgatttgggtatatgacacaatttacatgtaaatatgtatcatgaacagactagatggtattggctagttaaattttcttgttaaatgaatatttaaagaaccttctcaactctattttcattcagtttactagctaacagaatatttgagcggtcatataatacgtggagtattgtgctttgtgcacttgacaaatacagagaaaacataaggttttgagactgttaaagagattagatctacataaaattaagagggattaaggtgattaaatgctaagatgagtagatgttaaatgcatttggtgttactatagggagaaaacagatactctgcttaaatttagtgaaaaccattgaactactataccactgtttaattttatcatgctacataggaaatagactgaaaaaatacagaaacatcattgaattgtacatgtgaaatgaattttgttgttgttttgcttttacatgtacgtattgtatctgtaatgaaagaggatattaaagtcatgcccgtgaaaaaaatttctagtggtagtaattgcttttcatgatactggagatcctctacttctttaatagctactgcaataactgattttaagtctaggccagtagttaaagtttataggaagaaaatcgtatgataggtatccatggggaaaattgctgaactttatgttgttgcacaattccaaagattattcaaaagtatattcttactgacctttcaaaaactgttttttaaatagactttatgttttagagaagttttaggttcacaacagcattgagcagaaagtaaagagagttcccttgcattcctttcccatcccgtattagaagaagagggatcaagggtaactcttgctcaccccaaggagggttgttgggtggtataatttttgtatggcatgagcttcagagtatttgaagtttttgaaggggagggaaagaaaagtagtgtcgaagagagaatacagagcataaaaagacatctcttttagggccttcagtcaatataaagggtgtaaataaaaaaattttttgggggggtctctgttagagaggatttcaggtaacaggtttcagttaaagaaagaaacagttaaagaagaatttgaggactttggggaatttgctgatcccagactgtgaatttcagtgggtacaatagagaagggcttgagagggaggagaaatacttcagattagtggatgtatttagttgtttagggatcaaagtctggctgatgctacattacgtggctgggatttggggtttctgatggtaacaattttaactgaatgataagggaacactgatcaactgttccttctgtggtgcttcaccctctgtagtggagtggcagccaaggataaggaaatacttccccaggagacagctctgtcggagaacttggcatatacaaaacaaatgtaggactgtagcacaacaggagagggaaggctcatatggaggacaaagctgggaaccttttccatctttgaaatctggctcagtattaagaagaagattcatcttcagatagcccatattcaagtactactaatgcttttaataaaaatataccttttttattgtttaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgaggtaacacatatctagtaatacgtgaattgcaagtaatactgaaatattttgtttaatagcattaactgtcagaatgacttgtacatctaaaacataaattaggtgtatatgtatcttttctctaaatcatttcttagaagagtgattgctgtatggcgactcacttgtgttataaacatactctattcattcagacaaagtaaactatgttgttttaccatgtataccagcataatcttaacatttcatctatgattacttattttgtatgagttttaaaattaatattgtaagagactatcatttttggacagtatgaagttacagttttggtatgtcttaatcatttcattatgtcattgacagctcacaactttaaacacttaagaaaacaatgacaattatgtaaataatatttgctttgttaatagtgttttagttgggcaacaggagaaagtcctcattttctttgtttatctgctgcctatttgatagctctcatagttctcccaacctaattaagtgaaaaagaaaaggatttattattagaatgatcttctcagaaatagtgttttacaataaaaccttcaaaatggaaaccagtatgcttccccctttttatcttctctctttcaagatcttccataagataacttttccatgtgtatttctaatcacattttaaattagcttcatagttacttttgtctcttttgtttatatttggaggttttatatttattcagtggaggaattttttattacttgaaagatgcatattttggcttagtttgtaatagaaaagtattaggcatttctttggtgaaagtactgaaaccatgtgaggattatgtagaacaattgaaaaagaacaaatggagtcctaatctagatggtatttctaatatttaaaattaaagataatttagctgttttgttgtataggaatctaatttatttgcctcctcaagttgttattgttccgaaaatgcattttaaatttcccctatacttctttgccttaactgtccctctttaggcagtgattgataccattactacacacataaaaactattacttgtattttaaaaacagcttttgttactttttagtcattttttcaaatgagaagtaaaggtatagcataattacagctaggactcatctctgttgcttgacttatccatagttttatttatggggctcactgctgttaacctcccctgaattgtatatgaaattttttattttgcttttgttgataactttgattaaactacatggttatatctttagctaaaccccttaatgcagttatatttatgtcatttataaattatattatttagcagttatgttatatgttatcatttatttataatactgtatagtagacctttcccctattacatgtcatgaatacattttgtattgtaatattgtaaattagggtatcattcaggtaagctttgttaagagacttcataactggatttccttgaaatggagagtaaccctgttgtgtttaaaatagcttcttatcttataaatctatatgtctcatcaaaagttacactgcctcaactcaaaccaatggagctgactttgataatgtcagcaaataagtattctagctaatttcattatagaggcaaccacctccttaaccctaactacactgctctttcattgcagcagttgttattcttggtccgtggaggttgagggtacttcacactgcctaaagcttacttccctagagaatacggagaatgtagtctgatttaatcctcatagaattttcagactacctcaatcttcatctctgttgtggacagcaaagtgtaagagagcagatcccaaacatttttttaagcagtctcctatattacagtctgtttcaatatgaaggaaaacttttgcggctcaattacatattgggattttgatgttttctttttaattgcatttcctcaaaataagttaaaatgaatcgtgttaatagttccttgtgaagttctaaattatataaatacagtagatagaagacacattagattattagggattaatttattgtggtaggataaattacaaggcttaattcacacttcttgtatattaatgtcttactgagtcaacttttattaagagagtggttgttaagcttgtgagataggccttttttcacatatgaagatgatgcagcctacatcttcactagtagtgcaattcacatacgagttctttttgccagtagtgtaatggcttacgctaatgcatctatacagtttgctatggttcaaattaaatttacaggataacagtaatgaagttacttacatagagcttcctatgggtcttagtttttacaaagtactttacagttgcctcattgaaggatatttttggaataccattttttccttttcacagtttcctttcaggcagttgtattgatgggaagcaggctttttgatgcccatttactcatttgacaaagatttgagggggttctatgtgctttgcaagttgatcttatttagagattcctaattcaggccagaagaatattcttcctacccatatttttataaaccattgaggtatacttttaccaactgaagattttatgtatatttataagaactttgaacaagttggtgataagcttctggactccttagccatctcatgtggttgaaaacatcaggataaaatagaggcatgaacagttataagtgatctactttagagtgatttctaaagtatatgaccaatatacttaagagtttgtgtcattatgtaagcaataatgacacaaactctgaaaacaacaacttccataaggcctataacctgactccacatatttccgtttgcatatatgttagtctttaaaaaatcagcaggattttactttccctatattactgaaatatgctttgacagagtcttgagtatattaacatggcgtcttcattagatgtgttcctcttctgttgcatccaatacacaagccctttgaggatgtgctgtgaggatgtgctgtcagcctcacctgtgtagtctgtagtacaggacgcacgtgtattaggtctgcggagttagatatagtgtgttttgtgggagtactgtaagattaatataatgtattaaaagtagttggtatttgaatattgttgattataaataggtagaaatggtgctcttatttttctgtgtttcaattttatgtataaacttaaatccatctatctttgttctgcctcattttatattaattatgtttttaaactagttcttaaatttaaaattttaatcaattttttaaactttggttagagttgataaaatttaaaaaattctatacaggtttatttttttaatttgtacttacatattttaaattgcatttaggtattttaaattaaggtctgcagtgtcttgaggatgtatatatcccctacattaagaaagctgaatatatgataaagcagacttacacattagtaaattaagagattgccattagggtaagattcataagagacttcataactcaatttctctgaaatgaagaatatcattgctgtgtttaaaatgtttccacactgcttttcagtagtatatttcttacaaaacatgagttttataactttatttcccatatttcattaggtgacattccacaaagaatgttgtcaaagacacacattttatcttttcaagttattaagcattgatacaaaaataggtggcagacttttgtttggtcctataaaatgtagtaatttaatttaaatgtatgaagaaaatgttataactccttagtttttcttttcagtaaaattaagattaaaaattatgaactatattatataattttacaggaatactaggtatgtcctagagtgtaggaaactacagatggaaattaccaacacaagcagttgccattgttcatacacatgcatatgtgtgtaatttgaatttatactaaataaaagcctagagccaatagaggctttgggattctgcatcaaaagaacaattatgctaaaaggcaacaaatgatacctaaaaaacacctgagaatacttttgtatccatgttttttcctgtcatttggcagaaatattgaaaatactaaatatttctgcttataattttttaaaaatagccgtgacttggtaacattcagaaatcatttgtatggcaattcagattattgtgctgtcatttaaggatgtaaataaaagggtcatggccgtttgtctctcttgttaatatctggtgcactattcccaaagagaggaggttttcaccacaggcatactacggtacttaaaaaaaaaattcttctcgcagtatctcatttaagcttcatattcaaggtaagctttttcagaagcaaaaattgggatgcacattaaaatgacttgcccagagtcatgtagcaatgtagtggcagaaccaggattaggacccaggtctgtgacattaacctttccccttgctccttagttcactgcatccaggggagctctggagcattttaccgtaagtagataagattttatacatacaccaatcatgtacgatctatagcagtcacgaataagttttcctcagtaatgaacagaaaactagtgaggataatagcagtaagaatgataggtattattaagcacttaacatggtctagtaaagacttcatttgaattatcttattgaatccttactgttgcccttatttcacattgaggcaatggagacacagtgataaattaagtcagatgttgataatttggattctgaagaaagagaaaatctgtttgagtcttaaaaatcccttcctattttcaaattacaaaagaatttggaagtaacatctgaaagaaaggaagatagggaatcagtataagatccatctatcaattagaaaataaaagcagatggtagtgaaagtgattatacttgagagtaccttatttaaaatcactggtcctcacaatgtgtagtgccctgaccagcagcagcagcagccccagaggcttcctagaaatgcaagttcttggtcccaccttagaccttctgaatctgcagcttttgagatgaagccaaagcagtcatgaattaatttgaattaacttgccttaagtgcagttatagactaaaagtttccagttaacagtttcttgggagtggttatccagctttttaaacatttttatccccaagaatatcccctgaaataatttcaaacaaagagcaagcacaaactgtaattttttaaaccctctaaaaagtaattcaaactatgcagtatttgtgtgaattgcacctaaggaatacatttctaatgggttacatttcagttcgattccacatggttataagagcttgtgtgagtgtggtttctttgaggggtgcttctttgagaggtgtggtggggatgagtcggaggtggaatctggctcttcagatgaacaaaaaagaaagttaaatgacctatctcctgagatcatctagtgcttgaccttacaaaagtagaagcatgattatgcttggattttctgacagtatcatgatattctcaaagaggctttttgagccagtcctcttttctccccatgttatagacgaggaatggaacagacagggagtatttaagaggcttgcctaatgttttacagggctgcagtggagcatcagggaaagggaaaaaataatgagacatctgaagacaagacaaagctttcctccacctccagtcccctgccctgctcttttattcctaacagagcctgaagcagcaggatgatgattcacagggtgaggcacatagtcctcatggctctcctccgcttcccacatgtcactgcaccatcgcctcacacagcagtcaccatagctcttgtaatttcagttttactacttttattttgctgtgcatgtgaatattatttaatcatacaattattggttttcatttatgtgctttgtataagggactacacgtctctaagtgtggtttttcttgaggtcatattattctccattagaggttcatgtcattgatacacaaatgagagttcatgtggggaggaaaagatgatagatatcacttgtatatataactgaacttttttctgtaatacatttcttgtgattattgatggatacctccctatgtgttctttttatgtcatatgtgtcagggattgaatattttattaatagtacttaccatcagataaagtgttcctttttctccagaagatatttgatgctttggtcaaatttttgaccaataagaagaggagataaagaggatggagataaagttgctctagaggtgatgctatcaccagagttctttaaagcagcagtccccaaccttgttggcaccagggatgggggttgggggtgggaggaatgtggacagggagatggttttgagatgaaattgttccacctcagatcatcaggcattagattctcataaggaatgggcagcctagatcccttgctcgtgcagttcgcagtaggtttcattctcttacgagaatccaatgctgctgctgatgtgacgggaggcagagctcaggcagtaatgctcacttgcccaccacttacttcctgctgtgcaacctggttcctaacagggtctgtggccccgggggttagggacccttgctttaaaggttatggtaggtggaaaacaaagatgctctaggtcagaggggcagcttatatggaaattaggaaatgagacactgcagttagtgtacgaagttgaaatcagccaagtgtcactgtagtatactgtgaagagtggaatagctaagacctgagaagtaaaccaggtccacatgagctatataaggcccttcactttatcctgcaggtttggatagccactgaaagagctgaataaaatagctgcttaggtttctccttgcatttcccaagcagtaagttgtgttagaactgcgtggtaattttttgaagggagttgaagaaaaaggaaaagaggtaaaaatattgaatgtaatagttctacattttaaatttattgtactgatgtttgtcgtactatgtaccaggcattttgctaaacactgggaatatagtggtaactggccctattgctgcctttttcctaataagatgatatgctggctattttattatcttatggcagaagtgcttttgttagatacacttcaatatcgacttaagacccttagaatgccaagatttttatgtttctcatcagatattaatcattaagcatataactattataagataagatattatactgctattcaagccagaagttcatttagggcagaagatactaggtgcttcccgtgtttctcaatgttctgtgtcagcctgtaaggtgagatgtatatagtctaaatgatctttcagttctcttatatatagatgggtaatgcggacatgcagttttgtgaaacctggcacttcaaacacacaatttaaaattaaagagacagctgtatagttttcatatttattttgaagttatttttgtggctctgttctcagagagagactagggatctagattctacagaaagacaccttcttgcatagattagtcataactcaactttttaatttacaattatgcaatcagtgctgtactggtaaaagaaattccaaatgatagtatgaattatattttagaaaatgagacataccttataattttctaggtttttgtttagttggttgattttcaaatttctaacgtgtttcactgattgtgtatgctaagggtattttataaagaaaatttgatatgggattatggttttttcctcaaataatgtttcttgtagttctcattttaattcattagcagtaaaacatgagaaggtaaaccttccatattgtttttaaaatgttagtgatttttaagacttggtaaataggcactacatgcttaagccttctagaataacccaaagctttattatgcacgttggactttatctcctgtaactcagtggagaatatttttctgtcatgctttgtttttatataaattttcttttcaaatatctggtttattttgtggtaatttctgggcttaagtgttatttccagaatgtatctcgaaaactttaaaaatgtttatgctctgaaaaaagaacgtagaagtagcaactagtatttgtagaggaattcaagacattagcttgctttttttgcgccacccacgttcatataggattatcccataatattatataattaaaatatttttattgtggttttccacatttatgtagttgaattaagtttttaaaaatggtttcgttactttggtctcttataaacctatcagttttgtgctgtaggacagtataaaataatgttttagatattttgtgaaagttatttgatattagactctcaaatcctacttaatatgtcacttattagtaaagtagatatctgtatttaatattctaactagcatatatttgctatattatccatttatttattgaatggttagtgtactgggttactaagctcaatgtttaatagggcagagagaacagtattaaaattttaaatcttattaagttttgatgatcagttaaaataatgtatgtgaaagcattttgagaactataggttgcttctggatgcaggcaacagaagacctcactgaaattggtcttaaaaataggggtattgggggacagagcgaggctccatctcaaaaaataaataaataaataaataaaaataaattaaaaaaaaaggggggggtattggttatttcatgtaagaaaaattccagcagcatggtagagatttggctgtgttcaagcgggctccaggtctctgcctttgcccatgcatcattgtcttcacactggctttttcatgtcgataaaatggcagtggtagctctaggccttatatgtgaacacagcatcatataaagcagcactatctaatagaatttgttccatatttgtgctgtccaatatagtagccattaactatgtgtagttattgagtgtgtagtgcaactgaaaaacctgagtttttaatctttttaaattttaatttaaccacatgtggcgattggttactatattgttgagcatctatctaaagtatcagagatcagttgtgtcccagaatccacagcagatgttctaaaattaattctaattgtactgtttaaatcgcttgcctctccatctcccactctgaaaacactaaacacagtggtagagaaaggatagaatatcctgattggcttattgtagctagatgttacacccctgggatttactacaaaactaaagtaattcagtgtggtatttgcatagggataggcatgtagttcaatagaacagaatagagagctcagaaatgtacccacatatacatggttaattgatttttgacaaaagagccaaggtaaatcaatgagaaaaggacagtcttttcaataaatggtgctggaaaacctggatatccatatagaaaaaaaataagcctcagtatttaccttacatcatatacaaaatgtttatggaatagcggctttgcataggggagtaatcaaaggtaaggaagagacaaattgaatatagttgatagatggtcttgaatacccagctgtggtatttaatatttgtcctataggcattgggcagcctttagaggggtgtttaaaagttttaagtagtcaagtcattgttacaggaattaatctggcagcagattagcagtattttaaaagaagtgtgtagcttttaaaactaaactaaattatctcacttattactcatgataggctttagtaatgttgagaattatagaaagaggaatgcaattccatttggtttgaatggagaggggagattaaagtggggggttaggccatgttctaaggaatagaatatattgacacatcatgctgtttaaaaattgatttatagaaaatttgcataattgtaaaacatatatattattatagagagagagaattgacctaataatgctgtgaaaagtggtttgtgtgttataaaacagttaggaaactctgatctggctctctctttcatttaactgatgaggaagccgcgtccaaattgagcaagaaagactgtagatcctttgaggcaaagacttcgctaaggaacattagtatttttcacagtgctcagtaaagattcagcacacagcttaataatgacctataaaatggaactaaaggtagtgttgtgtacttccgcattcacttaatcataaattaagagtatttatgatactcagttaaaacttcatcaaatattacaaaatctagtagggacaaaaatataaaatatgtttaagttgaaggaacactcagtgtgtaggaggtgattctttttactctgttaacactggaaatgataactttatttccttatctccccatcctccacatctactaacatatattacttccagcctttagagaagtaaatgtacttaaaaagataagtatagaggcctctgctgtattgcagtgtatgcattcttgaataatctcataaaccgcaaaacctatgcagctttgtattctgcacatgaacataaatgataattggagggatagcttgaaatgctcagtgaggcatcttagtagctagtggccactatggtgggtcctgtaaatacacaaaattacttgaatagaaatgctggcagcacttgaattaggatgggctagtgcatcttaggacaatatgatatgatttccagtgtgataacttcatgattggagtatacattcccagagctttcagtaacctaattaatcaggttaatactgtagtagtactgtcacattaccttgtatctttataaataattgctccagacatccttaactatcatgtgaaattgaatgcatattttaattgcttattgaaatgtggtaggcatacctgagattaacttttttgctcttcttttaaatgagatataattcgtataccataaaattcaccagtgtagattatgcagttcagtggttcttagtccattcacaagttggtacaaccatgaacgctatctaattctagaacattttcatcaatccgaaaagaaacccagtacccattagcaatcacttaccaactcctccttcccctacatcctggcaaccactaatgtactttctgtgtctatggatttacctgttctgggaatttgatatagatggagtcatgcaatatgttcttttgtccagctttttcacttagcataatgttttcaaggtccatccgtatggtagctgtatcagtccttcattctgtgaccaaatagtattccatttgctactgtgaagtttgtatacaagttttggtatgggtataagttttcacttctcttgggtatctagttagtagtagaatttcctggattgtgtggtaagttctgtgtttaactttttgaggaactgccaaaccctgtcctacatctaacttaaaaaaaaaaatagcaaaaacatcaactaaaaccaataactttatggatattattagaaaatggttgattttttttaaaattttgatattgttgggctaggttatctggatcaactcttctgttgaagacatctaaaaactagataaactgtaaaaacagaacaaaaaaacttttttacgttatcaaagagctcaaggaatatgccaggccaaaatttaagagaaggtaagaacataaaggtaaaaaagtatttaaagttctaaccaccctgaatcatttgcccatctggataaagcagtttgtaaaactgagatttgggttctgatagatttgggttctgatagattcagaatcaaggggaaaatgatcacttctaggtttatgagcctaatagatacccccaaaaccctttaaactggggccttaagaaaagaggaaaatccactgccttctcctgctcccaaaggattccaaggagagttatttagtactgagcagataggggaaagaagagaacacgaaaagaaaaatagaacatatctgacagattgtaaaccaagttaccagcattgtgtggaatcgtagttccaagtcatataataccagacattcaagaaaactagtgccctgttaactgggggaagcaaatttatatcctttttgaagaaagtcaccttattctgtgtatcagaaatctctttcaaataacctttcagaactatagagcatcatacaaagatgaccaagcatacaagaaaacaaggcacagtgaggaaaacacagcaggatacagcagaaaatagctcttatatatttcagatgacattgttattatatgtagattatagaacagtttcactttctatgttttaagaaataagcttgaaaatatcagtaggaaacaggaagttatataggaattgacatagcagagttgaatgaaatacttcaagatgtgaaaaaatacgatgaccaaaactaattaatgcagtaaacatggtggaagtagattttccataaccgcagagagaatttgtgaaccaaagatagaagaaattatctagaattcaatgcaaatattaaaaggcagaaaatatcaagaaaggtttaaagaaaaggaggatcatgtttagaagttctagcttatgcttaattggcattgtagaagacggaaacagagaatcgggtagaggcaatatttgatgagataatgacacaattttctaggattgatgaaagcccaccatccttagatttaagaaattcaaatcccatgcagagtaaatgtgtaaaaaaaaaaacaaacaaaaactctatatagacatagtgaaactgtgcagaaaacaaagacaagaaagacgtaaagaaactatcctcaaaagagtgctatttccaaataacaaatgaaatctggagtcaatgaaatgatatcctaagtgtgctgtttaggaagggagtagaatgcaacctagagttctatacccagagaaaatttcgacagggaaagcataacacctgtatatcagtgttacaatcaaaccatctactgctttggaagaaagggccaagaccaagtcaggctgccatggtaagcagtcttcatcgaatgaccagatgatctctacagtcttcatgtggacgatgatctatgtctaatttatcagtaaatatcagcatctagtagggtgctttcgataaattttgttgaatgaaagaaaaaaggcaaattaaggtatttattcagtaaacaaaaagggatagtgaagaaccaagctccaggacttttgaagatagactttcttgtctgtggtgcactgagaatcagctctatcttagtattcatttacgtgtggagatctagaacagagttacattctttctggtgacaagctgagactacctggctgctcagtatccagctcctgggagacaagggcctcaaaactgttgggattggggggtggggcaggtagggaatcttactaccatttgttaggatttttaccatcaaacctaggagtagcttggaactgggtaagatcttagaatttagagaagccatagcctgaacaccacacacttctcactgaggaagataggggtgataagatcatggaggaactggagaggaatatgaagacagtgcctacaaccaccacatacacagtaaacattctctcttctcagtggttgaagttgttcctgattacagctctcttatctgttctccctttgatttgctgactgatggatgcagtccatttaagaaatgagcatagcatattggaaagagcactagacttagattctagtcccagttctgtcacttaacagctatgtgttgaggtgaggtgagggaagagtacttggatctctggatctcttttaactttaatattctcctctataagggtagaagatgaactagaggatcacaacagtaccatttagttttccgttcagtggcaattttgacatacttttttgagcatacataatctcagaatcctatgcctcaaaactttgattcattggacagatttcaagaaaaatataatttaacaaatgtaataaagaaaaaatagaaaaattgaataatcttgtcaagttttccacaaaactacaagtccagatggctgcataagaaaatactagcaaatttttaagaaggaagtaattccagtatttcacaaacccttccaaagaatagtaaaaacaaagagctttcctttcctcgttatctaaaattagcctaactttgatagcaaaaccagctaggagagttgcaaagataataatcagaagccagtctcactgaacataaatgtgaaagtcttcagcaaaatattagtctacttcgtgttcacatctttcttatgggagacttttttgtttgtttgtttttgagatggagtttcgctcttgttgcccaggctggagtgcaatggcgtgatcttggctcaccccgacctccgcctgggagacatttttattttcagaatgacccattttctctactgtttgggcacaaaactagactctgtattagcctcccctgtggttaggagtggccatgtgactgacctctgaccaaggagatgtgagtgaaaatgatgcaggctgcttccaggtgtgaccagtaagatacttcccacataatcttcgtactctttcttccctgtttggcatcccatgtgctaagaatgggaaccctgaggtcctatatgtggaaccataaggtaaatgtctttgggctctgaatctcacacagggctcactgagaataagaaacatccttcttgggctttgtatgaataagaaagaaataaactttcattgtgttaagccactgagatttatggatttattaaagcatctagcattacttatactaatacagagattaaatctagtgatatgtagaagagataatatattatgactaagttgaatgtatcctagtagagttataccatattcatagatcagaagtctcaaattatatatatctgtgccacataagataatctctgtagagttgatgaaatatcaatcagaatcccaagaaatactttttgaaagaacttcaacaactgattctaaagttcacagagaaaatagaacagaagacactgaagaagaacaaggtgagagggtttgcactgcaatatattgagactaattttaaagctataataatgaacatacagtggcagtggcacaaataccaaatgccaaacgtaccaatggaataatagctcagaaacaggaccatgcatatttagatacttaatatatgatagagtggcagaacaaactccttaagcagtggtatagggacaattgggtatccatgtagaaaactcatgaaattggacttacctcagattttatacaaaattacctccaggatgcttatagacctaaatgtaaaaggcaaaattataaagctatttgcaggataatataggagaatatcttcataattttggaaaggatttcttatataaggcataaaaatcactatcatatggataactggaaaggaaaaaactgataaatttgactccgtttaagaactctgcatccaaagataagcgtttttttttttttttaatgctacataatgggaagatatttttacaatgtataaaattagccaagggcttacattgactacttataaaataattactataaaaataaataattaaaagaactactataaaacaattatcaaaaggcagtagaaaacttagcaaagtacttgaataggtgcctcacaaaagagaacatccatgtggcctatagatatgaaatgtgcttcatttcattagtagttggtattgcaaattaaatcccacaggtaggaatgcatattgatacaattactttaaaagacagtttggcattatctagtataactgaagatccacatgttttatgaactaatacttctattcctaagaatacatacccaagagaaatgtgtgcacattatgcagtagactatctacagaaatgtccacagcagcatttttatagattcaaaagattgaagccactccaatgtctgtctgttgtagaatggataaagcttttttttcaagccatgtaatacagtatttagtgaaaatgagccagctataactctgtgtaactctatggcggaatctcataaacagtgttaatactgaatagtgtactgtgtgtggttccatttacatatcattcacaaataggcatagctaaattatatttttagggatatgtatatatgtggtaaatgtataaagaaaatccagataattgtcatcacagagttaggatggtattaactgtaaaggtgggaggagagggttatgggatgaagggagatagggagggttctggccttggtctatttttttgacttgattgaaatgactgatgttcactttataattatttgttgaattttatataaacttgtacataccttacatatttcacaatttttaaaaattgtttttatgtgttgtcagagtagctagaaagaatagtatatgtttcaaaattggaaataattatttacaatgaggaaagacaacttttctcatttttaaaatatcacaataatctagtttcaatttcctgaaacttaagacatgatttcttttttcctcttttttttttttttgagacagagtcttgttctgtcacccaggctggagtgcaatggcaccatctcagctcactgcaacctccacctcctggggttaaagcgattctcctgcctcatcctcctgagtacctggaattacaggtgtctgccactacgcccagctaatttttttgtatttggagtagagacagggtttcaccatgttggccaggctggtttcaaactcctgacctaaagtgatctgcctgtctctgcctcccaaagtgctaggattacaggcatgagccaccgcgcccggcccaagccatgatttctttattttacaagcacttgcttatacttatgctagatttactgactacttagccggtgtttatggagcatgtactgctcagctgtgtcatagcaatgagatttaaggtgggtggtcaaattttttgtgggtttatttaattgatttaaatcagttaactcctcatgcatttaaaaaccatgcatttataccttttgagtagttttaattccatagtttcacttgtaagtgctatgattctattagcttggaatggaatttggcaataataaagttgagcgtatgttaattttttttttcagttcttggtaggcaggagttaaaagtgcaggcatgggctctagcagatactccagcagtataggctcttcgatccaaaatgtagtgtcatatgtcaagattccagaaaatgcaagtcccttgggatatttataagttcttatttaagagcccatatgctttaaatatttattaaacatatttagaaagataatcctgatttatttactctgtaaacagatgccaaagattatagtaatatgcatttgtgcacgtatatatatgcacacattatatacggaaatggactgcacttttaactcctgactaccaagaactgaaaacacttttaacatatgctcaactgtataattgtcaaattccattccaaacaaatagaatcacatatatatatttaaaattttagacaagcttattttccatggaagtttttatgtatataaaactttttatattttatgtataaaagttttatatttaactattttttatatatgtataacatttccatggaaaatgtggctaaaattttaaatatagaatttcttgctgagtatttaacatgaaagagcataagctaaaagaaacgcattttaaatgagttgccctgcctaattagtaattcattttgaaataaatttttgtaagtttattatgtaaaagaaaacctcaacatacttaaaaaaaagtttatacagtattgtttttgtcctctcaagtatcttttttctttcttttttcacctcttcccttaatcctttccatctctagtttcaccaagaggtttagtatataaaccagaaaatgagaggcagatgtacagggtcagccaagtggtaacatatacccagaattctgtaaatgtttccttgaatttgaaaggtaaggttgtcagtactctataagtagaatgataggacgtatgactttaaagatttttgttggggtagataccattgtttcaatcagttatctttgaccaacaacagtaattaatcatcacttctaggtttgagactctttctggattctatgttgtagaggtactagccagacttattttgagaaatatgtgacttgggtaaagagactaataatgtgttacctaaaggatcactaacagttttcttcctcatgcttctttgattataagggatagaaacccatttaaagtagctccaactaaagaaagaatttgttgaaagaatgcagacagatagcactcaaaggcaagaggcaggagtagctggcttcctgaaggccggacaccaggaacttcatattaagggctccatggtctctcatctctgccaccaaggctggtttgcaaaataactctccttgcaagcacaactgataatcttcatgtagaaatgaattgatttaaaacaggtgagaaattcaaaatgatattgaggggaactgaattggtaacaatttatggaacagatagaatggagagagagaaaagtggaaaaaagatataagagtctagacataagatagtgcaggcttgagtgagtatggggacagtagaaatggaaataatatataaaatttggtattccatgtgaatgtagagagagaacaaagggaataaggtcgactaggttggtaagtccaaaggagagaccggtttaataaaagataatgaattctatggcagttaagttgaaatagaaatgttagtaaaatatccaaatgaaagtgtgcagcaggcagttgggattataaatcttccaagttgcagattagatttggatgaaggcataaacattactatcataaaattataaaatgaacatattagagattttatttgagtcattaatgaatgagggaacagtaagatcataaacagaggagaactcaaaaatataacacatttatagttaaagaatgcagaagtaaatttataaatagaaacaaaagtggccagtatccacagggtgacaatcaatggtattccacaggaaacaatttctggaaacaagaattatttgcagctactacaagttttctataagttaactaatgtccatctctgcagtgttgtaaaatagcctcatcaaagaaacggaagtggatgtaactaacctaaatggaggttctagccagggcactcactaagtttcaggctttcattgtttttccttaaattggtatggaaattttaaactcaagagccttcctactactggagtgtttggtcagcagtagatagaaagaaaaacaagcaatggggaaaggattccctatttaataaatggtgttggaaaaacgagccagccatatgcagaaagctgaaactggatcccttccttacaccttatacaaaaattaagatgggttaaagatttaaacgtaagacctaaagccataaaaactctagaagaaaatctaagcagtaccattcaggacataggcatgggcaaagatttcatgactaaaacatcaaaaacaatggcaacaaaagccaaaatagataaataggatctgattaaactaaagagcttctgcacagcaaaagaaactttattatcagaatgaacaggcagcctacagaatgggagaaaatttttgcgatctatccatctgacaaagggttaatatccggaatctacaaagaacttaaatttacaaaaaaaaaaaaaaaaaaaaaaaagccatcaaaaagtgggtgaaggatatgaacagacactgctcaaaagaagacatttatgcagccaacaaacatatgaaaaaaagctcatcatcactggtcattagagaaatgcaaatcaaaaccatcatgagataccatctcaagccagttagaatggtgatcattaaaaagtcaggaaacaacaggtgctagagaggatgtggagaaatgggaacacttttatactgctggtgggagtgtaaattagttcaaccatggtggaagacagtgtggtgattcctcaaggatctagaactagaaataccatttgacccagtaatgccattactgaatatatacccaaaggattataaatcattctactgtaaagacacgtgcacacatacgtttactgcggcactgttcacaatagcaaagactgggaatcaacccaaatgcccatcagtgatagactggataaagaaaatgtggcacatatacaccatggaatactatgcagccataaaaaaaagaatgagttcatgtcctttgcaaggacatggttgacactggaaaccatcattctcagcaaactaacacaaaaacagaaaactaaacaccgcatgttctcactcataagtgggagttgaacaatgacaacacatggacacggagcggaacatcacacactggggcttgtcagggagtggggggctagtctagggatagtggtagaagtacgtaatgtagatgatgggttgataggtgcagcaagccaccatggcacatgtatacctgtgtaacaaacctgcacgttctgcacatgtatcccagaacttaaagtataataataataataataataataataataaaaagatcagcaaagaaaaaaaaggaaggcttttaaagttcctcttcttttagataaaactggtttaattaatgctagacaacaaagcaaaaccttctaagtttgatttgggcatttacaacacagaaatagtgtggatatgatgtagggattccttttccctagaaatatttttaggcagtatgccctcctctcttcctccaccagcttgaatttcattttagatcttaatagcttccgacagaaaggaaggttgtgggatttgctgttttagacagttaacattcttaatgctgcaatataaataacaatttatgaattaccacaagaagattttgaagatgagtattgaaaggccacaggccctgtcttgtcatatttcatcgatacttgatattataacgaatacagattaatcaaatatttttagaaaattttaaagaacagcatactacttcttccttttaaaaaccaatacttgctccaataataagttctatcgagggttactaggaatctcttcctgagtttagatctgaaatcagtgagttgggtggtttcacactcgtaagtggtaaaatagttttgttttttggtttttggtttttatttatttatttatttatttgagacagagtcttgctctgtcgcccaggctggagtgcagtggcacgatctcgctcactgcaagctccgcctcccgggtttacgccattctcctgcctcagcctcccgagtagctgggactacaggtgcccgccaccacgcccagctaactttgtttttgtatttttagtagagacggggtttcaccgtgttagcaggatggtctcaatctcctgacctcgtgatccgcccgcctcggcctcccaaagtgctgggattacaggcgtcagccaccgcgcccggccgtaacatagttttttataaaggtgattatatcaagtgaacatgagtcaaaaattttaagtaattaattagtgagggagcctgaaaaaaatgttgcctttgtaaattcaaagatcagacaaatatataagcccaccaagaaggccaaatgaatttgcttcataaatacaaaaactggctcttccacagttgagagaggaagtcagttgaacttccaccaggcgggatttgtttgcacatctacaaacacaaattatttgcattactctcacttttctacacattatcttctgtttacagagttggaaaatagctcagaaaccaaggtacaaaccccctagaatcagataacttggcatgtgctctaaacaatacagagttttaagagatatttagttttttgggtttcatttaaaaatatttcagtatccttacataactagcgttgaaaggtaaatattagctaagtttattacttaaatcctgcgttttgtaccataaatgacaatgtgcagaaagtacctgaattggcccaagtcaaaaaaaaaactgttaaaataataatggaatttaactttgttgtgacataaatagaaaaatgattgtttctaacaagtgcttaactgaccctccaaaaataaaattactgtcttctatagacgtgtactgatgaaaaatataggtgtgttaattttaggattttatttaagtaatattgccaattgggacctttaaattagtttggaacatgtatagaacagggtgtatcatcggcttaaattgattaataattactcattaatattgatctttatagcagcctgtaatgtatgttgtagaagacatttctttaagaaaagcaactaggataagtcaacttaaatgggtacacaccattgaaatttgaaattattttggcacaattgagttttctccttaagtttgttggaatggcattgaaaaactcaatcacgttatttacaaggagtaaaatatctttgaagttttatttactttagaatggattataatgactagtaatagctatagagagtactcagtgctagcactcttgatgcatttttctactttttctttatgaggaataagcagatctctcatagtggtgacctttcacactgtgttttcctcattgagcaagtgtctttattgtggctaacttgtgtgtgagaaaactgaagctggccaggatcgtatgtacctgggcctggccttcttaatagattacggcattccacttgataataccagtggcacaggagaaacttctactgttgtgctatttggtaatgtgaagacagaaaaagtctttttatggtagttgggtcctcaaaacaactcttcatggtttagtgataaggagacacaagttgcctatcaaacagaggtacattagcttattatctacaaagctgatagagcctcttaaattctctcatggtgacagaaaccccatctgaagtgaaggcttgcagagctggagataccagagcactttccttcctcataaatacaagtagagttaaccctactcttgtagaataaaaattgcatgtaattgttgaacaaaagctgccttcttttttctctggcaattaaaatgtggtcaaagagatatatacttggtgattgccatttgtgaaaatttcagtgataagcattacagcttactaagaagagcaagactaattaactagtcttaaaatagatgaaaattgaggggaaatatcagagatttaggactagaataagtcaacaactttatgataagatctgtgtgtaggcacctactatatttgttctgtttctagtgctgtgtaggttttaagagttcaatgtgttccagtgttctgagtgtctacattttcactcctcatagctacttggaaagatttggcaagtaaacttgctaccatggttgggggaggataaatgcctttatcctttagtgctcccaacaacaggaccttttatggccaagcacacataaaagtccatgtgattacttaggctcatagagcctagtgccatggagaaaatgttggagaaatagatgttgtgtttgctatatgcacatgccaagtaatttaataagctaacgtatctgtactaatgattgtttatgattcttcatgaaaaatttttaaaaatcacattgaataaagtgaattttaaaaataatttgactttggagaatcaaaaaaattcttgaatcttaatgtactgtgcttatgttctacttcattcaagaaaaaaggagtaaaataaacatccataattattgctaatcatattttaaaggatactaagatctgctatgaaataatcaaaaatatctttagatctaatttaatcgtttattgatgaacttctctgggactagttcagtgatcaagctttgtttcctaactaagctctgttagttaggcttacttagaaattttaacttcctaatccttctctgcagttggtcagaaaatcaagaagtctcagccatttcagtgttgaaccctgtaactctactttaaaatacgacccactaggattttttaaaaaagaagaaagaaagaaataagacattctgaaagtaaaggaatattccatatatcttcaagctcttggtttttaatttatccttttaagtactggacaagttatttcatgatgaatttaagttaaaaataaaaatcagaaaaccaactgttttttgcattatactaagaaaaaaaaagtcagtataatccaggagatattttaatggcactcaagaatattctccagaaagggctgggcacagtggctcacgcctgtaatcccagcactttgggaggctgaggtgggtggatcacgaggtcaggagatccagaccatcctggctaacatggtgaaaccccatctctattaaaaatacaaaaaaaattagccgggcgtggtggcgggcgcttgtagtcccagctactcgggaggctgaggcaggagaatggcatgaacccaggaggcggagcttgcagtgagccaacatcgtgccactgcactccatcctgggcgacagaacgagactccgtctcaaaaaagaaaaaaaaaaagaaaagacagttctccagaaagtcaaatcagtggattaaatcaaaccatgaaatacactctgaataacttttgagtgcaaattttaaaaatatgtaaagtcactgataatttgtacattctacataggagtcattgcagacataaataattatcaagtttgttgtatttcaaagttatacaggaaagtgaataataggaatgaaattattgggatattgtgctgattctttctgttgagtaggataaaaactccgataggcagaaaggaagaatacgtgaagttgctgaaatgttcaatttataaaggtacgataacttctcaaagcatcatttttatagatttctatcttagttctttcatgcattggttatatcatataaattgatcaggctttaatcagatttgagttttaactgtgagagcagtgagtcatttagtattttgagaagtttagaaaggaagaatccaaacaaatattccttttctcttaacatacaatgggagaattaattttacttatatttaatgtttatcttatttgaagaagtaagtacatttgtgatcatttagaaaccgtttcagtggctcttgtataattcagttcattccgtctgtgctctcttaataaattttacagaaaaactcatggcaagttagcattatttgtgtgtgaattttccaattgtatttcagactttaagaaagaaaggccttaatggttgtgagagccctgatgctgacgattactttgagcacagtccactctcggaggacagattcagcaaactaaatgaagatagtgattttattttcaaacgaggccctgtaagtacttttactttacctctactttttatttgttgatcctttttgttaacttcattatttaggctctgaacaagaaggaacacagagggtgcgacagcccagaccctgatacttcatatgtgctaactccacatacagaagaaaaatataaaaaaattaatgaggaatttgataatatgatgcggaatcataaaatcgcagtgagtactaaagtatggtttgtgcttttatcttgtgcatgaagagattgaccaaacatcttgttgcttatttttatagtgggtgatgacaacaataagtagaagggaagaaatgcattttattagtattttttataaaacttcaaaataaaattgctgaaatcttatacatgttcagtatcttaaatgtagaagtgaagagaaaacatgccgatccagactttgctacttcttaccccaatacctttggatagggcacctaaacattttgaattctttctccatctatagtgagttggctctcatgatttttaaggtatcttccagctctaaaattctatgatttatagtatagagtatgtataaaactttccctctactcccatgacttaaaaacatatgtgttcttaaatagatcttgagaaagcaaaatgtaaggtagttaggtttgttgcgaaacttgtttttttcctaaattatcttcaattattttgtatagttgctataatagcagagctaagcttactgctttgcagtttgtaaatgtccccaaatcacttagcaacaataccaccagacttttgttcttttcttatgctgtagatactaaggaagagcagcttggcttaattttaatttagggcaacaatgttcttaaactgattgcaaaacaaatagtgactttacagtttctgtatactcattcatctaaccatagtgaaagagtatttttctttgagctcatgctcctagacttgatagtttttcaaagaattctcactggaagctccattggcaagagctacttaaaacagttattctggatctgatttcctaattctgtatatgtaggtcagccgcccttgaacaaattagtttcaatgctgatatttattttagcatcagagttaattctttcaaaactgtgccctaaagtatgcatgatggatcatttcttcagagtagtcctgtattacaggttgggtattccttattggaaatgcttgggactagaaagtgtttcagatttgggatttttttcaaaatttggaatatttgcatatgtatagtatcttggggatgggacccaagtctaaacattaaatttattaatgtttcatacataccttacatactcatggactgaaggaagttttatacaatatttttcataattttgtacatgaaacaaggtttgtgtacatggaaccatcagaaagcaaagatgtctctgtctcagctacccatgtcataggtcttggctccatgtggagcatcattgggaacctgctgttagcatgtgtagcctacacacgtgccattttattaccctttgtggatgtgcttgtgtgagggaatctgggtgtgcacagaaaagatatattgaagctgatggcagactggaacggtccttttccccttggagacactgaataaactgtgtattgtatgcctgcatttccacatgtcaggtttggaattctctatggcatcatgttggtgctcagaaagttttggattttggattttcagattagggatgctcaacctgtataagaagccagctcacaaaaaaatagccttaaggagttacttttgggcaaataccattattattcttaaaaacaatacagtagcaaataaagggatgttgctgaccttgcagttaatgttaaagctgcaaagatatcgcacaaataaaagtgttttacttttgaaaaaaattgtcatatacccactgtttttatatttgttgatgtataatttttctacatgaaataaactactattgaataaagtacaataaaatatattcttccaactttgaattagcagtgttaccttatttttgtatgttagtcttttaaaatgagggcagagtaaagttgttttattttctcccactttaaattgtaaagagcaacatatatttatcgtggttaacaagcatattgtaaatggtgtgtggaggaaatgcaagatgaaaatagaaaatagaaaaaaggggatatggaataatttggagggagggaaggttagcatttataatatttgtaatttaatctttatacaatttaaagaagataccaaaaactttattacttttattactggcttggttagtagttaattttgttgtttagattagatttctttgcattttcattaaactcaaattgcattgttatgtatataattactttttttttttcttagttttgccctttagaaagttagtcaattaaatcagaatggggaatatttatgatttatcagatttgacatattaagttaataatatgtgtacacacttttctccttccgttatatttgggatctctcagtagaaatgtaatgttattaaggtttacattgaagtgccaatttatgcttacttggtgacagtgatatattttgtaatgtctaaatatgacaacactacttgattatcaggtttatcctcttaaatttgtctttatgaatatttgaaatatagaatatagacattagtatatattaatgtataaagttgaaattgaaaaggctcatgtcagtcatattcatgttcaaacataattctaaagaaaatagctttaatctgtaaattggttaagaacctatccctatcctctacttttagtaacttgagttaccttgccaaattaaagttcaaaagttactttgtagatgaatacgaaaccaacagttttttccttctttttctttatttacagcctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtatgtagtgatacctattatgctggttctttaataaagagggtgaaaaaattcattgctaacataagcagtttcttattttgctattcttttattgctttgatgagcaagaatcactgatacataattggcctcattttaaagtatttttttgaaaatcaattgtgggtgtagcattgtgtcatgcaaagtagaacagtactgagaacctgccatttatatgctttccttctcatgggaaagccatactttgacaggcagaaaatttagttagatatcagaagcaaggatttaaagtagagtgtgagccattcatgttagaaatatgggtgatagactacctgattggagttagagtatcttttacatctcctcctgcctgaattacttcattaattcagcaaaatttatgttacatttattgtattagtctatgaaatgcagtgtctcctctctcttaagtcctagatttaatttagtgatttaatcatactccttacacactgcccccgtttttatcagtatgtactattttggtattgatgcaataccactatttggtattgaaggcgacatcaagcttgaaaggtaaactcatatatatgagatataataactacatcagattacatgttaatgccaacttcagactgagctagtttttatttttgtgtctttttaggattagagtgagagttatctctattcagttcacgttcagttaggtaaagagagctaattcatattcattctctgccctctgtcttctctccgtaacgttgttaggtgggatgttgagcactacagacctcacagtgccaaatggagctggaagcagtccagtgggtgagtgaattcctactcttctgttttgtaggtatctatcctatatgagatcaaaggaatgttgttcctgaaataaagctttctgggaaatttccttctgaagggtactttcactaatacatcaagataatttcttaaggggagactttctctaacttccctgcttaccaaagttagactgttaccaaactactctatcttacaacagcatgaaatgttttcagagagactagaatgaaaagaaatggtgggtctatctacttctacagatagaaagataattaacatatttgtcttggccgggcgtcgtggctcacacctgtaatcccagcactttgggaggacgaggtgggcagattgcctgagctgaagagtttgtgaccagcctgggcaacaccgtgaaaccctgtctctactaaaatacaaaaaaatttagctgggcgtggcagtgtgcacctgtagtcccagctattcgggaggccgagggaggagaattgcttgaatccgggaggcggtggttgcagtgagctgagatcgcatcactgcactccagcctgggcgatagagtgagactccttctcaaaaaaaaaaaaattatggagatgattgaatgacttaataaaaatgatgaggaagaaataaacaaacatcaataaagatattattaagacaagttacaaaatatttaatgacaaagtaggaataaatgcctaattatatctgccacagtattaaatattttaatggaattaaacagataagacctattgtggagtcttacttaacagaaaacaattaaatgtgggaaaatacataaaggttgtaccagttaaacactagggctgctactcttgtatgtgtatttccaaatatttatggttttttttcagctcttgttttagttgtttgtatgcctacatactgtttttgtgtccctttttttttttattcccccaacagaataataagttcagggcctaccaagaattgtgagagcctaatatgcttctctcacattgggttgacaccccnnnnnnnnnnnnnnnnnnnntgcaaacttcacctcccgggttcacgccattctgcctcagcctcccgagtagctgggactacaggtgcccgccaccacgccgggctaatttttttgtatttttagtagagacggagtttcaccgtgttagccaggatggtctcaatctcccgacctggtgatctgcccgccttgacctcccaaaagtttgttaaaattagatcgtagtgattagaaattagatttaggggttccagaatgcccggaaaagcaaatagtctctggaagaataaaataagcctggcccacatggcaaaaccccatctctactaaaaatacaaaaattagccggaagtggtggcaagtgcctgtaatcccagctactcaggaggctgaggcaggagcatcacttgatcccaggaggcggaggttgcagtgagccgagatcatgccactgcactccagcctgtgcgacaagagcaaaacgctgtctgaaaaataaataaataaataaataaataaaataaaacaccatctcagaccttattatttctaacttggcacataagctgaactaggcacacacacaaataaagcaaatgaaaacttgcagaaataaacaaacaatggaatcagcctcctgggaactccagaatttggagttactaggcacagactttgactttaatataacagtgtttactgtgttcaagggtatttaaaaaacaaaaagattgagaattttagcagagaactgaaatttatttaaaaaatggaaattttagaacaaaaaaaccccgtaatgttaagaacttaacagatgggcttaaaaacagattggacaaagcaaatacaagaattaagaaactaaaagataagatagaagaaaattatccagaattttggagacacaaagggatggaaaattaaaaagaagacccagagcatgcaataaaaaggactagcatacgttaaattgaagtcccaggaagcaaagtcagagaaaattgggcagaagcagtatttgaagagataatcactgagaattttccaaaactaacaacaacaaaaaagccacaaattgggaaggcctataaaactcaacgtggaatacagataatgctgtgctttatgagaaatttaaacctttatgaacaaaagactggagatggtgagctaaacctccttctcaggaagtcagaaaaggacagcaaattaaacataaagtaggtagaaccaaataacaaagatacaagcattgaaatagaaaatagaaaattttctatttcaggcatggtgaaacagatgatctcatacgtgcttttgtggtattgtaaatcagtaacaatctttctggaaaggttttggcaagatgtttcagtggtcataaaaatacaagtattgatactgaaatagaaaaacaaattgaattaacaaaacaaatactgattatttaaaagactaataaaatggaatgttttcactaatattcaattcgaaatattttctaatttccattatatctttttctttaacccaacttgtaagttatttagaattatatttcttaatttcaaatacatggagattttccagttatctttgagatattattttctagccagattgttttgttaccagagaacttacctctatatgattaagttctctgaaatttgctgatacttttttataggccagcatgtgctcaatttttgtctgtgttgtgtactggaaaggaatgtttattctgtattataagcatggattgcaaattctacttgttttaaatacgttttatctgtatatatgtcataacttactgtatcagctccagtttagaaactcgtgataggtcagttccagatagttttgcgttacctttaaaccatatcatttttaccaatattgtcattttcaaatacgtaatttgtttataggcgagtcttccatttgccttgttcgtattttaatttttgttgcatcttctgcctgcttccctaaaattggaatacttcaggcccatgtactgctgaaagaagaggcatccttgagacttttaaagcactgaacgaactcaggaaaggcaaagacttcttaaataagaaaccaaagaaagtctaatggaaagactgattgatttgcttgtgtgaaaattggaaactttgtgaatcaaaagcactgtaaagagagtaaaaaggcaagacagaatgggagaatatatatagtatgtatacaatcaatagagaggtttttttttaagaatacctacaaatcagtaagaaaaagaaaactcgacttttgaaaatgtgcatgagaacacatcacttcacaaaagaaatgtctgataaatgtgaagaaatgctcagtctcagtagtcatggaaatgcaaaattaaaccacaaagagagaacactgcacacccaccagaattgctaagatgaaatagatggtataccaaatattgacaaagctatgaaaaagcacaaactcatacactggtaatgggagtacaagttgttgcaaccatttggcattatctgcctaagctgcagatacgtgtattgtgtgacccagcattttcactcatccttatgtactgtagagaaatgcatttgtgcatcacgagtaccaagagatatgtaaaagaatgtgtacaacattatgttaaagtcattgtctagaaatagtacagatctctgtcaacagtagaatggataaatataagagtacattcatatgaaagaatattatactgcagtgaaaatgaaatcacagcagttctcaacatggatgaatgtcaccaaacattatgaattaaagaagatagatacatactcaagattctaactatataaagtttgaaaagcaggccaaaaaaactatagtgtttgggatgcttgtgtagatagatggcagagccataaagaaaaaccaagaaattactgtaaaattcacaatagtggttactttgggtaggtgggactctcggaatattttagggggcccaattatggaaacttctggggttctggcagtattcttaatctgaatggtggttacgtggatcttcactttatgataaatccttaacctatacgtttttgttttgtacattttctgtttatgtgttacattagcaagaaaacagttttgaaaataaaagaatacactagatataataataaaggaactataacaacaaatataaaggcactttttaaattataagagaaaataatgtacattttgtggtatttatactattccaaaattcagagagaaaatgtatagacactcaacactcacattcatgcacaaactagaggtagcctttgagtctttggacattgttgtctgcatgtggcagctggaactcagcacccatcttaagatcatgagacaagtcagtttaagatgacaggtcaaaatgccaaggttgatgaagtgaaaagctggtggccctcagtgttgagctgctgaagcagctgagtctgggaccactcttcccctagtctttttatgtgagataatacgtgttgctcattctccagaggaaaaaagcaagataaaatccaagcaacagataggggaatgtttagtaatgggcatttaattgtaccaaaatacacaattcaaaaaagaaacctaactagtattttaaaaactgaaaaggttgttcatcattggtagtattcatgaaattcaaattaaaatgacaaaaaaaaatactactcttacttactaattcccaactattagcactttttattgtgatattcagtgctaatgaaggcatggtgaaactgatgatctcatgcatgcttttgtggcattgtaaattagtaacaatctttctggaaaggttttggcaagaggttttagttgtcataaaaatgtttatacctccaagcccactaatcccatttttgggaatctctcctgaagaggtaagttagaataagcaaagcttcattgcaactttatttgtagtaatgaataataggaagaaatcaacatattcaacaatatgaaaatgaagtaaatgaaatttcaactgaatttctttttagttgtgatttaaaacgagcaaaaaatatgagcatggaaaacaaaaagggaaaaatccaaagagattataatacttaagatggtgggactgtgtttttcactctttttctagtttcagtgatgctgtattaatacagttacctctacagtcataacatctttattgtagtaaattagaatatttctttatttattacttataacttgttttccattgtcatctgtgcaaataaaacttggcagctttgtacatattgtaatttgtatagatctttcatagaggtaatttgcttatttgtttatgatttactaggtatatttctctatggggagtttaatactgggtttatactatagttcaaatgactttggggactttttactttgggcacactttaaaatatcaagcataaaataaagtcagatatccaacaacttcactttttaaaaacacgttgagaaagagaaaaaacatatatggtactagacatagaaaggctcaagatgctcttggaattatttggggttaaatgaaggtaaaataagggtttgcattgtagcaggcacattggcagttaaaaagaagagatggaagaggtgaaagatatcatgaagaaagcttgattgctctgaaggtggggatgggatggcggaggacagcagtagttgaagtctttagaacaagctgagttgagatgacagcagcatgtctgggtgaaagtggccaccagattattgaatatgtactggaaattaggaaagataaagcagaaacccagttttcagtcattcacatggaggtgatagttgaagttgtatgtgcttcagcattcatgcttcatgaagatgctgaagtttctgaaagagaagaagatatgttgccttttgggggctgcccacatgggatagagatggggaatacagtattcagaaagaaaagaagcagaccccatgagcattgcctatttttgttataaatttttattggacaggatccatgttgtccatcttacaagacatttcattgaatcaagtacacatgcattcaattatttcaaaacctgtgatctttattattttattttattttagactagtcaggtgcagtagtgagaagggggtaaagagtagaacaaggagttggataagttgagataactcactgccttcgaaccagccctgtaatcttttctactttcagaaacctcaaacagttctttgtacaaatgacataattttataactgttagaatgtatttttgtttattgaataatcagctgaatgtcaaattttatgaaaattttgccaaatatgattgaactttgctttggatgagtttttcagaatcctttgaagtttgcacatcagttggacttctgaaatgaattcatagtgaaatattagtgacatcattgtctgcagtttaaccctagaagagtagtatctaaggacacagagtacttgccagctacttgaatgcattatttcagctgatgtgatttatattttgaaatatgagccagactgatggaattgactgacctatcttacagctataggactgtaattgagatcaagttctgttaagtttctgaaggcatgggtatgcggtttgctcaagagcattttttcacatttgtgttaggatagtaaattaccttgaaaactggaaacacattttaacaacattaaattggatttattcatttagtgtagatactgtagttcctaggtttgtaaactgtggcaagatgagttatatactgaaagtatttacctcaaaagtctatctgaaaaatatcttcatttttgtaataaaaattgagctggaggtaagaaggtacatattagggtatatatcactgcactctacaaaataacaagtcgtgcataggagattctcttagcttcagcctggcaagttaccaaacacttacatcatcctttaatcatcatctgctactgactcctgactttacatcaagaaatactgtgcttttaagtcccctcttactcttgaaatttggttctcatgagttaccatcatgtcatatctatctaaagcaccatagactgcacatgggaaaatagtatttgtgcttcttgatgatgtgtggctctgaattatatatttttgtctttgagaggaaattctactttcttcttcagatttgagtataaatcaagtaaagaagaatcttctaaataatatcagaatcagaacacatattcatgccattgtatatttaaaaaattattaatctgacattctcatactgttaacgcaaaatgaagtttctatttaaccttcctatttttgaataaaattatttaataaacatttttaattcttcaactgtctggcttagcggttacctctgtccaagtcatatatgatctctactcgacaggatggcctggtgaagtggttgttttttaaactgcactgctttctgaagcttaacaggatgcaggaaattactctatggggtgtggaaaggatttaattcataccccttcaagataatgaaagcagaatgcaggaaataacctcatgaggttaactgaaataccagtccccacagcaaaattagatcatacatatgaattaaaactgagtgggtcacttggtaaacgttttggaggaaacaagaggaattgggtgagggtaaggaagaaaaaaccacactaatcatctggaactcagaaattcttttgtttgtttgagacaggatctcactctgttgcccaggctggactacagtggcacgatctcggctcactgcagcctccacctctgcggctcaggcaattcttctgcgtcagcctccctagtagccaggattacagacatgcaccaccatgccctgctaatttagcatttttttttagtggggtttcgccatgttggccaggctggtctccaactcctgacctcaggtgatctacccatctcggcctcccaaagtgctgggattatacttgcgagccaccatgcctgggccttttattaaaaaaaaaaaaaaaaaaaattatttcaatagttttgggggaacaagtggtgttttgttgcatggaaaaattctttagtggtgattttggagttcaccagagcagtgtaccctgtacccaatatgtagtcttttatgcctcactccctcccagccttcctccttgagtccccaaagtccattgtatcattcttatgccgttgcatcctcatagcttagctcccacttataagtgaaaacatgtgatgtttggttttccattcctgagttacttctcttagaataatggtctccagttccatccaggttgctgcaaatgccattattttgttcccttttatggcttagtagtattccatggtgtacatatatgtatatatatatattacgttttctgtatccacttgttggttgatgggcatttgggctggttccatattttcgcaattgcaaaatgtgctgctataaacatgtgtgcgcaagtgtctttcatatactgacttcttttcctctgacccagtagtgggattgctagatcaaaccatagttctacttttagttctttaagcaatctctgtactgttttctttagtggttatactagtgtacattcccaccagcagtgtatgagtgtttgcttttcaccatatccatgccaacatctattattttttgattttttaaatatagctattcttgcaggagtaaggtggtatctcattgtgattttgatttgcatttcactgataattagtgatgttgagcatttttcgtatgtcttttggcaatttgtgtatctgcttttgagaattgtctattcatggcctttgcccactttttgatgggattgtttttttcttgctgatttgagttccttgtagattctggatattagtcctttgtcagatgcatagtttgcgaagattttctcccactctctgggttgtctgctgattatttcttttgctgtgcagaaggtttttagtttaattaggtcccatctatttatttttgtctttgtcatatttgcttttgggttcttgatcatgaaccctttgtctaagccaatgtctagaagagtttttccagtgttctagaatttttgtgatttcaggtcttatatttaagtctttgattcatcttgaattgatttttgtgtaagatgagaaatgaggatccagtttctttcttctacatgtggcttgcctattatgccagcaccatttgctgaatagggtgtcttttccccactttatgtttttgtttgctttgttgaagatcagttggctgtaagtatttggctttacttctgggttttctattctgttccattggtctgtgtgcctgtatttatgccagtaccttgcttttctggtaactatagtcttgtagtatagtttgaaatggaaataatgtgatgcctccagatttgttctttttgcttagtcttgctttggctatgcaggctcttttggttccataggaattttaggatttttttcccccctagttctgtgaagaatgatggtggtattttgatgggaattgcattgaatttgtagattgcttttggcagtatggccattttcacaatatttattctacccatccgtgagcatgagatgtgtttccatttgtttgtgtcatctgtgatttctttcagcagtggttcatagttttccttgtagaaatttttcacctccttggttagttatgttcctaagtattttttttttttgcacctgttgcaaaaagcgttgagttcttgatttgattctcagcttggtcattgttggtgtatagcagtgctgttgattttgtgtcctgaaactttactgaatccagtaaagatgtcatagatggcttttattactttaagatatgccccttctgtgccagttttgcttattgacttgtgtatgttaaaccatccctgcatccctagtatgaaacccacttgatcatggtgtattatcttttgatatgctgttggattcggtcacctgttattttgttgaggatttctgcacctgtgctcatcatgggtattggtctgtagtttacttttgttatatcctttcctggttttggtattagggtgatactggcttcatagaatgatttaggaaggattctttcttactctgtcatttggaatggtaaaataagattggtactagttcttctttgaatgcttgatagaattcggctctgaattcatctggtcttggactttttttttattagcagtttttaaaattactgtttcagtctcgctgcttgttattggtccatgcagagtttttatttcttcctcatttaacctaggcgggttgtatatttccaggaatttatccatctcctctagattttctagtatatttttccacccctttactttatgtgagtccttacatgttaggtgagtgtgttgaagacagcagatacttggtggatttttaaccattctgccattctgtatattttaagtggaacatttaggccatttatattcaacgttaatattgagatgtgaggtactattttattaatcattgtgttagttgttgcctgaatactttttttttcattgtgctgttgttttatgggccctgtgagatttatgatttaaggagggtgtattttcaggttttgtttcaagatttagaactccttttagcatttcttggttgtgctggcttagtagtggtgaattctctcagcatttgtttgtctgaaaaagactctctcttcttcattcatgaaggttagttttgctgggtacagaactcttgaccggcaattattttgtttgaggaagctaaagataggaccccaatctcttctggcttgtagggtttctggagagaaatctgctgttaatctgttaagttttcctttgttggttacctgatgcttttgcctctcagctcttaagattcttccctttgtcttcactttagataatctgattactgtgtgcctgggtgacaatctttttgcaatgaatttcccaggtctttgagctttttgtatttggatttctagatctctagtgaggccagggaagttttcctcaattattttctcaaatatgttttccagacttttagatttctcttcttcctcaagaacaccacttattcttaggtttggctgtttagcgtaatctcaaattttttggaggctttgttcatttttgttttttgattttttttttaatttgtctttgttcgattggattaattctgtcacctaggctggaatgtggtggcgtggtcttggctcactgcaacctctgcctcctgggctcacctcagcctccttagtttctgggactacaggtgcacaccaccatgtcctattaatttttctttttttttttttttttttttttttgtagagacggggtttcaccatgttgcccaggctggttttgaactgggctcaagcgatctgcccacctcagcctcccaaagttctgggattacaggcatcagctaccacatctgacccagaggcaaaccattttacgtctcagaatgcagtcttgtcaggatgagattattaggacgaattttagaccagtgttaagcacacagcagacactcagtttttgttagtccttgcacgtgtattaatacaggggtgtgtgggtgtgtgtgtgtatttgtaacacctagtgtctgcttatttttcgtgaattctgaagttttctttttggctttatactagaatgaaaggagcagaacaaatacagctactttttccttctgatggtccctgaagctgtggattatccaggcttatctgctctgccattcctcactcacaccttgttcattcgtgctttaacgtgtttttctcacatttatccataatgcctgccttctcttttcttctgttcttctctcatttcagactgctcagtagttaatcccacaaaggctttcctaattaagctgatagatttgttatcagtgctttctatttcattgtaaattttgtgtggttacctctagtttgcccatattgtgagtataattttggtatattcatgcctatgtgatatgcctgctcttgctaactagatgaaaagctacttgaagacctgtaggctttttatggtttctctacatataccctcccaggggcacagtactgtatacataatagatatttgaatttttttaatttccaaatagtaaaggtacttctatgatttccaattttaggcagttgctagtcttaatgacatgtgaatgctgagtcctccccagagaacttaagaggcctgtttggctcatcaggaacctctggttcactattctgaatattttgttctttgccagctttgtaataaacacttatcttttattcttctctgctttatttgtgatttactttgaaattgaaataccacactgtaatctctgttttataaatgcacattatatgtttctgtacactggttacttatctactttttacttgtcattatctctgctgttggactgcaagctggtgaataatagctgtttctattaggatagtatcagttgcaactaacagaaaactacctcaggcttaaattgtataggggatgtattaacttacatgtaaccgaaagatccagaagtggtacagactacaagcatggtttaatcagggattttacatcatttgtttgctgttctcctttttgtatcagctttttcctcattctggccttcttctgagtctcaaaatgacttaataaaatgctggccggacacgttggctcatgcctgtaatcccagcactttgggaggccgaggcgggcagatcatgaggtcaggagatcaagaccatcctggctaacacggtgaaaccctgtctctggtaataccacaaaaaattagccgggcgtggtggcgggcgcctgtagtcccagctactcaggaggctgaggcaggagaatggcgtgaacccaggaggtggagcttgcagtgagccgagatcgcgctgctgcactccagcctgggcaacagggcaagtctccgtctgaaaaataaataaataaataaataaaaataaaatgcttcctcaggcacagtttagggaatgtgagagcctcctgataatcatggaagagttgttttacccgggttctgattggtcattaccacatccagtcactgtggtgagcgagaatgacctgagtcaaatgcctatcactaagttcatctgggggctggagggagggttgcagagagtcagccccacccagtccacgtggttgctatacatgggaagaagtagaatgactgactacagtattcatgaaaacaggatggtttcatacgtattttatatctcaactagtacccaaaagtattatatacatagagcatatatcacaatgtgcatttttcctcatttcattaagggagatggaaggttctgttagggaaagtttaggaataagatgattaaagtgagataaatcagaaatatttaataaggacctcagtgaagctgaagaaacagactcagtagaagtagagccataaggaagaagtacgtggtgaaaacggggcattagaaatgagtgctgaataagctgcagttaagaagctgctctgatacctagttcactactcagaacttagtggtagcagtgcctttgctctcacaagagtgaatgaataggctggtctcagacatttttctataatacctccattattttagtccccagtatgagatgccctcttagaaatgtggtcttttgcttgtttgtttctttgagacacagtttcactctgtcacccacgctgtagtgcaggggcatgatctcagctcacggcaacctccgtctcccgggttcaagtgattctcctgcctcagcctcctgagtagctgggatcacaggcgggcgccaccacatccagctaatttttgtattattagtagagacggggtttcaacatgttggccaagctggtctcaaacacctgacctcaagtgattcaccctcctcggcataccgaagtgctgggattacaggcgtgagccactgcacctggccagaaatgtgttgtgtgttaaatctctttcagcaggtccaaggagtaatgctgtacaagtatcattagtcttaagctttatatgtatttcagactttgcttgtcttcctttgcttatttttaagatatcccaaggtacttcattagttaccacaggttgagtatcccaaatacaaaatgctctaaaatctgaaacattttgagcactgacgtgattctcagaagtgtcaattggaggattttggattttcaggtttagggatgctcagccaataagtatacaagtattccaaaatcagaaacacttctggtcccaagcatttcggacaagggatactcaaacctgtagtgagttttgttataaaatttatttgcaactcagactggggaaaacttgatttgtttgtgccaaagtattttaataactcttctcactttattgaatgatatttttccccccagggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactagtaagttgaacctttcttcaacttcattctttaaaacacatattttatacatagtcaatctgtagcttcctttggaattttctgtgccaccgtagaatctacacctattcctaataaatatttccattcaaaattagtatttgaagagacaagtctatttcaaatacacaaaaatcagattatggaaatttgcttaacagttacttaaaattaaagctaaatacgaacgtggttggaactggaggttattgtgttaagtgaaataagccaggcacagaaagatagatactgcaaggtctcactcatgtgggacctaaaaaaattggtcttgtggagatagagaatagaatgatagcagaggctgggaagggtgtgtgggtgggagacgggatgaagagcggttgattcgtgggtaaaaacatacacttagatacaataaatatacccctgtatttgataggagagaagggtgactatagttagcaacattgcagatggagtatatttcagagtagctagaaaagaggacttgaaatgttcccaacaaatagaaaggataaatactcaaggtaatagatgccccaaacaccctgacctggatcattacgcattctatgaatgtaacaaatattcacatgtaccccattaatatgtaacacctttcgaatcaggttttttttttttttttttgagtcgttttaaggagtgaaatttagtagccaagaaagaaggaaggaaggaaggagaaaacagctccctccaacagagacagagggaggggggattcaaacaaagagaaaacccctcgaatgagtttttaaaaagtaaaatacagagagattattatgtttaattttaattttaccaggctagaagcattaaccatgacttatttattctctgtactttgtatactttcattaatcaattaaacatgcttttctgtgagagaagcactaaactatttgttagaaaattctacataccaggcagggtacagtggctcacacctgtaatcccagcactttgggatgccagggcgggcggatcacctgaggtcaggagttcaagaccagcctggccaacatggtgaaaccccatctctactaaaaatacgaaaattagccgggcgtggtggcgcgtgcctgtaatcccagctactcaggaggctgaggcaggagaatcgtttgaacccaagaggtggaggttgcagtgagccgagatcacaccactgcactccagcctgggtgacagagcaagactctgtctcaagaaaaaaaaaagaaaaaattctgcataccacagaactattgtaggatagggaagaaagcacacaaacttgagtgagttattctccaattaattttatttgcttattccttctcaaataacctatttaactgtataaagaatgcaggtagcctctattccactccttgatgacggctttagggttctagtctcatttgtttttgagtcttaagtctgtttgtaaagaacaggagaatctatttatcgcccttagcttcctgtagaaaaaaaactagaatatataatcaagttttaaaacttcttagtttagcaactgtttgactactaccatactaaatgatatgccaggtgttctctctgctgagcagttgctaaactcaccattagagtttttgctaagtgaaagtgatgctgtcaggcttagataataattccactttggtataatgctttatagattccatagcaccttcatgtgtatattgtctcatttaattctcaattagcctgtgtcattgcaaggtagagatgtggaaactgagttaaaggttattacttgtccaagatagttcaaaatagagctaggaccaaatctctaagtcttacagtccaggtcaaaaaacaagtacttttttatctggttatacagaaatctggaaacagtcactcccagcctcacaattaaaaaaacttggatatacagaaagttcatagttttccttgaactcattatagtgctgagatttcacggcaaccaactggcccagatactccagagtcaaagacactgtaaggagagttgacatttgagcattagacaagacacagatggtaagagttaagctagggtgattggtgaattgctggaggccaggtgtacactgacagaactgtgtgaaactcctgggggccgcagtataacacagggtgagtctgtgttctcttgtatacttttttactccgtgaatcccatggggtgctcagaagctcctgaaaaggtctcgctgtggtacacaactgggagaggggaagagtagccactacactaggggcaaaaagttttgccaggatctttttgtcttctttctctaatatgaaacaaaagctttaatctctgagaagacgaacaacaaacattatcactcttagggcactgttgaaatcctgtttaatggaaaaggcaaaatatctcaaccagtggtgaaggaacaggaagacatgctcggtatggagcgatgccaggagagtggcaggatgactgagaaggccacagcctgaggcacaacaagagaggggatgacttaaagctgagagtggagcaggcactaggggaaaacctggcatgcagatccccacccccagagggatatgaagcttgtggtaggtgccctgatggtaaccagagcaacagtaaggctcaaacccagtccagcttctaatgaaattaactcgattcttgcactaatagcttagcaggagggaaaaacctgtaggtctattagtaggaattacccatgctgaaatacaaagagaaagaagagtgaaaacaagacaaaataaacagaattaagtatccaagagctatgcaccattatcaaatggtataacatatttataattggacttccaaaaagagaagagagaacagattaggagtaatattttaaataataaccagtaccaagtaggataattactactgccaacacacacatgcacgcatgcacacacacacacagatgtatgcacgcacacacactctcactcctagactgctaaaagcaaaagatcaagagaaaaatcttagagatacattacagaaaaacaaagataaggattagtaacatacttttttcttcacaaactaaactattcaagcgagaaaaagggagtaacattatttaatgtgctgaaattttttaaaaattcctcaccccaaaattctctacccaccaaaaatatctttgagaaatgaagatttcctcaaacaaaagtcatgggaatttattgccagcagacctgctctacaagaaatgttaaaggaagcccttcagcaggactgtgatcccagcaaaaactcgagtctacacaaagaaatgaacagtggaaatggaataaatgaagataaaataagtaaactctggttttccctgcattttataaacgttttatttttagaacaattttagatttatagaaagattgcaaacatagtacaggaagttttcatacaccccacacatcattttttctattaacattagtatggtgtatttgtcacaactattgaaccactactgatacgttattattaactgaaattcgcaatttattcagatttacttatttttaaccttgtgtctttttctattctaggatccaatccaggataccacattatatttagcaatcatgtctctttagcctcctcttgactgtgagagtttctaagactttccttgctttaatgaccttgacagttttgaggagtactagtcaggtatttttatagaatgtctctagttaagatttgtctgatgtttttctcatgcttatactgtggttgttggtttgactgaggtaggccatagaattaagatgccgttttcatcacatcatatcaagagtgcctactacatttattatcccttatctgatactcaggaccagaagtattccagatttcagattttttcaagttttggaatatttcccttatactaataagtagaacatcccaaatccaaaaatctgaaatccaaaatgatccaatgagtactacatgcgagtgtcatgttggtgctcaacaggttttagatcttggagcatttcagatttcagattttcagatttgggatgaccaacctgtatcgtcataactattgctgatgttcatttggtcacctggctgatgtttaacaggtatttaccaggtttcttttctgtgaagttactctttctcccgcttttcatactgtagcctttgggtaggaaattaccatgttcagcccacacttttaaggagtggggagttaaggcttcactttcttaagagaaggatatctacataaattatttggaattcttctgcacgggagatttatctcttctctctcatttattcaaccatttatttctatcaatatggactcgtgggcatttattttaatactttggtttataatacaataccacgtttttctgttgctttgttctagcttcagcttttgagggctatctacttgattcctatgtccctttgatatatccttatttttgtgggtttttttttttcagggggagcaggcgcttttttattttccggcactataatatattctaggcttatcttgtgtattttctgccccagtcctagaatcaggcatttctccaaggaacattatttttatggagaatgaaagaaaccaagatccgagtgctttccctctttttaattgctccaaaaggtatctgactatgtaaggcaaaaatagtaactgtattttgtttctgtagcacatgtaaaaataaaatatatgacaacaaaagatgggagggaggaattgactctacacatgatgtaaatattatttgaagatgaactcaaggtaactaaaggtgtatattataaaccctagtgcaactacagaagaaaattttaaagaagtataaataagtcagtagaagagataaaatagaaatataaaaaatgctctactaagtagcccaagaaatgggagaaaagaagacaaaaagcaagataatggtagcttttaatccagtcatataagtaatcacattgaatgtggtgagaaagcgtcagttaaaagattgtcagatttgtgtgtgtgtgtgtgtgtgtgtgtgtgtttcttaaaaagcaatgtggtggctcatgcctgtaatcccagcactttgggaggctgagacaggcagatcacctgaggtcgagagttcgagaccagcctgaccaacatggagaaaccctgtctctactaaaaatacagaattagctgggcatggtagcacacgtctgtaatcccagctacttggtaggctgaggcaggagaatcacttgaacccgggaggcggaggttgcagtgagccaagatcatgctattgcgctccagcctgggcaacaagagtgaaactccgtctcaaaaaaaaaaaaaagaaaaatgctgcttacaagaaatccactttaaatataaagacatagataaaagaagggagaaaatttaccattgcaaacaccaaaaagaaagctaaagcagacctattaatttcagacaatataagcttcacaacaaggaagagtatcagcgataaggagggacgtgacatagtccactttccaagaaataactgtctttaatgtgtatgcacctaacagcaaccttcaaaatacataaagtgaagactgatagaactaaaaggtgagtagaaaaatccacaattgtagttggagacttctatatccctctcagtaactgatagaacaagtaggcagaaaaatcagtaaggatctagatgatttgagcaacactcgaccaacatgacctaagagacatttatagaacacatcactcgacaacagcagaacacacacttttcacaagtgcacatggaacattcaccaagatcacatcctgtgccaggaaacaaactggcaaatttcagtgaattgaaatcaggcatattatattctctggccataaggaaatcaaactagaaatcagtaacagaaaggtagtaggaaaatggccatatatttagacattaaacaacatattttaacccaaggaccagagaagaaatctcaaaggaaatttaaaaatacatatagccaaatgaaaatggaaatacagcatcaaaattttgaggcccaactagagtagtgatgaggtgagatttatagcaacaaatgcctatatttgaaaagagggatcccaaatcagtaatctaagctcttaccttaagaaactcaaaaaagaagagcaaacttaaccccaatcaagcagaagaaaggaaaatgtaaagtgataccaattctacacagtctctttcagaaaaaattaggagagaacactttccaacttatttttttaggtcagcattaccccggtgcaaaaccaaagtaagccaacacaagaaaaaaagtctacaaatccatattcctcatgaactctagacacaaaaatcctcagtaaaaagtaagtaaattgagcaatatataaaaaggataatacatcaagaccaagttggttttatcccaggaatgcaaggctgagtctacatttgaaaattcattagtataatcagtatattaacaattgaacatctattcatcatttaaaaaaaaaatctcaatgaactagtaatagaaaggaacttaataaagagcatctacaaaaaatatacagctaaaatacttcataaggggaaagcattcagtcttctagcatttggagctaggtaatgatatttttttttctcaccagtcatatttaccatggtagtaaaagtcctagccagtacagttaggcaaaaataaatgaataaaatgcatatatatcgggaagagagaaattaaacttcctctattcataggagatagattctttcatgtagaaaagtgtaaagaaattataaaaaaaactcctcggaccaatcagtgagtttagcaaggttgcagggtacaaagttaatatataaaaatcgattatatgccagcagtgaacaattggagtttgaaattaaaaaaaaaaaatgatagcaccccaaataaaggaaggaaaagaaacatctaggtaaaattctgacaaaatatgtacagtctgtatgttgaagactgcaaaacactgatgaaagaaatgaaagaagacctagatgaatagatagatacatcatgttaatggatttcaagactcagtattgtcaagatgtcatttcttcccagattgatctgtagattaaacacaatttcaaaatcccagcaagctcttttgtagttactaacaagctgattctaaaatatataggtaaagacgaactacaatagctagaatgattttaagaaggaacaaaattttaaaaaaatactactactacccgatttcaagacctactacaaagctatagtaatccagaaagtgtgatattgacaaaaggatgggcacatagatcagtggacaaaacggctcagaaaatttacacctatacgtatatattcagctgggtttttggcagaggtagtaaggcaattcaacagagaaaggatggtggttacaacgaatggtgttgaaacaattctacatccatacacaaaacaaaaacaacccaaagtctgaaaataactcaaactttattaaaaaattaactaaaattggattatagacccaaatttaaaacaggaaactgaaatttagaggagaaaatccaacacaaaaagcaggatccataaagaaaaaactgatgtattggaggttgaacttaagttttgctctgtgaaaggcactgttcagagagtataggacaacctacagattagaagaaggtatttgcaagtcacatatccaataaagagtttgtatccagaatattttaagaattcttaaaacccaacagtaagaaaacatttttaaaagggcacaagatctgaacagatacttcaaaaagaagatacatggatggcaaataagtgtatgaaaatatgctcaatattatcaggcttagggaattgaaaattaaaacctaatgagatataactgcacatctagtaaaatggctaaaatttaagaaaacgcaacggctgggcgcggtggctcacacctgtaatcccagcactttgggaggctgaggcaggcagataacctgaggttgggagttcgagaccagcctgatcaacatggagaaaccccatctctactaaaaatacaaaattagccaggggtggtggcgcatgcctgtaatcccagctactcaggaggctgaggcaggagaatcgcttgaacccaggaggcaaaggttgcagtgagccaagatcataccattgcactccagcctgggcaacaagagtgaaactctgtctcaaaaaaaaaaacaaaaacgcaaaaactagaaatgctggtgaggatgcaaagcagaaaatctctcccatatctttggaatgcaaaatggtacagccactttgaagagttggtcagttcttatgaatttaaatatacacttgctggccaggcagggtggctcatgcctataatccctgcactttgggaggccaaggcaggaagactgcttgagcccaggagttcaagaccagcctgggcaacacagcaagaccctgtcttaaaaattaaaaaaaaaaaaacaaaaaaaacttgctgtacaatccggtaatgccactctttgagtatttacgcacatgaattgaaaactatacttataagaaacccgtatctttcataattgtgaaacactgaaactagcctagatgtccttcaacagatgaatggataaacacactgtacatccatataaagaaatgctactcagcaataaactgtttattcacccagcaatacagatgaatcctaagtgaattttgctaagtaaaagaagcagtagtgtatgattccatctatatttcattctggaaaatgcaaaactcactggctgccatgggttgggagtggagagaggagttgactataaagggttaatagggaatttttgaggtgatggaactaatctgtgtgatgctgttttgttagatgcatgggtctgtgtttgttgaaactcatgaaactgtacctacaaagagtgacttttactaaatgcaatttagtaaaaaaagattccgggggagcccaagatggaatgcatattgtcacacatgaatataactttattacagataagtaacatgatattgaaggggtgaggaagcaagaacctggtctaagtaactttggaaacttttgactggatactgtaaggttagagaccaacgaaattgtagcaaatcactgtgctctagatggtaaattcatccctcacatacacaaacacaaagggttgaacatataaataaatataaaatgtaaataaacaaatggacattgtagataaaggcagccaggtttctcatggttggaggagaaagttgcagataacccagggggttgggggtggggtctagaatgagcctgtgtttcagggttatagttgaaggattcagtaagagtttatatgtgtgtgtgtgtgtttgtgtgtgtgtgtgtgtgtgtatatatatataatttttatatttttagtggagactaatttttgtatttttagtagagacggggtttcgccatgttggccaggctggtctcaaactcctgagctcaacatctgccccctcagcctcccgaagtgctgggttacgagcatgagccactgtgcccagccagacacatannnnnnnnnnnnnnnnnnnnnnnnnnnnnnnnnnnnntgtatatacacacacacacacacacacacacacacacacacacacatatgtacgtatgtgtctggctggcacagtggctcgtgctgtaatcccagcacttcgggaggctgaggcgggcagatgttgagctcaggagtttgagaccagcctggccaacatggcgaaaccccgtctctactaaaaatacaaaaattagtcgagtgtggtaggatgcccccatagtccccagctacttgggaggctgaggtgagaggatcgcttgagcccaggaagtcgaggctgcagtggcctatgattgtaccactgcactccagcctggctgacacagcgagaccctgtcacacacacaaaaaaaaggtacagttgtgtgtacatatgaattagtatacatcatatatttcctagctctgtttgctgagaggtctgtgaggcaatagcatccagtaactgaacatacctggtgctcagattttagtttcagaacaccattttctaatacaaggactcagggctgcttggaaaaaaatggtttgttgtagagctggggcagggaaacgggatgagccggggttgtcagaggttaagaaagtgcgtatcaaaagtcacgggagctggcctttcaaaagagtttccagtggccaaaactagaacaatttgagtaacaaaataacaatagtattggattatagcccagggaataaaaaacattgagtccattactgatataaataaatgatagaataaataaggggaaaaagggacaactcttccttagaaaataactaattaataaatgtagaaagaatgagagagagtaaatcagcattagaacaccacagtacaatggtaattgttgcaggcaaagtcagtggataaatgctaacataagtgggcaaaaagtttaagtaaaaagctattttgctttgtctcagaatgtctcttccccaatattcatttcttacaaagggaaaaattagagaattagaaataagagaatcctggaaaacactgccttaaccggaggatcaaggttaacatcaccagtaatgggacataaagacaacatgtgccttccaatatgacatgctaagaaagccatgtctctttgtggtattcttgcaaaaatccatgcccttctatctgattatgaatgaaaatcagacccaaattgagagacattctataagataactgatcagcactctttcaaaacaagttgtcaaggtcatgcaaaacaagttgtcaaggtcatgaaaaggaaagactgaggaactgtcacagagcagaggagacgaaggagatgtgagaactaaaggcttgtgggatccaggatctgatcctgggtcaggaaaaaggacatcagttgaaagactggtgaaatccaagtaaagtccaaagctttaattggtgctgtattatttttattagtttcgacaactgcattgtatttccttgtgatgttaacaatgtggaaagctgagtgagatgtgagggagctctctttgtaaatgctgtctaaaattatttcagaataaaaagtttaaaatatatacatacatacataacaaagaaatacaccccaaaagggagccaagaaaaaatggcatttaggatggtcccatagctcacctttcaggtactggatatgcaatacttgctactgtctttcagaaataaactctacaaaatgtcatgtagggtacagaaatgtttacaagaattgttagtaaactgccaatttagagacaaactccatttaagcattttagcaattgcttaataaagttatgtctgattgttaggagagcatgaaggatctccatggaaaactcaaaatgtgtcgtatgaactatttacacgcttattcctgtatattaaagtgaaaaccatatgttttacacatacacagctataatgttagacagtatattttggtgtgtaccttgtgtttggagatatgtaaagatatctataacaaaacagttgaatagcatcttgcccacattggagatagcagttgtagatcaagtgattgtttttcagagtaagtaatcggtcccacctactttacacacaccatttacagagaaaccttcttccagattagggcttcatgtatcagtggcacttacaatgacacttttcacagactgacagagaagcttaacttactcaagtaaaacaagtaaaaactgattagactgtttctagcatgttaatattttctaaatgttatggagaaaaggagcaaaaatgtttctttttttttttttttttggacggagtctcactctgtcacccaggctggagtgcagtggcgtgatctcagctcactgtaacctctgccgcccgggttcaagcaattctcctgcctcagtctcctgagtagctgggattataggcacctgccaccgcacctggctaatttttgtagttttagtagagacaaggtttcaccatcttggccaggctggtcttgaactcctgacgtgagccaccgtgcccagccttatttcttttctttacatgacttatgaattcatttctccttcagtctcattttcttcaaatatgtggtttttctccattgaagtcattttattcacatgaaaatatatttgcaaatgataaacatatataaaactggtatttaaaactcatgtatttattaacaaatgtttgtgttcctgttgttttataactgctagctcctgcgggaaataaaacatacagcagtttctttctgccaagaagcagaattcagtaggagatagataacatgtatcaccaggtggggtaatagtagggtgattaagatacagagttacaagtacagagttgatattctcacagttccaaatacagatcgatagcatgatgaggaaccccttttaaatactgttgcagtagcatgactatgtataagaggccagcatgagagcagaccaagttggggtaggagggtgtctttgaatactggccctagagaatttaaaataatttttctagtcttttgaaaactcaacaagtagagacaagtaatttatatttctatctgttgtgtatataatcgtctctttagagttccagacagctgctagtgtccaaatatgtttttctaaagaaatattttgtttgtgagtaccaacagtcttagtaactctcttatccctcttatgtgctgagtacagtcggaggaagaggaattggagttggtgagtgtgggtttctgcttgaaggaagttgaaaaagatgtagaaagtactaattctcttacgtgttgttatctaaccaatgttccctttgttacacaaatttttttaaacactattcaaacactttgaataaagcaatctactggtactacagactctagtttttctatttataattgtatgtgttgacccattttatttgttggagggaacattggaatagagcctttaaaaacagtagctgtccatgagcataggatacttgttaattttttttttaaggaaagatacaaaataccttatatagctctccaaattattgaaatatttttagaaaatgacttcaccctcgaagttcctcagattgtaacacacgatgttgtgttgtttctctttcaaaaagattacatcatttttggtgaggtcacctttttcagcgttggaattatttcatcctgcatgatacagcctgaaccacaagggggttccctgtttactaaaaggaatgtctgtaattgaatgtgtatataagtttacttttctatcagaaggcgctcttttcttaaaagcaactattgccctttttccaaaacaaacgttttctgttggcttttcctctagaaaataaacttgactaaaagcagcttgcagttgatctatttcttctttaggaactaaaaccaaaacctcacaggagtcatcatataatttcaaagtcagctgctaattaaaggactttaaggggaataaaaacttgaaaatgtttcttagcatggacaaaggttaagagtgcatgaaagcatgggggaggaaggcatccgttggttttaatattccatgtttatgcatgctggtgtgttttgcacagtttgttttcttttcaaagaaggttatctgttccccttaaaatacgagattgttctttatttagctttgtgatcactcacagttttgggtgtagttttgtattggccaactgaaatattctagtcagctgtaaatgttttgaattatattatgaatatcttttggagaaacactttacttaatgataccataatgatcagtaaatgagagtttataattcaagctaaaataattcaccttaggttagacctcactgttcaaggagttgtgaatgcgtccatgaattatctagcactatactgccctcttgtggttctgaaaatcactcactcttgtagaactcagtgccgttgagatgaggagcttagatgagtggaactagtgtttgaagtcttcactgcttttgaagacatgccaggagattgcatgaagatgatgccatggagtaggtagggtccaggccaaactatgtcatactgtattctttcacctagtgattggacttatgaagttccagactaaatattaaagaagaaattaagtccaaagtagatctctatctcgaaaagtcattaaatttataaacttgatgctgagactaaaatatattccgaactggcatacattgattttccacattcctcagagtacatctgtaattacagaacctcagagataaatatattaggtccttgaagactttaaaatacatacctaaaaacttataaacagccatttatattatttaaaacttaatcaattaaaaatgcagaactttatgtgccagaaccaaaatataatcagaagcacagtccgttacaacttagaaagttgttcagcttgccttgagctctaaagtataattgtggatgactctgatccgaagtgcagaaggacaggtgccctggggcctgcactaaagactgtactgttaagaccagcgacagattcctttagaagccgagcaatactagaacaacttgacttcatgaaagctgcagtagactaggctatggattagaaggaataaaaatatgtatcttttttcccaccagttatatagaaatttgggacagagggtttcttaggacaataaggatattatcttatatttgtgtagtacttcagttatgaaagcacttctgacatagtaacctcatttgattctcacagtagctgtgcaaggcagccaggacaaagattgctatatcttctttatttgacaatgaagaagttcagagaggtcaaattattttcccaatgcctaggaaatggtgaatctgggacagaaactcaggcaatacatccacatccacatgatctttctcacatcttctaacctaggttagaaagtagaaattaaaaagaaataaactgagatcaggatcctcatcgaatgtttgtaagtgtctacatctagccaaaggcctttttgtctgatgtacccttttgaaaattgtgatagagaaaatggaatcacattctaactcttcataatctcaaaggcactgaattatactttactgatttggctcagacccccgaatgtcagttatcaggctgtaacataatttataaaaaacaaatagagttgtgctgtggctttcttatgtgctagtgacacagagtctgttgtgttcctctgatctttgattttcaaaaaccgttaccttaagccagtttggcgagaaactgcttctgtcgtactcctacacgttaaggacaatgactgtcttagactaactggattatttaatagttgaattttttttatccattcccagcatggataggatgctacacagatgcatccagttggcaaaaagcatttaatattgctcttccactgccctgtcggcagtacttgattcaaaattctctactcaaagcctctgctacagaaggccaggggactatgaagggatacatgtccgaatctgttgttaaaaaataggtcaactgcatgattggagagaaagaaataagaatacaagctgcacccaataagccatgacttcaaaccgtgttaacacgtaaataataccgcaaagaaaagtagttttgattcctatactcatagacgtacaatccctatatatacagatgacctttgccatcatcaggtatttaaaacctacacatacttcatttaggggagtctgacagtatttgtagtggcatcaagtcctcattttgtgcaacaaatagaagtgctaatgcctgtaacagaagttcctattttaacgtggggtgtctgacactaatcaactattttaaaagaattaatgtaaaaataggacccttcaaattaaatatttagttattctcactagtatttttgaagttttcacatcatcagtgcttcagaaaatgacattcatatgaaactgtgaaaaatgtcacttaaattgaaagtgatttttaagtcaacataaataccacatcagaacacattttctcttttttgatctcacagaacacccaaaggatcagtagttctcaagccactcaacctcttgctaccccagtcgtgtctgtgacaaccccaagcttgcctccgcaaggacttgtgtactcagcaatgccgactgcctacaacactggtgagcctgctctggtgccttccgtaggttttaccgctctctgttttgtgatcaacgtgtgcttctgtgattttttttaagtatatttattgaaataaactatttccagttttttagatttaaattaggatgtatttttcaatgtgctagccttgaaaaaattacaaacaaaatggatagtgtggatagtgcgatgagtaagttattccggcttctccagtgtgaactttcacttaacccctgacacaaagccacgtggatgatagcaaaatggtgacatgcatcaagccaagaggggagcagcctgttgcttgagtattgctgatgtagtttctcttcatacagtatcacgcttttccaggcttttaaaataagatgtttgtctttatgctgtgttaacctgctttgggaaagacatgaatccctttggacctgagacttcaggaggtggccgacgtttggctgtgtcgaacaggctgttttcctccctgtaaccactagcttggtccatgtcatgtgcacctgaggggcaaaacaagggctgttctgatttctcctcggagccagtcactctgcctttgaggggagcttttccttcatttatgtttatttaggcatttcatcttaaaatgccctaatttggggttgtattaggaaagtttaagaatattacagtgatcgtaggagtgcttttagccaagcagactgtatggagaatcgagggcagctggtttcatttaaatttaccaatctaagaaggagtggaaaacacatgtggtttcgctttctcatcagctgagccaaacacctgatgcttcagaggaagacggcagtagttcaattctcccttgcccattactcagagactgcaatgcagagaagttattatgattctcctgagtgtcataagtagactgtggtaaagatggtctgattttagccttcagggtaaatgctttggcacagaactttgaaactgctgtccgcagctacgtgaggggacagagcgttgataacatttgattgccacttgaattctaagaagttcttttaaaacagaatcaacaataaaaggttttattgaaaaaaaaaaagcctcttaggaaatatccattacttttccaaccgttagtgtgaaaaataatgcccaaatttgtcagctgcatactatcttagggattgtgaatcatagcctgttattagtgccttgcacagaacaaggttccagagtaaagccagggatgaagcattcatagaaattctgtttcgacgcattgatcacctgctctgtgagagactgtactagggacatagctttctccaagtttattccaagtgaggaggcaggacatacctaagtgggtaaccgtggaggggaagtcctgaattgttgtgattgtgaatttatactctgagaattgagaagggagggcaaagctatactgttcaaaggtgtattggctgagaagagggagcttgaactgggtgtcagattatggtttactgaccgtttcattacaggtttttcagtatacttagaaattccactatacttatttttagaaatgccattgaattgggaatttattttttaaaagtataaaagaaattaccaaagcatataaaaatggaggcaggctctcaaaatcatcagtcgcttagcgtcagtctcatgccaccttttgaccgactttatctttcttctctttctcgtaacacttactctgtttgaagtttaccatgttgtttttaacttatttccacatctattcagcaaatatttatcaggcagctgctgtgtggcaggcactgtgccaggcactggaaatgcaggagtgcagtcagcagtgaagcctggggggaaggcacaagacacacagctctagggataagctgctgcagttgtgtcaagggctgtgtctcagctcggacaggaaggaacatgcgtgactcagccaggcagaggaggcagagtgctcttgggagagggtgtgcctgtacaaaggctaggagtttgcgggcgggacggggctgaaggaatggggacagagcgtgggtggttagaattgagactagagaggtaagtaatgatttgtagactatgtcaaggattttggaaactgtccggagagcattggggagccataaaaaacttttgaagtagaggagtgccatgaccatatttgttattttaaaaagatgtctttgctgtatatagggttaaaaggcaatgccaggaagccacatcagaggctactgtagtggtccaagcaatgggtgctgatagcatagactagagaggtggcagtagagatggtgagacctgggcaggcttgagagagagcagatagaattgctcagacctggaaattgatgttgggagtgagagggaagggaagtagcaaggataacacccatgggcttctgcacgagctgctgggtgcatgttggtgccatgtactaagagtacttaaggaggaacaggtttgcaggaaaggatgggccatgtcagatgtgtggcgtttggagtggcgtccaaatggacatggcactaggtcgtttaaaagatctagaggtcgaaggagactgtgggccggagggagcactggggaaggcgtcagtgtgacgggtccttgcccgagcccatgggagtgtatagaatgacaagggcagagtcaggacagccctgagcaccagctgtgtcgcttcaactccgttccttttttaaaatgttaattcactaggaagaccaatttctttaaacacctctcttgagacatgagaaagaagataaaagtagaagagttttgccacctctctttggaaccaagtgagaaagacaagtgttaatgatgagctgaaataactccccgtgtgagtgataactaacgtcctaaatcttggtcccagtgattacgactgaagcattcatatgatatgagctgggtatactctaggacaccgagttttttcatgaagttgaaactcttgcatgctgtcagggagtttgcgacagtctaggtactttaaacaaatgcgcttactaattgtgtaatgatgtcactgagcttggcaccccatgtagggattctgtctttcctgtcccctattccctgtcccccaaccccttgcttcattaagacttgctgattcaaactcactctggttgaggttgagtgtttctctttgttccaaagggtagtggcaggcatatttaaagtaacaattgtacagaacactctttaatgatggcctcttatttgaatcatcccagacaaagaaatattgctagatcctgtaaatcttccaagaaaagattttgcggattttagacccacatgtatgttgttttgttgtgaagtatctggcttctctcaatgtaggaactttttattttatttttttttgagaggaagtctgttgcccaggctggatggagtgcagtggtgctacctcggctcactgcagcctctgcctcccgggttcaagcagttctcctgcctcagcctcccaagtagctgggactacaggcatgcgccaccacgcctggataatttttgtatttttagcagatacggggtttcaccatgttgtccaggctggtctcaaactcctgacctcaagtgatccgcccatcttggcctcccaaagtgctgggattactggcatgagccagcatggctggcctcaatgtaggaacttttgcagtagctacgtaaaaaatagattccgtatggaccttccatcatatgcagagccctcttgtcttcctttgtagattattcactgaccagcgctgacctgtcagcccttcaaggcttcaactcgccaggaatgctgtcgctgggacaggtgtcggcctggcagcagcaccacctaggacaagcagccctcagctctcttgtgtgagtaactagaagttttccctgcatctttactcctggcctacacactgtcttttcctatcagtgacagccttttgctctgttgagtttcgtgtgaggaatcctgtaatgattccttttcaggtagatacaagtgtcgggagaaaatattttcttacatggctctagacagtagcttggatactgacaaactaggcattccttgaagggatttggggagcaaggcttctcccatagggacatcctgaggtagagagactcaaccaggatctgaaggggtctgaaggcacagataccacccgcatgcaccatccttctgccctctgaccagtgatgaagctgcctactgcacccctgctcccaagcacctgcctctggctgcactgcttgaaaggcagcctgtaggcattcaggcctccctgccacccttgccattgactgctttggtgagtatctgtagacaagaataggaagacaagctggaccttttgctttctccctgggccacagggaaggaaaactggggacagggtgtcttatatatcagtcaggctccataggatttgtgtgactgatcccagcccaatgcacacaccaaacctcattcacaaagagaatgttccgtatgggcagggtgtaaggatataagcaaagaggatttacagtggcgcccagatgaggccagacatccctgacagccgggagaaagaacagggcttttgtggaaccaggatgacagcagacccatggagcagttggaggagagtgtcccaagagaggggacaacatagcagacccagctggcctccatgaagactggctgccttgcctgtgctctgggcagtaggaataccccaggcccctagcctctgcccaggaagtccccagagagcctgagctcagcagtccctttccctcatccattctgaagtaactgcacagtgaggattgttgtcagtggtcttcttaggaattatgtcatggaaaaagcagcagagtatctcagggaaatttgcctacacaggatttggccctcaggcctgtcctgagcatcctaaatgaatgcactaaaaatagtcctggaaaagcaagtggaaagggctcagagcccaggcccggggaacagcctgtttgcgtcctcctctactgctctcagccagcccctcatttcctcatctggaaaatggggatggtgcgacttgcaccttagaggtgttgcgaggatgagcgatgttgtgccctgtcacagggccagagcagatggggagcagatgctgaggaagaagaggcggtgagcagatgaggctgctgttcctctgtctttctggtccctgcacagcattaagacactgacattgttttgtatactttagctgcaaaagtaccaacgttgtgggtaacagaaccaagtaacgtaagggctcaacggtactgttttctttcctcctaggaagatgggatttccttttgtgccaagcactgaaggaaacgacccaaaccagtcttggggaactctgataagatttcagactctgggcccttttccatcaggcagtgtctctactgtatcatcccagttttgcagaggtacttgcaagccatctgacctctctcttttttttccttcagtgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaagtaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttggaaaaaaaaagccatgaacacttattctaaatgtaaattaaaagttgagccaaactctttgtgtatatagcatcttaaatatattatcacctttgatgtaagtacctatgtattgtatggtcaccagattaaaaagtatatttttgtggattgccgccaatctggggggaaaaggcgaggtcctttattaagtattcactgtttaatatttactattttgttaaatatactgtactttggattttaattattagcccagttttttcagaggattgtataaaggggtttctcccctcactggtggtgaatgtgtgatgttacattgtaatctttgtgctgtatgggttgagcatcattatatattttgtatgtgtacataaatagcaaagtggcaaaaaaaattggtgttaagttcatcctgcataagtataaaatgtgttgtaacagattttataaggcattatttaaaacttgccttttgtgaggaaaaaatgtagtagaaaaagctgacctaatttaattaatattagagaaaatggcaaaatagtagatgagcacaaaggttttataagtggtaaatgattaggggaaaataatcatggggaaagggatcttttttccttgaccctctgaaaacagaacgatgcagctggttacaaaatcctaccgttatcagctcttctgcacattgcagtgatgctttggtatgcggggagaaacactcttagggtgctggtccttggcatgactcttgccattctaattggaattagtgccaccctcagcttggattttgaacaaggccttattctttcaggaagacaactaatggatgatagcaagttcatccacttactgggcttgtgccatgagcaaaattcaaagtcctgtatatctttcattgtagatttttaaatactccttttcctaaaaaactcaagggtttaaaaattgctattttatattttaaatgatattgagcagctacctacaatttctatgtacattttgttcccccccccccacccccccccaaattacgttccttttgacattttcctcatctgctgtttgtgacaagtcatcagccagatttcctgactgacacataggtatgatcagtgcaggagagacctgcgcaccacaggctgcaaactggaggttctgttctcatggcagtttgggcagtaacttttgagagaggccaaaaaaaggaggatgacatgctgtctcctctcttcagtatagacattaggctcttattcagaaaggatttttctttaaaaatgtacttactttactgaactacttacaggcacatttcttcataaggccacacctaatccaaacaagacagtctcccaacactgaagttccaaaataatccttaccactttgtaaaccatttatagctttgaaagtgttaagtgattccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaaaatactactactcaaggctcggagtttgtatttaaattacactgaccaagtaacaatgtattccatttcaggaactgaatatttgactgttaacctttttcccatacgtccagtgtggcatggagcatatggacttgacagacatctctcacccagacgcccacgtgtgaacacacccacatccacatctctgggtggaaaccagcctagagtggggacgacgctaatggtgttgctttagaaccgtcttttcttacccttttagactcgtgttttgtatgagacaccattgcaagaaaattttatccctccagaagtattttattactaaagaacaaaagcaaaaaaagcttaaattgcactggttaaagtacagtttccaacagctgtccttcctcagtactct

SEQ ID NO: 12508 - DNA, 77851 bp, Human
attcccctagtcctaagggattaaagaaggcttcctgaaggaactgatgtttattctgctaagctgccatattaatttttaaaccaatatcagcttaaagggttacacaacatataaaccttaatcaattaaagaaaaggagaataaccaatagataatttacaaatacgaattcccagcctctcaactctatttgttgaaatataatcagtctttcaaggctcttctctgatgttatctctttcattctttcttgatcctctcatttagatcgctttctgctttctactttttttggtgctacatttcacctctaactttgttcttgttttagccccttaaaagattataagctgaaagataaggaccacatttaacttatatttatctcctacttgtctatagaaggcattaagaagtatgtgtagcattacatttaattaaagtcttgtcacttgattttgcctggaatggattctgagaagttccagagttaggcataaccccaagatactgatttcttgatacctaatctcacaagtttaacagtatacaatcttaatgtggtattaaactttattactagtggcaatagcactaaactcaagtttaaatgtattactcatgtccagtaacttttctggtcctgttactttattgtaaaatgtaagaattttactaaagtattcctaaggccaatccggcttttcagtcacccaatcagagacacccttggaatcagagatatccaatcagaattgctctgtgttttattaattctcctggagcttccactttttctttgattctcaaactaattcctgaaccttgcaacacaaaaatgaccatacatcaattcattaaacacttaacagatgctaataaataaaagttcacttgtaattatatcaaatatagtaaccttataccacagatcttaccctctcccccaacatgcttttcctttcaataaaaactccctttatataaattttgagtttacagatccagatacaaaaaattatgtacaaaattttactggtatatttagtttaaaaagccaagcctaggcgcatctacccgacttacagttaagaaacaaaactgatgacttgatgatgatattcctgatattccatcaggaatgtcagggtatgtttcctaacttaaagggcatatcctattttgagagagatccgaactatgtcaactccttacaaacaactcagtgataggcggggctataaaccttactggtgaaggaggttcagatagattaaaacaacttgccctagatcaaggacccttcaatggaactgaaagggcagacgttctaattcaaaagttctacattatttttcgctgcactatacatcttactgctctcagcacaaagcagtgcagatgtgctgaactcaaggacctaggggcgacacctgtagagggtctggcgactgggagggagggagaggggatccagctccggcactctgccaccagccgggagctcacaggcccgtgagctccgcctgcggccttccaaacagccaagagcggagaagcggcttcggtcctacctggggaccacgaagcggcctgacctgcagggctcggcctgtgtccacaggctacccacccccacgggctcaggagttcttagatggcgccggtccatcaaaaagcgaggtccgggacagggaataacaacccacctgacagaagggaaaatcgccgccttgcatctcacttccgggttcgtctcctagcctgctcaggattggctcctgcgtgagggcggggcctcgccgctactttacccgccccctcactgcgtgcggtagccaatgagagccgaactggacttgaagcatctacgttatccataaagtgtcgcgagagaaacggacgccgttctctcccgcggaattcaggtttacggccctgcgggttctcagaggcaagttcagaccgtgttgttttcttttcacggatcctgccctttcttcccgaaaagaagacagccttgggtcgcgattgtggggcttcgaagagtccagcagtggggtaatttaggaatcgcattcgtctcctgtttctgcaggttcccaggcggaagcccagagttaactggaacctcgggaagagcgggccgagtgggcaggggaggggtcctggcgggctcagcgttctgattccgaggttccctgcggtgagggcgtgttgaggcttggaatcccgacggaatctggagctccagatgtggtgggggttgtctcgcggtggcagccactcttccccaaacctggctattttcagtcatcctgctggtgcctaaaggtgttcctccgcagaccacgtgtttgtttatttacactcgctttaaacgcgggcccgttcccttttccaaactagccaggtcctttaaaaaaaatcgtggggtttgaataggaaatacaggattgcctctgttctccagagtaacctatgcgtgcaacttaaaaatatctgcacatctagagttgtttgtgtgttgaaccagaaccgtatgtgaccctttctgcctatttatttagcatacattaatttcccataagagcacgggaaaggaaaataggagtttaatcatcttggtgaaactaggaaacaggatgtacactggagatatattattttctatgctcagttcattaaaaaaaagtatagtgggtgcttagatgaaaatgagacttctaaatttgccagtctaattaagacgtctgtaccttgtgcagcgtaaatcatgttggttaaatacgtgcaggcttttaaaaaatgtgttttatgatgtaattttgtttttagaatttctagaatttggaatcgagtgcattttctgacatttgagtacagtacccaggggttcttggagaagaacctggtcccagaggagcttgactgaccataaaaatgagtactgcagatgcactgtaagcacctgacttctggaatcccttgttatttggggtttctaaagctcgtcaactgtgatcacagtaaaagaaaacttatttaataagcagtaaataaggaacctgtttatgaacagaaatattagtcatcaaaaagggtatttggaatgttttaaatatttatctgtttgttaactggaagctaatatgcagctatagattggagtcttgcagtaatttgatatattgatatagtattgtttatgttcttaggcttcatcttaaattattgaagtgataaatattcttgaattttcctgacaaattcttattagtcaatgcagttctgtttaagatttttagagtaaattcctctagtattaaataagctggaaatgaatttgaatggaatgggaataaataaaaggactgtaaaagttatgtgcactttgggaggccgaggctagcgggatcatctgaggtcaggatttggagaccagcctgaccaacatggtgaaaccccgtctctactaaaaatacaaaattagccaggcgtggtggcgcatgcctgtaatcccagctactcaggaggctgaggcaggagtatcatttgaacccgagaggcggaggttgcagtgagccgagatcgtaaaaaaaaaaagttatgtgggaaagactttagacttggagtcttttaccctagtttcaagtccttggaccctactagctgtgtgaccttgggcaagtcagcagttctctgagccttgcctcaattttgccattggtataattggaataattatacctttttcagattaattttgaggcttaaatgagagaattcatgagaaaatacttcataaattgctacagaaacatgtagtattatgatttgaaaagtattctgacctaccttcttggatatatcagtgagaactgtgtgcatatcatttttgaagtttttgaagagaaatcgtttgtggaaatatcttttgtttgtaaagatttgaattttggagatatatacagagattttttaaaaattcattgtggtttattgaaaatagcctgagttttcatcatgggttttagtcctgtttctgtcactagttatgtgataaagcagttaatttctctgggtttagccttctcatttgtcagagataataatgcctgactctttatctgtgagggttgagatgagatcataaaaataaaagtatttcatacaattaaatttagtgtaagagtattaataactattacattgctacttcacattaaagtacctttgaatattaccaaattcaaattgaaacaattctgtgttggccaactttattaatgaaatctaactctgtagagagtagagtcatgcaagtgtcttcaaggccctgaatgtaaattattgcatattagtataaaattgactcataaacttagaggaaggctttttaaattaacttcgattttcctggaagagtacgaagtcagataaataacaagtttatttatctgaggaaaacaagcaaacttttgggcctgggttacatgagtttgtaaaactggttataacaaggttataaatttttgaagcagttatagaaccttgtaaagatttatgtacatttgttctgtattgaactagtggttaggaaaactgtaatgttaatgataacgttgaatacttcagattttcagatgaactctaaggctaaaaaaaatgattttactctataactgttattatttattttataagtttgtctcaatttgtttgaatatcctttaatgaattattaatatattgaaatgtttcttctttcttaatatagtgatgatgaaaacacatttaaaatattagttgcaacagatattcatcttggatttatggagaaagatgcagtcagaggaaatgatacgtttgtaacactcgatgaaattttaagacttgcccaggaaaatgaagtgagtgtggtttgtatttgtgcactatctaccatattcccttggttaacaagttatttttccttctaaagttagagatttgttttataagctcaggtgcttaccttgcctgcttgaatatcaatatactgaaagctcaaagccgattttgtatgctttgtgtcttaaattcaagtaggagctacttttgtaaatagtctgttaaaatttacaaatgtttttggggtgtttactgaatgcaggatcctgtggcagtgtctattcgaaatgtaaggtgactgtcaaagcttctgctttcagataacgtagaagaaaactggtgtgaaagacaaatatccacaatccacagatgcaaggttgtatgtgataggagccctaagaaaattctaaataacatttcctttgagtttagaggcagaaaaaatcacgtttagattatagcaagatgagtttaatgaagaaggttgtgtttaacttgggctttggaggaagggtagacttttggccagtggggagcatagagaatgtacatccatgtgaagcaggagtgaggaaacccgtgagacagtataaggtatgttaggggccctgtagtcaatttggctcaccagcaggtcatagttagcaagcatgctgagagactagaaggaaggatttgagctgcattaatgaggacttcaaatatcagattgagaaatttgtatccagttcaagagaaagtcttttggcagcggagtataataccatgaattggagaccagttagaggctttttttgaagtattgaccttagggatggaaaagaggaaatgaatgcaagggatactgcaaaaagaggatttgtgtactttggttagttgtagcggggtggggatgagggcaaagggatgacagtgactctgaagtgtgtggagtttgggtgaatagttgtaccaaaaatagaaataggtagataaggaagaggtactgcttcatgtgggaaggtgacaaattctttgtttgatttcgacaaacttagagttggagactgcaatgggacattcagggaaaaatttcagcaggcagttaacacgccagcccaggagagagttggagaataaatgtaaaaattgacttgcaaattaacaccgccagccttgacttttctggagagttctcttaagtttatctgctaggtccttagttcttcctcccaaatatatatggttcctctctactactcttttcacactaataaacttagtccaaaacgatcacatttcacatggcctgcaggaggtccccttccatctttctgcttctattcttttctgctacatctactcagcatagcagccaaagtgaacttttaaaataataaatcagatcatggcactctgttgcctaaaattttccaagtgtccttccattgaatctagtataaaattcaaactacaaggttcgacttgatcttgacccctgccatgaaacttcatctcctactactctctgcctgatttacagtgctacatccacaccggcatgttctactctgaggcccttgcacatctagttctttctgcttggagcacattgatcttggtggggccgacttctgagagttcaagtcttacctttttggagacgtcttccctgatacttccaagcactgttttatcacattactctgctttttttcatagcatatttttaatagcactatctgaaataatttattgaattatttacttgtttattgtctgttgtcttcactagaaggaaaactccatgagagtggaaatcttttgtttgttcatgctgtatcttagtgcttagaaagaatcagaaagcagtgggtatacatattttaaatttcttaattaagtgaggcaatggctggattctttcttttattttaggttcaggggtacatgtgcaggtttgttacataggtaaactcatatgacagggattgttgtacagattattttggcacccaggtattaatcctagtacccattcattatttttcctgatcctctccctcctcctatcatctgctctctggtaggtcccagtgtctgttgttcccctctttgtgtccatgtcttctcatcatttagctcccacttacaagtatttgatttttctgttcctccattagtttgctaaggatgatggcctccagctccatccgtgtccctgcaaaggacattatctggttctttttaatagctgcatagtattccatggtttatatgtaccacattttctttatccagtctaccattgatgggcatttaggttgattccatgtctttgctattgtgaatagtactgcagtgaacatatgtgtgctgtgtctttgtggtagaatgatttatattcctttgggtatataccaagtaatggaattgctgggtcaaatggtagttccatttttagctctttgaagaatcgtcacactgctttccacaatggttgaaccagtttacacccccatcaacagtgtataagtgttcccttttctccgtaatttcaccagcatctgttcttttttgacttttcaataatagaatgtaaggtgcatttttccttccttgaaggcaaaaaaacttgtggccaaaggaggtctgtttcctgccagagaatcctgtatgtgctctttcttttttaactcttgagccctaaaacagaatcttctcctgagtgtaagctacttaattctactttgccctttccttcacttctgcttctactgtttctcttccctgcgtcccttaattgtaactgttccaccccccataaccccaggtagggacttctagatgtgtattatatttactcattctcttgatttgtatttagtatttcttattattgaatctaaagtcttcctgacttttaagtcccttattatgtgggcccatgcccactaaccagtcttagttctgttccctagtttcttggagtctttttttaaaaaaactttttattttgaaacaacatcagtctcacagaaaagttggcaagaatagcgcatagaattccttacccgtcacccaggttttctaacattttgtcacatttgctttatcttctctttacaaatacacacgatttttttcctgaaccatttgagagtaaaccgcatgtataatcatagaaaaccagaaaattagtattgattcagtgctattatataatgttaagatgttgccaattgtccctgtaatgtctgttacagcactttggaggctggttggtggtgtccaggatccagtccaggtttacatattgcatttagttgccatgtctctttgtctcctttaatctggtacattttcctgcatctgccttgcctttgtttttcatgaccctaatattttgaagagtacacaggccagttattttatagaatcttcctcaaattggctataagtggtatttcctcatgattaggttcagattctgcactttcggcaagaataccacagaagtgagtcgtgttcttttcaatatttcctggagtcactgccagccagtttaaaaaatttttttaaatgtttgaatgatggcaaaatatattaaatacataacataaaatttcccttgttaaccatttttaagtgtatagtacagtagtgttaaatatgttcatattgctgtgcaaccaatctccagaattactctcatcttgcaaaaatgacacccattaagcaacaacttcttttcgccccagtatgtttttcatttggtttgttgtttttgttttgtttcttccatgcctttgattgagatcattttcttccttttactcaaatagtgttcattctggaaggcctagcttaaacctcacatttttattaaagttatcctaactaccatacgcacagtgatctataccttgtattcttttgtgtgattaagaacttaagtttctttaggtgcatcgtatacgtcttgaaagcctgtgttagactttttctgtatgatttccctccttcactgaagttattcctagaattctcttcctcacaatcatttatctttcctagtgcaactaacatgccaccatgttagttcattccttctagactttctgtcctcaggcgaattgtcctcccttgagttcaaattcatcgtagtgtcatctctgctgctggttgcttacgtgtccattctagtgcaccccagagtttgacttatgtttaaatgtataacagtttgcctcttccattagagtttgaacatatttaggatagggatcatattttattcatcattgtatcctcaggactcagtagagggtcttgcatagagtcagtatttaatgagggcagggatataatctattttgtagattgctattttttgagcttctagaacctgtaggaattctgtaaataaatgctgaatgaattaaatgaatgatttggattgaatttggtatctcttcccatacgttctgttaaagtgctaagtttatgtttgattcaaataatagaaaaaatatgatcaccttgtgtggcctgaatcagagacttggtgtaattggaagatggcttttttgaagatagcttagtcagctaaattagaaccagattaattaccagattgaaagtccctttgaataaataaaatgtaaatttttaagttgccatatataatagtgtcttttgtgagtttttttttatctctttcatctgtagtttacaaaaattttacctgtaaaacatactaattttaacacctttttctgttgatcaggtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtaagtatatttatttacttgagtgagtgattacttgtgtatggtatttgctgtataagacacgtaaacacacaactgttttgccttccatataagctattttcttagtaaatatcattctttgaatttttttgtacatcattgtattaatttatattttcctaattaatagtggaactgacccagctactcgggaagctgaggtgggaggattacttgagccccagaagcagaggttgcagtgagccaaaattgtgccattgcactccagcctaggtgatagagcaagactccatctcaaaaaaaaaaaaaaaatacatggtgggactgaatatcttctcaggtttatattgtacattttggtatcctctcctgttcatatcctctgcctattttaaaaattgagatttttttgtttgtttttctacctgaattgcagaagttacttatatattctaattagtaaacctttgtgatacatatattttttcccaatcaatggcttgtcttttgactttgtttatggactcttgttgacagaaatatttaatttttatgtagttaaatctattggtttttctttttttccatttgtgcctttgggactatttatgatatttgtcaatccctatattataaaaatatcatcatgtgttttttctttttttttttgatggagtcttgctctgttgcccaggctggagtacagtggcatgagcttggctcactgcaacctctgcctcctgggttcaagcaattctccctgccttagcctcctgagtagctgggattacaggcgagtagttgggattacaggtgagtagctgggattacaggcgcccatcaccacgcccggcaaattttttgtatttttagtagagacagggttttgccatgttggccaggctggtcttgaactccagacctcaggtaatccacctgccttggcctcccaaagtgctgggattatagacgcaagctaccgcttctggcccatcatgtcttaaacattgtacaggatctcacattgcatttagtagaaacgtttccttaatttcttcagcccatgtcaggttttctgtctttccttgtctttcatgaccctgatacttataaagaggtcaggtattttgtagaacgtccctcaatttggtattttctcctgctttctatgattagattgggattacaggttttgggggagaatattcaagaagtgaagtaccctttcagtcgcatcatatcaggaggtgcgtgacatcaacctgatttatcactggtgattttaaccttgatcacttggttaagctggtctctgccaggtttctccagtgtaaagtcattattttttcctttccatatgctgttggttagaattgagtctctgagtccagcttactctcaaagggcagggagttaagtttccacttctgatggacataagttaaaaccaccaaagtaattaataaatattttagggtagatattttgaggctgtgcgacttttctgttcctccttaaatttgttcattaattttagattcatcagtggatcttacctacaacagttataactgtgatattctaattgtgattttccatttcctatattctttctacatgtattaattgggattcttttgtaaggaagatttgtcccttgtcccacatttgtttattcaattgtctatatcagtagaaacccatttttttttcctttgggttataatttattactatcataatttacttgtggcttaaattgttccagctttagccattgggctccttttgagattggctcctgtatccttttgatatatcccaccttttcttctgattttttactttgtctttcttgtcttcagactcagccatttcttcaaggaaccctggttccttttggagaatggtatttggaaaccaagatctggatgttacatgtgcacattactattgtattgttgcttctaggctctcactggacagagctaagaaaaatatgtgtacatactaacccatgagaatagacatactcatgtttatttatttatttatttatttatttaatttttgcttttgagacagggtctggctctctttcctatgctgtagtgcagtggcatgatcatagctcactgcagcctcaacctcctgggttcaagccatcttcctgcctcagcctcccaagtagctgggactatatgcatgtgccactgtattagtccgttttcatgctgctgataaagacatacccgccaagactgggcagttcacaaaagaaagaggtttaatggactttcagttccacctggctggggcggcttcacaatcgtggctgaaggcaagaggagcaagtcacgtcttacatggatgatggcaggcaaagagagaggttgtgctgggaaactcccatttttaaaaccatcagatctctttagacttattcactatcaccagaacagcacaggaaaggcctgcccccatgattcaattatctcccacgaggcccctcccataacacgtgggaattatgggagctacaagatgaaatttgggtggggacacagagtcaaagcatatcagccaccacacccagctaatttttaagaaattatttttggtagagatggggtctcactgtgttgcccagctggtcctgggcccaagcaatcctcctgccttagcttctcaaagtgctgtgattacacttgtgagccaccatgcccagcccatatttatttcttatttagtttttaaagtgtgactttatattgggaggtaaatttttttttgagattttgtccacatgaaaatgtttatgttcactttccccttgattgatagtttggctgcatatataattgagttttaaaagatttgtataatactttgtccttgtttttcaaaattgtgatcaatgtctttaccctccttctattcaaatctaaaacttgggacattttttattttttattttttatttttgagaaggagtcttactgtcacccaagctggagtgcagaggcacgatcttggctcactgcaacctccacctcccaggttcaagcagttcttctgcctcagcctcctgagtagctgggactacaagtgtgcaccaccatgcccagctaatttttttatgcgtttttagtagagacggggtttcaccaggttggtgaggctggtcttgaactcctgacctcaagtgatcctcccgacttggcctccgaaagtgttgagattataggcgtgagccaccacacccagccgggacattttttaacttcagtattttctttctttcatcttatttttaaattgcattctgttttgaaaactgtttccccaccctatatacatgtttacctatttctttgctcactgttgttccttgtatttcatttcttttgtgtagattcagtttccttctttctgaagcacagttttcagtagttttttcatggagtgtcagtgagtggtaaactcttattttttgttgctgttgaggagtctactgttaggtgagttgctagaaagtttagcatagtgattaagagcatgggttccggtataaaacagctggagttcaaatcctggttctgtcatttagtagttgtaaaattatgttagtcacttaactactctaccttagttctgtccttcataacatgggaaagaaatgtgccaatcttacagagttgagaagattgagatgataagaaaaatggctagagtagtgaccagcataaagacaatacttgggtaacttaagattttctcattgttcttaacatgttgcagtcttatttagctgtggatttaattctgtttgttccgcgtgggctttatcatatattctaatgtaatattgtttttcagcaacttggggaaattcccattctattcattatgttttcaaatattgtttcctttctctttctgaatatcatttatatagcatactattaaaaaaaatattgcccataactttacctctttgtgtttcattttggataatttaatcttccagttcacagttcatgtagaaaataggcaaagatagggaaatcccaaaaaagaagactactaaggagttagtagccaattagatttgaagtataacaatgctacaataattgaaaatgtggtatggctcatgaattagtagataggtaagtgaaagagaatagaaactctagaaatagcctcaaatacatgtaggaattgagtatttgatgaaggtcaccatctcacaatgtaggggaaataatggattcagtaaaactgctaggagaaactgttacacatattttaaaaatctaggtgtggggaaggcttctaagtatgacacaagacccagaagtcataaaagattcatacatttgtctttgcaaaaataaatttctgcatgccaaaaactgcctgaagcaaagccagaagtcacagttcaatcaggaagaatatttgcaaccaattgcaaattaaggttgaattccccaataagcagttctttcaagacaataaaattcatgagttagtaataaataaagaatatggacatacttcacagaaaaggaaataacatgacatttaacttttatttttttttttcgagacagagtcttgctttgtcgcccaggttggagagcagtggcgcgatctcggcttactgcaacctctgcctcccagattcaagcacttgtcctgcctcagtctcccaagtagctgggactacaggcatgtgccaccatgcacggctaatttttgtgtttttagtagagacagggtttcaccatgttggccaggctcatctcgaactcctgacctcaggtgatctgcccacctcggcctcccaaagtgctgggattacagatgtgagccaccgcatccggcctaaacctatttttaaaagtttgatttcactcataagaaaaagacagagctatactgaaatatttttctcctataaggttggcataggtctgtgactctcaatcctgagtgcacagtacagttacctaagaacctttgaaaatatggatggccccctctccaggccaactaacttagagtctctccaagtatgtcatgggcattggcatttcttgaaagatccccaagataattccaacatgctgctagcattaagaactgctagcatagatttaagagctggatgacctactgtgttagtgaggtaggggaaaactgtccctcttgtgcactgccattgcattatgtgtaaatctctatggtgggaaattggcagcacctatcaaaattacaaatacatgtactctttgacctaacaattcccttccaggtattcctttacaggtcgactcaccagggcaacaagattactcgctgtagaagattactttgtacaagattactgactgtagcattgtttgtaaaacaagactgccaagaatctaaatgtccattggtagggaactgctcaaacacattgtggtgatccatgcaatggagtactgtgtggctgacagagcagaagaaaggtcttcatgtactgatgtggaatgatttctaaaatatgttgagtgataaaagcaggatgcagaaatgtatatttttctatcatttatgtaaggagaaagaaaaatctgtttatttgtgtggataggtataggatccttttgaaagatgcactagaaattgctaacattatttgcctctgagaagaggagctggatggctgggggcaggggctgacaggagactttaatttgaacaggcaataagtgatagagctgggagttttaatctacctctttgggattctaaagtatatggattttcttccctccccccactacgaataaaaaccatatgctaagtttttaaaattttgaaggcttattaacttttcattaattagatatactactcatacataccacaagcactgtttattatagttggggtttctttaaaatgtagtgctttgagatattttcaaactaattgaaatgaattgtcgcctatgattttattttttaaagctctaaactagtggtcatatgccaatgtagattatgcagtttgcctatgattgcattaatattttggaggagaatcttagggaaaacagcttttgtcccgtatggaaattttaagtaactttttttttttaaggtttccatgggtgaactatcaagatggcaacctcaacatttcaattccagtgtttagtattcatggcaatcatgacgatcccacaggggtaattattgttttcttagagtttgttggaattttggaaatgatcagtttagtttgtctgtggaaagcatgccttccctttttctcattgtgtagtcaaattgagtcaaaagtcaagttgacttttcacattcatacaagcttttatactgctttttagattttttaaaaatctgaaataagaattggtgtatgagctatgcttttatttcattaatactgatgttaacaataagaagccaggagtaggagtgaacacctaacatctgtatagtggtttacagtttgtcagtgtttttataactatcttataaaatctcacttttaggaaatgattgttcaagaccatctttaaatctaaattagattatcttattacctgtttgatatggaagtaagactagagatcctacaagtattttttcattttatctggtcattaatattatgaatcactgattatctatggtcttttttccccaggctttaagacggttgcttaatattacaaagcatttatctcatggctaatttttatttttttgtggccaagacatcataagttttgatgagatattaaccttgcctttggcatgtgattccagttgctgtaggtgatttgtagtacaaaaatgtagcaaatacttttactattgtaattttgttttgagaagacactatcctcatctatgtttttgtaagtagaatatggagtatgcttttaacaggtgatacgatattcatgcagatacctacttttacatacacactaacattctttgaaattattttgcataggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggtaagacagttttattttactgtttatgtccatgtgtgattctttaaacaattgagaaatttggagataagtttgtatctgtttggaaaaaatggggcaaaccttattctttattggtgactataaaaaatgatggatggttttggtaaaaatttttggtgaaaaaatgtcttttcgttactatttattattttgggttttttttagactcaggtgtagaatcctgaatgttagaattatagaataattagcaaaactgcactttgatatcttggaagtctttgaaaggtctaatgcttcactgtacaataccgctagcttataattttgtgcagctttcataatacctctggcaagtagaaaagcatcatggttatttatattttagagataaggaaaatgaaatctggatgttatatctgattctgcaagtgaaagagcaggaagtgaaatatacttttcttaaaaaagctattaacagttgttttaatcactgcagtgttattagggatcatatctccagaaaattgcctttcctcctccattcagactaaggacagattccattatgcctcagtcaccaccagaagcacatctctccagtcatccattttctcccaaactcttatcttatcctgttctattataccttccttaactggactctgtctccaccctgcacccctccctgtcccccagctcttcattataaactctagaactctttttataattatcagattcctcattattatcagtctcttctctgaatgttacctccactttctaaccttcagtgaagcccagctgtcccctgaggttcctgtgtcccatgcagttctcttacccctgggcttttggaaagaagcggggatcactgttctccttgctccacccactgcttccttttctgcctgcaaacacactgttccctttaagcttctgccatctggctaaaccgcattgctttttctctcagactttttacctacttacctaccttcaattttgccagtgtttttagtgtttcaacactcaagtagattaatcttctaatgccttgggctttgtgtgccttgacttttttgtctccagttacatgttctacattccacctcagccatgtattccattggccactcctgtagcattctccttgggagctaggccacttctaacttctagacttctacattgttggcttttcttctgagaccctctctaatccgtatataaagtagcagtgttgtccacccttttaattccatagtgttaattcgccatcttagcatcctggctttttctccttttataatatttaatatttgtaactattttgttgacttgtttttgttagtttctttcactagatcaaggtgaacctgtggagtatgagaattgtttgaaagtcattgagttatttaaaaagcacaatatattaaaacaatgtaagaatattgtttttaaatacacttttatcatcccttttaatatttatttctgcacatgttataatgtatatattagatcaaaagtatatataatttataacaaagggatggtgaaaaatagtattactagaagttttaataagaattttaccatagaaaactcacatttttattctacattttgctggttttgaacatgtatatgtctgaaatggaaaatgtttttcaaatgcaactaactactgttatcaagaacctggaacaggccaggcgtgctggcacacgcctgtaatttcagcactttgggaggccaaggcaggtagatcacttgaggtccggagttcaagaccagcctgtccaacgtggcaaaaccccatctctactaaaagtgcaaaaattagccagacgtggtggtgcatgctgtaatcccagcaactcaggaggctgaggcacaagaatcccttgaacccaggaggtgaaggttgcagtgagctgagatcacaccactgcactccagcctgggcaatggagcaagactgtgtttagaaaagaaaagaaaagaaaaaaaaccctgaaacagctaggcatggtggcttatgcttgtaatcccagcactttgggaggctgaggcgagaggattgcttgagcccaggagtttgagaccagcctggacaacatagcaagaccctgtctcagttaaaaaaaaaagataaaaaaagaacctgcaacatacccacttataaattattccagaattcaaatatatctcccaacagtaaagtgaaatactttgagaaggacataatttagaagcaaaatagattcattttttaagccgaagtaagaaaacaatttaaaaataatgtaatgtccatttcaggatccattccagatgaaaggctctatcgaatgtttgtcaataaaaaagtaacaatgttgagaccaaaggaagatgagaactcttggtttaacttatttgtgattcatcagaacaggtaaaacttttctctgaaaaagtttgagccaagtgctgaggcttcccaaatctgtttctgagcttacctattttagtgaaatgcccttaatctttcaaggttgtcaatgcaagatcagacaaaacatagatttgctttgtgtgatttcattttgaaattgtttttagtatatattaatacctacaagaatatttgtaacataaggataaggcatacacatgaatactcctcaattcaacaaaaaggtagaatctttttgttggattatccattcctttatcccattccttttccctgatcccacctgcttccccctatcccaaagggaagcattattaattttgaattaattatttcattgcttttctttgctgtttaatcacatgtatactcatattatgctatatttacagccaacttatgttcagcattacattactgagatccattttgatgcttggatgtgtaatttatttttactgatgtgtacagttatgctttgcctcctgtcagtgaacaggagttttttgcttttataaaccttgctgttatgaacattcttagacatgtttcctgctacatatatgcaagtgttcttccaggatatacaaatatagctagattacctttcttttgttagtagttttaagaaatttaatctgttggcagggtataggattgattgaaaagaagacagacttgaagaagcaagatttattatctgatcactgcagtaaaaatgtgaggtggtgacagtgatggcaatgaaacagaaatgggagggacacaccggagaagttgtcagggaagaactcaaaggatttggggcctgattatataatttattacagttgtcccttggtatccacggggggtgttcggtccaggacctaaaatcctgggatgctgaaatcccttgaataaaatggtatagcatttgcatataacctacatatatcctcctatgtactttaaatcatctctagattacttgtaatacctgatacaatgtaaatactgtttaaatagttgttatactgtattgctttaaaaatttatatttttcgttgttattttttattgtttttttcctgaatatttcgatctttagttggttgaatccacgaatctgccaatacagagggccagctatatttattgaacacatttattgaatgcagactactctgtgcattcagtgaatgcagacttaggttaaatactcggtaaaagaaagggtttaagaggctgacttgtgttaccttatgtgtgagttcttgaataaactgtgagtttcaaaggaggggcaggccagagtttagatatgtgtgtggtcttcatataactttgcaccactgggatttgttccttctcttccatagagcttcccaggtctaccatttttttgtactatgccaaagtagggatgatgagttgaaaggaaaactcataagtaattctaagaatttaagccaaatgaaaggtagaatagcagcattggtaaggggaatgggtagtcaccatatgatgttgatttttctcattgcccccctcatcatttgattaagggaatgtgtaacagctttctctgctgtaaagttcccattttctacttttcaattaataaatatttttgggaaaatactttgagactatgcaaatatcctgtttcaccttaaacttttactcgctaattttagcatccatgggtgatcttatttccagtaattaatactgtggtattttaattgtaagttttgatttccttcattctttctatatttattaatggaattcttctgtaaggaaaatttgtcccttcttctctatttacttacttatttatgtcattatggacttgaagatccagtactatcagttttttggttgctactgttcctctgattgttgcagctttgaccattgcattctcttttatgttggcctctgtgtcctttcaatgtcttcccacctgttttgaggtcatgaccttagttagctttttggcacctcaagatggtctaggctcttggctcttgtaatggcaaaaatcacaattacttttgcaccaacctgatattttcctacctagccctggaatcaaccatttctccaaggtgctctgattctttttattggagagtggtattcagaaatccacaaatgcgtactaggtgtgcttactgctaccagggcttgctcagcactctgaatgaacagagttatgggaatagatatatgtgtatatagtaacccatgcatacatacatgtctatatatgtgcttaaaaaaccaatgataagttcagactgattctaatccagccctacaaggtccatttttgtcttctccctttccttacttgtgacttctttgtctaacagaagcctggatcatattataaatatatatgtttacttattttttcaatcttggtttaattatatttccaatcctggtataatttgaaattataaagtaatttcaaaattgctaactcatacccctgtgcaaaacaactttcccaactaggttacaatgtttgtgtaagttattttagtctttagcctttctgtatctagttgaaacctaatttttcaaacttacttagctcattttctccccacccccttcactgtggttatgtggttctttggtaatgctgttagattcatttgtcaccctgtgcattctcaagatacttctgctttcatatttaaaacaaagaaggttttcacagattgggtgagaatcttgagccttctgcattttgccttatttcccatttgtttctctacatcaactgtttttttctcttgtttcaaagaagaaagaatctgaatttggagatgacttggtcatgcaaaatctttcaacaaggatattgtgatcacttctaggtcacaaattacagtcagcctaccagcatcatcctcccttcttcttccgggaaagaaccagcactcaatgaaggcacaatggcatcatgttgtatttgggaattattctgcttttctttagtagttgtgataatctcataccttagatgtatgttttttacataaaaacattcctggatacacaagcctgtatattctgtcttccctgcatttattctgcttagcccttctgttctccttgctgttccttgaattcactgaacacattcccactttagcaccatctgctcttctactgcttaggactttctctctccgcgtactgatgcttcatctcagttctctgctcatttgatgctagtcagagaggtcttcctgactaccctgtgtatgtagagaggagtatggcacttctatgtcacttttccctttatttttctttacagcacctatcactaactgacaagttatacatgtgcatacttacacacatgcatatacatcttgtattagagattgagtatcccttatctgaaatgcttgggaccagaagtgtttaagattttggattttttggattttggaatatttgcacatatgttggggatggaacccaagtctaaacatgaaatttgtttacattttatatataccttatacacatggccttaagttaattttatacatgttttaaaataattttgtgcatgaaacaaagtttgtgttaagtatttatgtgtggaatttaccacttgtggtgccatgttggcacttaaaatattttggattttggattttcagattagggactcaacctgcattgcttgtttcccacactagaacaaggactttgttcactgctgtgtcttccatatctagaagaagcctgggacatctgacataaagtagacagtgtttgggtaacagtatttgttgggtgaatggaagaatattggtttggattaaatgaatgcttggttaaactatgtgaacacttttacttgaatctccaatgatgtaagttaatattagggaaaactattccttcttgtcttctatcaccttgcatttcatgtatctttaaataataactgatataggtataataccatagtttgcatatcacttgtttatttaatatttgatattgaaaactcttagcacttatgtgagattgatgtttttactcccattatatttattagtaaaaagataatgttaagaaattactggacatatttatacttacttgcattttctgtgtgttttctctagtatatagttagactgatttatagatttctactattgatagaattcatgcttttctgattgaccaaaggggaaatccttcctatgtaaaacctttcatgatcttcctccaaatatagaattgactgctttctcttttcgggtttccacttgtctgtgtccaataagtttgtaaagctctcaaggtcaggagttagcattgatgatctttacattcccaatcctgtgcacactttctggtacatagaaggatgcaataaaatctttagtgaatggagaaagaaagatctgtatagacttcaataatatgaaatttttctaatcaccgaatttatatttttcaaaatcttgatacaggagtaaacatggaagtactaacttcattccagaacaatttttggatgacttcattgatcttgttatctggggccatgaacatgagtgtaaaatagctccaaccaaaaatgaacaacagctgttttatatctcacaacctggaagctcagtggttacttctctttccccaggagaagctgtaaagaagtgagtgttatatattttgagccaatttttaagaaatctttgctataataactaatcatctcataggtttaaggcctatgttaaggttaccgctaactggcagtattgtcatttatatgatagctttatttttgaaaattgatcattctgtgtagtcttattgtttttccagattttaagccattttcaaaaagagagcatccaattggtgttattttgctgctcattaggcaaattcaagatgcacatttttattatatttcaaggtagatgttttaggttgatgattactaatttcacaaagttcattataaaaaattatcctaaaaccatttaattgaaaattttctgattataagtgcagtataatagatctcatttttaaaacatttttgggggaatgatatgattgtaagaagtagttaacagtgattaaactcaatttttattatgggttttatcttttgaatcacttgagttctgattgttacaatgataatagggttaaagaatatggtagtagaatctatgttggttggttttttttcttcatgagtccactgcaaaatcattttgtctatatgtgtacatgtatgtacatatacataggtatatagatgtaatactatagtctacatatgctaccatcatagtcctgttaacatttttttatgcttattatgtctatcttacaagactgatcagacagggataataatggatgagttgattttactctggggaaggaaaatgtctaccatcttttcctgtgatgataacattaaggttaaattagcagaaacatttatttttaagagtatgattttataaagaagcatttttagaaactaagaaatatgaaagctttcgtatgcacatcaccctgaggaaatttacactgtgactcggtgttcatttctctccacttcagacatgttggtttgctgcgtattaaagggaggaagatgaatatgcataaaattcctcttcacacagtgcggcagtttttcatggaggatattgttctagctaatcatccagacatttttaacccagataatcctaaagtaacccaagccatacaaagcttctgtttggagaaggtaattctttttgataaagtcaatgagatctactttagttgaagaattattcaccttcaattaagtaatttaatagagtagagggaagcctttatgttgattacattctcatgaagcctgtaaggacactgttcttcagtgaatgtgtttaattgtgtccaagatttttttttttaagtcattgagagagaggaatactggatgttaaaaaaaattaaatctctctcctagtttctttcttccttttcaaaaacataatacataatcttttctcctttttaatcctgatttgatgatttgttcattttatttatgaaagcaggcagtaactttgattgaggaatgggagactatcgtgtgtgagaaaagccttagcttctaataatctgtattaggcgtccctttcaccctgaaagctaccccaaatgaaatgtgaaaaatgtgtttgctatccaccctattgctgcaatgtaagtcccaaacctccctctctatgcacattgccacccctaaatctctagaaaatttcagccactactaaggttgggtggattaatgcatttaataatatgtggtttgacagcttaattagcatcacttgctgacgctcagttcttaactctgtgtcagctgtcctactatgttttcttttcatgaaaaatcaggtaacatagtaacaatgataataattatgaccagtgatacttactgatttactgtatgtgatgtgcactgttgacagcatttaatctagccaacaatactatatgtgagtagtttctaccatctatagtttagaggaactgaaccttagataaggtgactcattcagtgtcacagctttttgagcagtgtgtagctcacgtaaccaaaagtgtacgcttgtttcaagatgattgactctagaaactcaaacatagattaagattctggcatccctaaatccaatctctcaagccaaagagatagaaaatgcattaattgcttttgcattgattgatccaggcctgagtcatgtgcccttccctggagtcagacctgggtttttcaactttggcttagttgacattttgtactaataattctttgttgtgggaggcagttctgtgcactctgggatgtttagcagtattctccctggtttgtacccactagatgccagtagtaccccttctaactggtcgtgatgatcaaaaatgtttacagaccttgccaaatgtccttagagaagcaaagtcacctctggttgaggtctactgtatgaacttcacctaaatcctgtgggctttggtgacatgaatccagagaggaaagtagacgctggtgacacaaagtaatagaggttcattttaaacaccaggtgtgcacataactttctgttatctctgtattttatgtacatttctgttattgtacttagttaagttatattattttttataagcatgtgagtgtcttctgaactctttgaggacaggacccatatcttacttttctgtctcagcacttgacctagtacctggcaaaatgatgctctataaatgcttgttggattgaaataattgacctaggagatcatattcttatagattttctctgtgctgtctgatatgtattcactagcacatgtggctgtttacatttaattatttacatttaaatttaaaattcagtttctcacttgtactagccacatttcaagtactctatatccacatatggttttggcaaccatattgaatatgcacatagaaaaaattattgcagaaaactcttttggacttcattgttacagacagtttaaaggacaagattataaagtcttagatgtgaaagaaatctgaggacaaaaacacttgttctgtattgttcttgagatcaggaccaagttataggaaggcagtttttgttccaatacaagaactttctaagaactagaattgttcagctatgaagttggccatctggagatatctaatcactgtgcacacagccatttatgaaaataatctagtgctgtctccttgtaacttggttttacccttaagaacaatatagaacaagtgcttttgtcttcagaactctttcaagtctaagatgttataatcttatcctctcagagtatgagacaactccacatatttgaaaacatcagtcttattttcttttaccttgaactcttccaagataaataatctaaagtccttgcttattgatccctaaatcttctggtgagtctcccatggatcatatgactgcaaaaactagacttacttggttttaagttggtaagctgaggaaagccttattgaaacatgagtagtaatattttaagttttattctaaaagaattattttagagattgaaaaattatgaagaactttcatgaaaggaaaacattaaggaatagtattaaaggagcattacaagaaggtatatttgaaaaggtgtcataaatgacctaggaaataaagatgattatgtagttcaggaaaattcctgtggtaataagctgctattcagccaagttaaactcagtttactacgttgttttttaatctttttaaaaattttgagattgaagaaatgcttgaaaatgctgaacgggaacgtctgggtaattctcaccagccagagaagcctcttgtacgactgcgagtaagtcctatttatatagattgaatattattaattttcaaagcatagtaatgtacagtttacatggtttctttgaaaagtagtgaggagagtgctcatagtaataagaagagcaatcaccatcggaggcaaaaacaaagatataaggatttgagttaatcacagtttaagtgataggtttggtaacttatttttctcattttctaaataatttgttgttatatttaatagattggctgagctctctggcttcatctttaactacctcctctactcacttcattccaggcatcttggccttctcgcagtttcttgggcatgtgggatgtgctcttatctccctttagtctgctcccgtgtcacctcactgcagccctatcatcaagattgcagcccctaccttctctccagtgccctgatttcacttaccttcttctgcttcctcttttcttcttatttttttccccgtaacacatccttctaatctatgtacggtttatttgttttggttattattaggattgtttcctgtgcctataaatctgcttatcctttctatcgtgttataaacaaagaaacaacaacagacttcttctttaccactatgcttttcccttttccaaactcctaccccatgttgcttactctctttaaaagcccctaaaagtatataacctatatctctcttaactttctcttcttcagttcactataaccaaggctctgacttcaccataaccagtggaaaagatgacctttaattgttcaatccaatagatcgtgtctcatcttgctgaattactcttgggcattctctgagttatttgtatccgtcccgtctcatagttagccctcttttcagtgtaggcatacagctttaatgaccaccaatagagtgatgacttcaaaatctttacgtagacctccttcttgttctgtatctccaggagtcccctgaggcctggtactgaggagtgtagtctttaaaccagcagtgttgttgttgcctgggaaattgttaaaaatgcagagcctcagaccctgcatcagaacccactgtattttaacaaaaatctccaagaaatgtatatgttcatgaaaatttgagaagtactgggatgtagactgtggaggtaaagagtacagtgtagagccagacttcctgagcttcattctggcccaaccactagttgtatgaccttgagcaaccgcatcccttatcccttggtttgtattaggttggtgcaaaagtatttgcgggttttgtcgtagaaagtaatggcaaaaactgcagttacttgtgcaccaaccaaatgcttcgtagatttatgagatctaaatggattaaatagtgtctgttgcacagtaggtaatctgttcccgtttctttatcccactgtcgctggcatagtgaagcccttattaatacttcctggcctattgctgcagcctcctaccaggactctgcctccagtttccttctctctccacactaatgccaaaatgatctttgtaaaacacagttttgcatgtcttttctgctaaaaataacttaattattccccagcactaacaggaaaaagtctaaacttttttaggttagcattcaggggtctacatgatgtggtctaaaccaaaaaagctgccgtcccctgggtgcagtggagtttatttcactggaacctttgtccatgttgatcctgttgtgtgggacatacttctctcctcctttctctataccttcttcagcacccacctaaagcctctgtcttcaaagaagcctttcttgacctgcccacagagaacatgcttcttcctttgtgtcctcatccaactttgtacatacctcttatagcaccactcacagtctgcttccagtgatctgtttacatgtttttcttcccagtcagtttgtgaatttcttgacagccaagattgtatttatttatggttgtatccctggccctgaacagcatacttagaacattgaggacatccaataaaatttgttatgaccaaacatttataaatgagaagtttgaaggagagacctaatagctttagcatttagtattttgtcttttataacatggtagctgtagagatgatctgggtaaggctgggcatggtggctcacgcctgtaatcccagcactttgggaggccgaagtggctgaatcatctgacgtcaggagttcgagaccagcctgggcaacatggcaaaaccctgtctctactaaaaataaaaaaattagccaggtatggtggtgcatgcctgtaatcccaactacttgggaggctgaagcgtgagaatcgcttgaacccgggaggcagaggttgcagtgagctgagattgtgcctctgcattccagcctgggtgacagtgagacgccatctcaaaaaaaaaaaaaaaaaaaaagagagagagagagatggtctgggtaatacaaaaataattactttaagggaatcacatagttctcttcattatggcaaaagatcccaattttctcatctgtgtctgcctcacagcattaaaactaaccagactttaatagaaaattggcatttcttttcctaagcacagtaaattacgaattcattcataaaacagcacatattgtcatataagtaatattacaaaactacattgtactgactaaaagacattcattaattcattgactaaatcttactgagtacctgctattatggatgctgcaggatatagggatgataaaacagatgaggttttgaattcgtcgagcttacaggaggtggaggtgcaaagagagacatgatacacaaatatcaaataaatgaacaaaaaaccttagcagatagtgatgatgagtgaaagtgggagcactttagttagggagcattctggataagctgtgaggtggtgcagtgctggtccccatagcgtactttgggaacagctagttgagaagaacatatctctgagaaagaaaggtggtatttgtctttgtaaaggtctgtttaccactacagacttctgtagaaagagtctaccttgagagaagttctcagtttcagtgagataccatgttttggaggtaatcatttctcaaggctcacagatttgattctttattacctggatgttcctagcattcatctttctcttgaggcacatctctaagatgatagaccaatttactaatgcatttaaggctagtattttattttggtgtgtgtttgtttgtttgtttgttttgaaagttcagaaaattgttttcagatggtttgcttggtaggtacctagactattagtgttatcagggggagatgtaatcattctgcattgtggaaattattgcaataccttgattccatcgaacaaagtattttgcttatgcttataaacttttcaaacattagtttctcagtaggataaatgatatagctccatcatgatctactgtagaaaattaattcataaatttcaaagtatcaagcataaacactgtgaatactgaaggattagtgtgtgttttaaaaattggcaaattgttgtttcctagcgttcatagattattctgtgttttcaggtggactatagtggaggttttgaacctttcagtgttcttcgctttagccagaaatttgtggatcgggtagctaatccaaaagacattatccattttttcaggcatagagaacaaaaggaaaaaacaggtaagctagttatttttatgaggtaaaaaaatgttcttataggatttgtgaaggaatctttattaaaaactgtaacataataatggaagatgttttaatatgattgtaatgtcttaaacaaattgacagtgggaataattctcttgtcttctaaaaattagatagcaatcttttttattattattataccttaagttctagggtacatgtgcacaacgtgcaggtttgttgcatatgtatacatgtgccatgttggtgtgctgcacccattaactcgtcatttacattaggtattgctcttaatgctatccctcccccctcccccaaccccatgacaggccccggtgtgtgatgttccctgccctgtgtccaagtgttctcattgttcaattcccacctatgagtgagaatatgcggggttcggttttctgtccttgcggtagtttgctcagaatgatggtttccaccttcatccatgtccctacaaaggacatgaactcatcattttttatggctgcatagtattccatagtgtatatgtgccacattttcttaatccagtctatcattgatggaaatttgggttggttccaagtctttgctattgtgaatagtgccacaataaacacatgtgtgcatgtgtctttatagcagcatgatttataatcctttgggtatatacccagtaatgggatggctgggtcaaatggtatttctagttctaggtccttgaggaatcaccacactgtcttccacaatggttgaactagtgtacagtcccaccaacagtgtaaaagtgctcctatttctccacatcctctccagcacctgttgtttcctgactttttaatgatcgccattctaactggtatgagatggtatttcattgtggttttgaattgtatttctctgacgggcagtgatgatgagcattttttcatgtgtctgttggctgcataaatgtcttcttttgagaagtgtctgttcatatccttcacccactttttgaaggggttgtttgattttttcttataaatttgtttaagttctttatagattctggatattagccctttgtcagaagggtagattgcaaaaatgttctcccattctgtaggttgcctgtccactctgatggtagtttcttttgctttgcagaagctctttagtttacttagatcccatttgtcaattttggcttttgttgtcattgcttttggtgttttagtcatgaagtccttgctcatgcctctgtcctgaatggtattgcctaggttttcttctagggtttttgtggttttaggtgtaacatttaagtctttaatccatcttgaattaatttttgtgtgaggtgtaaggaagggatccagtttcagctttctacatatggctagccagttttcccagcaccatttactaaatagggaatcctttccccattgcttgtttttgtcaggtttgtcaaagatcagatggttgtagatgtgcattgttatttctgaggcctctgttctgttccgttggtctatatctcttattttggaaccagcaccatgctgttttggttactgtagccttgttgtgcagtttgaagtcaggtagggtgatgcctcgagctttgatctttttgcttaggattgtcttggcaatgtgggctctgttttggttccatatgaactttaaagtagttttttccaattctgtgaagaaagtcattggtagcttgatggggatggcattgaatctataaattaccttgggcagtatggccattttcacgatattgattcttcctatccatgagcatggaacgttctgccatttgtttgtgtcctcttttatttcgttgagcagtggtttgtagttctccttgaagaggaccttcatatccttgtaaattggattcctaggtattttattctctttgaagcaattgtgaatgggagttcactcatgatttggctctctgtttgtctgttattggtgtaggaatgctgtgatttttgcacattgattttgtttttattttcatttttttgagacagagtcatgatctgttacccaggctggagtgcagtggcgtgatctcagctcactgtaagctccgcctcccaggttcacgccattctcctgcctcagcctcccgagtcgctgggactacaggcacctgtcaccacgcccctgctaatttttgtatttttagtagagacggggtttcaccgtattatccaggttggtctcgatctcctgaccttgtgatccgcccgcctcggcctctcaaagtgctgggattacaggcgtgagccaccgcacctggtctgcacattgattttgtatcctgagactttgctgaagttgcttatcagcttaaggagattttgggctgagacgatggggttttctaaatatacaatcatgtcatctgcaaacagggacaatttgacttcctcttttcctaattgaataccctttatttctcctgcctgattgccctggccggaacttccaacactgtgttgaataggagtgatgagagagggcatccctgtcttgtgccagttttcaaagggaatgcttccagtttttgtccattcagtatgatattggttgtgggtttgtcataaatagctcttattattttgagatatgttccatcaataccgaactaccttgacgtcacaaggcaccagcagtacccatgattgcttttgcatcgtcagtgtagcaatgatggcagatggcaaaatggcaaataacatcttaggattattatgaaagtatttttgacgttattactccctgaatgggtcttgaggacctccagaagtctgtgcttcacccagtgagaacagctacaagacacctatcctggaggtatgaacgagaaatactgactgtggggaaaagaccgtggctattaacaaaaatggcttgttttgcctcaaaatttaccatgttgagcaagctggcagttgctaaagtttggccttaccttctccactgacaacttgcaatgagtatgcacattttaacattatgatagaagctattttttgatatacttctttttttctaggagaagagatcaactttgggaaacttatcacaaagccttcagaaggaacaactttaagggtagaagatcttgtaaaacagtactttcaaaccgcagagaaggtaatttcttacagttcacattttgaataatggctaccttatagtaacagattttaatttaggatatgtttagttgatagtttaaacaaaatgaatcctcaaaatgtttctatgaagtaagtagggtgacaattaattacattcatttgcagttgctgcacagcagggaaaattagtgtttaattaatgttagttattagtactgttattaatatagctgttattgttgatgttgttattctctttctttgtatctctgttgcaattattaaactgaataattttaacttaaatcagggacattcttaagtgaaacttagaagtaactagggtgacatttacattcatttgtagttgctgcacatcaaagaaaattagtgtttaattaatgttaattgtgaataccattattaacataactgttattgttgttgttattttcttactttatttgtatctctgttacaaagatctcaatccagatttagttttctcacatttggatgtaatttcagaattattctacaaacaaagacagccaaatgatggtgaagccactgaaacttacgtcataagtatatgccactctaagatcctccggttgtattagtttcctatgggtgctgaaacaaatttccacaaacttagtggtttaaaacaacacaaatttattatcttacagtcgtgtaggtcagaaatcgtacacaggactggaatcaaggttttggcatggctgtcttcctttttggaggctctaagggagaatccattttcttaccttttccagcttctagaggtgcctactatgttccttggctcttgctctccttttatcttcaaatcctgcaatgttgtatctctctaaccatttccccagagttatttttccttccagctcccatctgcctccctcttgtgcttttcaggacccttatgattacactgggcccacctggatagtctctgatactctccctattttacagacagctgattagcaacctttgttcctctttgccatgtattcacaggtcccagagtttaagacgtggacatctttagggggctcttattttgcctatgacactggttaatttcatctctattaatcatagctgccatttttggactccatatcctagccatcaggcctctacatttcacgtgtcctgtactcctcccccatttctggttttgactttgctttttctggttcctgatattagtaggcttaactacagctgttcactatattttttctctggtaacatatttggtaattttccttgctcatctataattattttgtaaggaataaaaactatttctgcatccagtgatttgtatcttacagaatgtgcagctctcactgctaacagaaagagggatgggtgaagcagtacaagaatttgtggacaaggaggagaaagatgccattgaggaattagtgaaataccagttggaaaaaacacagcgatttcttaaagaacgtcatattgatgccctcgaagacaaaatcgatgaggaggtaagtaactaatttgagtgtctaggtctatttaaatagtctgtctttaagagtagctctgagatttttttctggtaaatcactatttaacctctctgatttgtttagtttttctcatctataaaattgaaatgataaaatgaaggttaaattagaaaatgtagaaaatgcctagaacagagtcttgcatatggttggtactaaagtgttttgttccccatggatagtatcttctcttaaagatcctttgaaagggctttaaagtgaaccttgtaggatggtaatttttgttcattttaatttttttagtaagttttgattgagatcttgaatttcatttagaaaatttctgctaagcaagaagcagtggaaaaattacaggaaaagctgtctagacttgactacatagaaattataaatgtttgcatatcacattgtcaaaaaacaaaattaaaagatattgacatgaaaatatttgtatgtgggcagaaaaaagtttaatattcttaatattaatgagctcttagaaatcttaaaaataattaaacatttgatagaataatgaacaaaggacatgaataggtggttcataaaagaaatataaatagctaataagcatatgaaaatggtgtttagcctaggataatcaaagaaactcaaatacatcttttgtttgtcaaattggcagcaatttgagaaaaatagtatctagcacactgctggtagtagtattacgtttgaatagctttactgaaaagcagtttggcagagtatattaagaggcttaagatttaccctttaactcagcctgggaaatttccctatgaaaatagtgaggtagagatttgtgtatggagtgattcatcttagtgttgttcatagtggggaataattggaaatgttttgatacaataaatgttggtacatataccatataaaattttacacagcttaaaaatgacattttggaagaagaacatgagaagatatttctaatctaatgttaattgggaaaagaatttcaaagataaaaaactgcgtagtataatctcaattatttttattttatatgtaattgtgtatgtttatgtaaataaagaaaatatcccagatatattatcaacagttatgtcaaggtagttatattacaggggatcactttctctatttcccagattctccctaagcagaagaacaaaacaatgttatttaaaaaaaaaaaaaaaactcattcccttattttagtgcttttggttaacatggttctcttaaagccttatggtgtcaatgtgtaactaatattatttaataccaagtacttccagaggtaggacaggcagttcaccctctaaaaccattcactctatgactctggatgtgttgggtttgctaatttatagcataaatagatttctcaggtacataccagaaataaaacataaccatccccacctggagtgacatcatgactcctgagcagcaaagtctgtgtggggtgtgtgtgtgtgtgtgtgtgtgtgtgagagagagagagagggagagagagaaagagaaagagtgtgtgtgagtcatggtggctctgaccagacacccgtgttcaaaatcaaaacccttattagctgtgtacccatcattgagttatctaaacccacctatccctcagtatcctcatctgaggataaaatggtgatgataataggccctccttcaaggttgttgtaaggattagaagaattaatccatgtaaaatccttagaatactgtctgacacatagtgcctgttcagtgttcccactctgactctcatttctcttctgtgaatggcttagcacctttggtatgctacttatcacctagggcacgattacatactgtctcatcttttaaaatattgttattcttgtatttttcctctactgaatcataacaaacatgctgttatttctttcagcttaagaaacaaacaaaactctcgatcccattttcctttagctactgctctctgttcctcttctagagcagaatcgcttcaaagagttttctgtatttgctgactcattcttctctctccattttctattaaatctatccactcaggctcctgatcccatcattctagtgaagctgcacttgtcaagatcaccagtgactgccattgctaaatccactgtcagttttctatcttacatctcacttgaccttctttgaaacatgttttttattggatttcaggataccagactcttgttatcttcctgcctcactggctgcatattttcagtgtcttttgttgattcctctaattgctccagcctcttacattggagtcttatttgctgttccctctcccatatcatcaattgattatagattccatgagagcagctttttgtctgttttgttaataactgtattctcagtttctacgataatatatggcacattgaaggtgctcagtaaatatgtgctgagtagattattaaataaatgggcttaaagaacatatacatagctgtataataagagccttgtgagcaggaaccattaaaaaagaaacctgtagtctccttcttgataccaggaccatgctcagcaaaccttcatgagttgactcttaataaaaatggatcttcaggggccacccacttcagatcccatttcacagagcctcctggatgtcttgcagcaaggtgcacaagagtgatttgcaatgtaataaatatttcaagccttgtcaaggagatatttttgtttttaactagtttactgaagtgtaatacccatagggtattagaatttttcctgtacagtctgaaagactttttcagtgatgtgaaacattttggcagcaggtaatataattttgcttcgggtcaatatgagtttttttttttaagagtacattgtgcaattttaacgttaataattggaaaaatatgatttacttttgtgagacattgttaaatttgcaagttttataacataaagcatttcttaattgtagccccttgttttatatttacataactggaataggcaacatgtttgtgatttactctgttatgatctaggtacgtcgtttcagagaaaccagacaaaaaaatactaatgaagaagatgatgaagtccgtgaggtaattattctgctgcaaattcttgtgtttatatatcactttcttaaactagaataaccagtaggtttagttagaatagtcagtccataggtctaggggataggagtgagctggggttggcttaggatggctgcttttggttgatttcagttcagcctacaaatattctgctcattgctctttttttccattttgttcttgtctaaaacctgtttagcaagtgcagtgactcacacctgtagtcttggctacttgagaggctaaggttggaggggattgcgtgagcccaggagttcaaggctgcagtgaactatggctgcaccaccacactctagcctgggcaacagagtgagaccctgtctctaaaataaataaataaaaataaataaaacccatttaattgtatgtgtgtggggatatatacaacaaaagcccctattactcaaaataatatctctttgttagcagagcatcttatagataaaatcttatcttactgagctgatattattttgggcaaaaaagaaacttaaagtgttttggttagcaatgttaaccataagtaagcaagcatgggcaaatagacaatttctattatctattctaaaatattaaaattagcttaagcaccatcatcactgtcttctcagtctcattgcaggtttgaatctacaagttagcaaccatttacttaaatttggggcctctacctggtacttgttgaatttatgattgaaatgtattttcttattttctgattgcccttagtgttttatgattgctatctagtatttaaaagttataaactatgtactgttagttttgtcttgattgctttcattcagcaaacattttatattgtccctgttatgggttagatattctgctttatattaggactgtacatataaaaaagctgaggtctgtagccacaagattttctcaatttagtagataagagacatttgtgtaaggaagatatttattgaattatttttcctaggtgcccattttataaatgaggagacagaccagactcaaggtcatggagtggcgctagaatttgaacatatttctgactccaagtgtagacttttctatcatcctgtgtcctatcaaaattttagattattataatattaattcggtgcattgcaaatggatggttttctaaaaatgaaaaacttctaaaagtgtcatgcaacacatcagaatcactgttgaaatacacatagttgcaaccactgtatcttttacaggttgttttttggaagctaaggaaaagaagctatagattagaaatggcttaacacgtttattatatttctatttatcttataaggtgcatttaaaatagaaatagtttgccaaattgcaagaataatgctaggaagaaatgattcctgattcttaaatatctagcttaaaattgattaaccctttcaatttaacagggtacagaaatatttctttacgtttgagtgagttcttcatgtttgaagcgacaaacctcaatttttcattaagcttttaaaagagttaagagtgaacgtcttatacaaggaaggtgggagaggctgtgacaaatttcatatgggagttttacagaagaaataacttacaagttcagatattcagctatattttaagactaaaatgtaattggggcttcctaggtaatttttcagcatatcataagatattatatattttttcattttcagcatactatttagaacttaggtaatggagtctgaaactctgccaagctgtaattcacagctttgcagaatcatttggcttagaatatgaatcccagcgccatgcttaaattacttatactgacaaacaagactattagctcttctatttggagaaaaaacagtatgctttaaagtctttcaggctgggcattgtgacttacctgtaatttcagcactttgggaggccgaggcaggtggatctcttgagctcaggagtttgagaccagcctgggcaacatggcaaaaccccatctctacaaaaaatacaaaaattagccaggcatggtagctcccacctgtagtcccagctactcaggagacttaactgggaggatcgcttgagcccaggaggcagaggttgcaatgagccgagatgacgccactgcactccaacctggatgacagagcaagaccctgtctcaaaaaaaaaaaaaaaaaatcttttgttcacatagaaaaactctcaaatcttttctttaatgataaattcatatttgaataaaagagcaaacagtaaccattaggctttgcgggacatgtgtggtctctatcacatattcttgtgtttttttgtttgtttgtttttttattaatggccctttaaaaatataaaaactattcttagtcttacccacagtcgttagtttacctggcctctgatttcttatgttctacctcaatttgaggtgggttgataccctctttcaaaatataataccaggcactatcaatagtgaagaagtgacccacagaatgagagaaaatatttgcaaatcatacatctgataagggattaataagcagaatatatttttaaaacttctaaagctcaacagtaacaataacaaaaaaacccaatttttacaatgggcaaaggacttgaatagacatttctccaaagaagctttacaaattatagcacatgaaaagacactcaagatcaccagacattagagaaatgcaaatcaaaaccacagtgagataccacttcacacccattaggatggctgttattaaaacaccataaaataacaagtttcggcaagaatgtggagaaattagaaccatatacattggtggtggggatgaaaaatgggtcagctactgaggaaaacgatagcagttcctaaagtagttaaacatagaattatcatgtaatatagcaatttcacttctaggtacataaccaaaagaattgaaagcaggaacttatttgtacatcagtgttcgtagcagcatgattcacaatagccgaaaagtggaaacaacccagttggtcatcaacagatagatggataaacaaaatgtggtatgtgcatgtaatggaatattattcagtcttgaaaaggaatgacattctgatacatgctacaatatggatgaaactctgaaaacattatgagtgaaaaaaaaacagttgcaaaaggacaaatattatatgactctacttatatgaggtacctagagtaatcagattcatagaaacagaaggtagaatagtggttactggggagagggaggaatgtgaagttactgttgaataggtatggagtttcagtttgggatgatgagaaagttctatagatggatggggggatgattgcataaccatgtgaatgtacataatgtcactctactatacctaaaagtggtaaaaagagtaagtttatgttatgtatatttcaccacaaaaaaaaagtgtttaacagtaggatagtatgttttcaaatctcacaaaatgtatatggaaacatttttgccattggctctagacctgcactcatgagttaagctcttagaagtaatacattccaaagataacagtaaactctgtttttcataggaaaggtagagttaaaatacaatttgaatatacaatttgagatgataaaaatgaagatacagtatttagacaaagggaaaatacaaagtttagaaatgatggttagtaattgattccaagaagtaatcataatagggcatatttattttaaattttgctacatactgccacattagtccaaagatgtcttaactagtttatattctcaccattagtatttgggagtgcttgtttcctcacatctttaccatcgtgatgtattactgtatcttttgatctttacaagtctaaggggtaagaaattatttcctactgttgttttcagttcatactacttttttttactaatgagtctgcctaatttttatgtttataaatcatttgtatttatatgaaacacatggtcattttgtttggccacattttctctttcgagtagggtattggtctttctcttttttttttttttttttgaggcaaagtctcactctgtcacccaggctggagtgcagtggtgtgatctcagctcactgcaacctctgcctcctgggttcaggtgattctcgtgcttcagcctcccgagtagctagcgcgcgctaccatgcccagctaatttttgtatttttagtagagacagggtttcaccatggtggtcaggctggtctcaaactccttaccttaggtgatccacccgcctcggcctcccaaagtgctgggatgacaggcatgagcaaccgcgcctggccgggtattggtctttctctaattgatttgtaagagcactcacttgaacacatttgtgtgtgtgtgccctctctttctctctctggatatatacacatagtaatatagcatatttagggttttttgacacataaagtatccacttattcatcagcttatttgtttaaatcaggaatgattggtgattacatggttctgattttatgaagatatacatttgggttttttctttctttgttccattaatatagtgagttatattattatgtacatagcttattgacccatcctggtaatatatccattaccccctggtaatggatatattggtctttccataagcttctggagtctctatttgctttcataattataaataagattctgtaattttctttttgtgcacgcagttctttgtcagtactgtgtcatactggcattgtgaaaacagtttggaagctgtctttctgtatgctctggcactattgaaatagcagtgggcttatctgttttttgaaagtttggtagaatttacctacgaaactttctgattgtggtccttttttgggagtatttttcttttaataattttctcaaaattttctttgataattggtttgttgaacctgtttttttcccaccttggatcagattaagttattcattttccagattatttagaattgagcattctctcataagtcttgggtcttccctcccattcttccttctttctttttttcgagacagggtcttgctctgtagtgtgctaccactcccagctaatttttaatttttttttttatatagacggagtctcgttatgttgcccaggctggtctctaactccagggctcaagtgatcttcctgacttggcctcccaaagtatggggattagagatgtgagcttctacacctgtagtgctagtattagagatgtgagcctctacgcccgtccctcttatttctaatgatgtatatttgtgttttcttcctttctttaaagctttgtgatttttattaatgttattgttttgtcccaaaggaccagtgcttatatttattcattctaatgtgtttttgtttaaaatctattaatatatggtttcatcttcattctaatacttggataggctttattttgtttctcctagctttttggatacagaattaacttatttacatttattcttagcaggctataggctttcttataagcattgctttagctctctcatatgttgtgatgttcagtattcttgttatgattttctagatgttctgcaactttcgttttgttttatagttttgactctggtttgttttcaggaggcaggtttttgctttattattaattttttattttattgcatgatgattagacagtgtgataaatttatttctcctatcaaaaatgtattgagatttttgtttgcaccctgttatgtatcagctaaaaagtttcatggggtcttgaagtatattattaattttcagtgtatagaattcaacatttatcaattagatctatcttattaattatgtgatttagatcatcttttttctcttaagtctgctttctaaaagcatacagctggttccttttatttgtggtagttatgtcgtataaaatcacttccagcacagaattagcaaatggtgaatcattgctcctaggggaaatacaaaattagctttctatgagccactgataacgtttttgtcagctgatcaatacgtaatctttttaatgtgtttctgtttaaagatactgtatttaacatttgattcattagcattgaactcatagccagtagcactttaacttatacttgaattaagtttatctaatatacattttttctccaaaagtcatattgcagcctttttgcatgtaggaatgaacactaaacatgttgagggggtcatttgaaaacaccacattaccaaagcaaaagtacaaaaatgcagaaaatgcaataaatatgtagtcatgtgccacatacaacattttgatcgatgtcagactgcatatccagtggtggtcccatgagattataataccatatttttactatatcttttctattaagatatgcttagatacccaaatacatagctatggtgttataattgcctgcagtattcagtacagtaacatgttgtacaggtttgtagccaaggagcaataggctatctcctatagtctgggtttgtagtagactgtaccatttagctttgtgtaagtacacactatgatgtttgcacaataatgaaatcacctgatgacacatttctcatgaggcatccatcattaagcaatgcatgactatcacagaaaggacactttaaagtacacaagtggaaacaagaaggcagagtggctcattgttcagcctcagctgggaatatgtgtgtcaggcaattcaaaatatttaccactctgcgtctccataaatgatgccaaaagtatcgtgagtgttgatttttagggttacagagaaattttggcaagtcggtgaatttgcaaatataggattaatgaataatgaggattaactgtatttcatgtgggacaggaaagatgaattgaaatcactgttgtttcttatattttttgttgtatttcctgaagtgttttctttttgcattgtaatgctgtattgaaccctgcatgcagtgagttagctgtgatttcacctcagctgagatcatctcatcatgaagttgccacttcagtcccactttatgctgcctgccttgttcacatctcctcatttagccctgggtctccttactttatggtatcacagagcttagaaatgttctggtcagctattcttagacccagaactgccattccaagcaagagagactgttatcatgtcttcttgggatttatacatcagttttggagagctgtataatacctgaaactcttctcacctttctcccttagctaggtcaaatatttatcatattcattaactcttctttatagtttgtgtgtttgggggtttggaactattttttaattttatggaaaatgtattttgtttttgttctcttactaccttttgattggtttaagggaagatcaaggcaaaattgcttttatttatattttattttattttttggtgacagggtctcgctctgttgccaggctggagtgcagtggcacgatgtcttttctaaatggattcttaccaaattaaaaatgcgtggcatgttcttggtcctaaggtgtttattccttcttaggcttaggctttcagttgatatattctccttaattcttccgtttcttttcattttttttttaggcaaggtctcactgtgtcacctaggctgaagtgcagtggtgcaatctcagctcactgcaacaactcccctccccactgcttcccccaggcttgagcgatcctcctacctcagcctctcaagtagctgggactacaggtgcatgccatcacacctggctaattttgttcttttgtgttttttttttgtatttttggtggaggcagggtctcgccatgttgcccaggctggtccctaactcctgatctcaagcagtccatccacctaggcctcccaaagtgctgggattacaggtgtgagccactgcgcccagcccttaattctctttaccatatatttgtgagagattgttactcatgtttttttctgattataaaactaattttttagaaaaagtgtaatatagaaaatatgtaatattcaagaacaaaaaacaaaagcaccctaaaatattagtgcccagagataacggctattttttgtaagtttttttcttattatttcctaggagccgattctaaaaagtagctcaaatgatgacagtctgttactgtcaaatgtggcattgaattagggatgattgccagtattccttctagttctgaaaattttgattctgtaaaattttatttttcttggtaaaccttttcaaagggtctcattttataggtagtatggtagattggtctgacagataataagtattaaatttgattggtggggaggttctcctttacacatatataaatattttttgtttttatttttatttttgagacagggtctctctttgtcacccaggctggagtgcagtggtgtgatcatagctcactgcagcctgtatctcctaggctcaagtgatcctcctgcctcagcctcctgtgtagctcgggactacaggtgcatgccaccatgcctaattttttttttttttttttttttttgtagagacggggtttcgctgtgttgcccaggcttgtctcaaactcttgggtgcaagtgatcctcccgcctcggcctcccaaagtgctgagattacaggcgtgagccactgtgtcagcctcctttatgtttttatagtatgattagttcatgtcaatgcctaaattaatgatttttaggatggtacgttatctcattgtgtgtactttctccttcttctccctcttaggctatgaccagggccagagcactcagatctcagtcagaggagtctgcttctgcctttagtgctgatgaccttatgagtatagatttagcagaacagatggctaatgactctgatgatagcatctcagcagcaaccaacaaaggaagaggccgaggaagaggtcgaagaggtggaagagggcagaattcagcatcgagaggagggtctcaaagaggaagaggtgagcactgagttcagtcctgtgcacattcacacttggcagttgagtggaaaatacagaattagatcttgtcagagttgaattataagttttatttctaaaacacggttctttaaaaatctatttttataatatataaagacagtctttaaggcagttctgacatgtgccttttacttaaataaattttgaatggccacatgcacttagggttttaattgttcttagcacataccttataaaagcttcactgtgtttgtcacgtagtaccttttggatacatttaatgtcatatgtattttcacatgtgcaaagtaataggcaaatatgagttgttaaagaaaatagctaaaagcctttggcaacaggaggaaaactccagatcatacaattattatttttgttactgtcataagatacaaatacacatatgcttatcaagtagtctttataaagtcagtttaagaaagaaaactgccccccaatttgattcctaaaactagtcattaacatagtcaacattgtatttactgtgagactattgtcattgaatagttcacgccaatagaaattggtcattcagtgactttctcacacattatgtcagttcatctctaaagattttttaaaattgtttttattaaatatgcatccataggaattttaagctggtgaaatgaatattaatttggtttaaaatctccagggagagaaatcctcatcttttaatgatgattattttcactattcttacatttacaaaatttttccttaaaaatttttatttttgttttttaatttttcttgagatggagtcttgtctttgctctgttgcccaggctggagtgcaatggtgcgatttcagctcactgcaacttccgcctcccaggttcaagcaattctcctgcctcagcctcccaggtagctgggattacaggggcccatcatcatgccagttaatttttgtatttttagtagaggtggggtttcaccatgttggccaggctagtcttgaactcttgacctcaagtgatcctcccgcctctgtctcccaaagtgctgggattacaggcgtgagctaccacgtccagcctatttccttacattttaattggataaattaaattggataaactgaagtgtggcctaaaagaatagtctctgaaaattggtcagactctagatgtttgttcttatatatatgtctggctttttacagacaaactatttgacataagtttatttagctttcattttttggtgttgtatgaaataaaccttagctgctgataggcttgtacattgactgttcatttttctaacagcagacactggtctggagacttctacccgtagcaggaactcaaagactgctgtgtcagcatctagaaatatgtctattatagatggtgagtatagactgcaagtgattatttataaattccaacattagaaagaccaaggtaatcaccattggtagcccttatttgtgttgcaatcattgggaagttataagggcaattaggatcacaggataaattattttttaaaagatctttgctatgcattagagttactgaagagggtaagcttttaaaatcatgttttataggccaggcacagtggatcacacctgtaatcccagcactttgggaggccgagacaggcagatcacgaggtcaggagatcgagaccagcctggccaacatggtgaaacccggtctctactaaaaatacaaaaatcagccaggcgtggtggcacatgcctgtagtcccagctacttgggaggctgaggcaggagaatcacttgaacccaggaactggaggttgcagtgagccaagatcatgccattggactctaccctagcaacagagagagactccgtctcaaaaacaaaacaaaacaaaacaaaaattatgttttataatttcttactttcagacaaatgctgtttctgtttggcagagagaccctggaaacaggaaagtgaagtagttggtcactatatggacagtggtcgaaagagagaggaactgtctctactgtttccttgcttcccccatactgccctgtcagtctctgctttccatatagagaagtcatgtgacctatatttaagagaaattatggctaggcccttggaattaatttgtgtatatcctatggtctaaaaattggcctcaaggggatctgtttaactatttttaatattatagatgatgagatcagcctaaaatgttagtcatatttacaaaaagtatgcattaagataggtggtgatacttttttctacctagcatttagaatatattcatatgtatattatttatattatcagttatttgaggttattgtttcacttttataattataaatattttttaaatattataattgtaatatttataatcttatagctaggattaattgttgacacactggggagctgaactaattctcagaagatgaagtttatcaagggtaatataaaccacatttatgtccaaaaggacagctgcacaagtagagttgtgagaggtatgtgagtttaacagcaacccaggtgaaaaagacttaggtcagtaagagttatgcaggcatacccaactgtccaaatctattgatattttaaacagcatttaatgagtcttgcagaggtgtccaagggagagaatacagtcatggattcttagtttctgtttctggttgggccagtaaagcccttttctcatccttcttttcctcatatcactagcgacagaaactaaaaaccatggcttcagctgctaaaagcctaaaacaaaagaaaacagaacaaaaacaataacaaaatgaggtgggttggacaagcttgcacagcaaggaagttctctctgtgtactaaattggccataacatgccaaggatactgtactcctctttggaattatatttcaaggagactgtcaactatatatgatcattcagaagagataccaaataatataaaaaatggttggccaggcgcagtggctcatgcctataatcctaccactttgggaggctgaggcgggcggattgcctgagctcaggagatcgaaaccagtctgggcaacaaggtgaaaccctgtcccctactgaaaatacaaaaaattatccaggcagggcggcgtgcacctgtagtcccagctacttgggaggctgaggcaggagaatacttgaaccgagaaggtggaggttgcagtgagccgagatcatgccactgaactgggtgacggagcgtctccaaaaaaaaaaaaaaaaaacaattggttgaaggaacttaggatttaggatatctaacctgggaaacattcagatctttatgtagattatgttctatcgtgtaaaatgtggaatgaatagatttgatctgtttagtcccaaaggcaatgctttttaatctattttggcttatggattctctaaaaatctgatgaaagctatgtcttctctccttaaataagtactcacatgcaattgcacccaatttcaaagggttcagccactcccatgaggcgcattcgtgttttccagcttaagaactcctggcccaatggggatggatgggaatagctagaaacatactgatttaagtttctcatctgatagaatggacctggaagatttaagaacaactttgttcccctgttttatatgtgagggaactaagccaagcagttttgccctgagttgataaaaccactaatagtagcaataatagctaatatttatgaaactgcatgcctcttaacaggtctgtggggtaggtacttactatattatttctgttttacagaaaaggaaacaggctttaaaaagataggtagcttatcctagatctcataacttgtcagtaccagatctgggaatgatctcacattctctgcactctacaaccagtagttgaccactgtactagtttccagagcaaggtaagattagagacctagctactagttctccatagaataatttttgcattatgcagaataacctatgtaattaatataaagatggactaatttgccttggaagtaagtatcactccattaaaggaattttcaacatttatcaaatgacagctgacattgaagaaaagatacaaaatcaggttgattaaatgactcttaaaccttacaaaaaattccattgctatatttttactcaagtattatttagtacttcagaagagctagctaagatccttagctttttgcttcacaaacatgttgtctttattgccatttagggagtggtatctggaaagatgctgttccattcttggtaggtttaatataaaagcagagaggaagaaagagagaaaaggcagcctggaaaattgtaaaggattcatgctgagttcaaccttgcattcaacaaatgacagctttgtgacttgagacaaatcagtcactctcctagtttgtttagatatgattggaaataataatctctattgtattgggttattctgaagattaaatgatcaaaaagcctggcacagtaggcatttatcaagtgttcttttaaaaatgagaaaacaggaacatagaaaaagagtgaataaaataatgaacacttccatgttaaaccaccaaaattggttagcatgcaatcgacagagtcatagatgtagattacccacctttaccttagcccaaatcgtctttttttgtcctgtcttgttttttttttcttttttgtttttgtgtttttgtgtcctgtggaatccagtgtcctggcttgttttatgttaagctttccttgactccagtgggtagaattcatcacttaaaatgagtcgtctttgagtttccactgtaattaagaaatcagatatcagttaagcttgttggtttttgttttttaaaaaataacctgtttttctctcagcttgctgtttttggtgttctgcagtttcactgtgatgaatctaaagatggtactcttgtttagcctgcttagcaattattgggcttcatgaatctctgaactgctatcttccgtcacttctagaaaatccttagctattatcccttcagatgttacctctatgctattcttattctccttctgagtcttcagttaaataatgataagacctctttactctctcctcacatgactcttgtattttctgttttctctttctgtgctacattctgaataattatttctgatcacttttttttttttttttttttttttttgagacagagtctctctctgtcgcctaggctggaatgcagtggcatcatcttggctcactgcaacctctgcctcccggggttcaaacaattttcctgtcttagcctcccgagtcgctgggattacagatgtgcactaccacacctggctaatttttgtatttttagtagagacacggttttactgtgttggctagtctggtcttaaactcctggcttcatgtgatcctcctgcctcggcctcccaaagtgctgggattacaggcatgagccaccttgcccagcctatttgcttcctttaaaatatgctctgtcacttttaatagtttttagaagttttctgaagatatttttaggcctgttttaatttttcgtgtgtacacagtaaggacttcttttattttgtatctaataacctagtgtctgaatgtctttggcctctttctgttgtctgtttctgtgggttcttatttatggtgacttatttccttccatgctttgttacttactgtccctagaaaattatcaacaggaataatttgagaccttggatgaagccatcttccttcagagaagattcacgtttgtttctctaggtttgtagggcaccacaagtcatagaccactttaagctaaatttgagggtttcttggaccagtcatttgatacgtacttgtaactaaaatgcaggttcagtcacttgctgcttgcaaagtccaattaacaagagcaaggtgtggtataaagaaagtgactttttattccaaagcgaacttaggggaagaaatacaggcttcctaccttaagggtactgcttccccctttgcagcagaaagtggactcttttaaaggggacctatcaggagtggcatgcaggggaggaagcgagcaagtggggggtttgcattctagtttggtgtcttatctaccaggcagttgaattggcatcttcatgggtagaaataggctataaaggtggccgaatactctctaggttggcgagagtttcatagcaggactttggattgtgaattgactgttatctctagaggcaaccccctggtgggtgatagttcaactctggagcttccaagcacatagttagatgaactccccttttagggagtctctgatgaagaggaagtaaaagactatagttgcatttctaaagaactaagtagaaagtgggggaaaggagaaaagaagagagagaaaaagtaatgaactacctcttagaaaaatgagggtactcagttacatgcttatgaaatcctgtttacctctgcttctctcttcaaccactggggctccaccttaggaagggaaatgcatcggggttttcactttgggcagccgtgggctgtggtagccctctctatttttcttcaggattctcaaaaccaatgttaacattttcccaattgaaaagtgaactcagggaaaggactctgcttacctctctgagttctagcttttcttcagttttggcctggtaattccttggtatgtgatcagctcttcaatgccattgagaatttttttttttttttaaatgtttgaggtactaatttggattgttgtcagcagaagtgagtttgaagacaatgagaggtcattttgtctgaataacctagcctgcaatgactgttacccattgacaacatagaataaagcttctatttgtgtagaaagactggagaccagttatgatgccttaaaagttttacagaatggcttgactaatttttttaaggaaacagtattcatctatgaaaagaggctatgtaaataaactaaatacgaaacgtcagatttcctgaattatgttgtaagcaaaaatcttattatggtaccttttgcagcagagcatgatggttaagaatgcaggctctggagtcaggtccattgggtcagtcacagccagctctttactgctggcttagcacccttgcactgtaagtgctgtgagaaaggggtctgcatcattcctcctcatcactgtatccactatatttggcacataacatagtagatgcttgttaaatacttgacaatgactgagtaaaaattacttggagattgtgtagcgtaagggtgaagaccatggttctaaagtgaggaagatcttggtttggatcctgacttctcaattttactagttgtgtgtcctccagcaaatatgttaagtttttcatctttaggaatgagtgttctcatctgtaggatgggacaatgattgcgtccacctcattgcgttattttgaggattaatgagaaaatgcatgtgaagtatcaggcagtgtctatgcatattaagccctcagtaagtgcaaactggtgttattctacaagcatcagatcccttagctataaaatttgacaatgttgtactgacttcagagtaattttattaaatgagcttaagtatttacagtactgatcacagcacctggtaaaaatgcgacagatgatagctgttattaatattagtggtagtgttttgcaataagattatgaagatgaatattatgtgaatcattggtctaaatttgtcttttatctaattgatttgatataatggtttcgctaacttaactgattacctccagtactaggcctttttttgaaaaatgaactgattttttaagtataaatttgtgaaacatttttatcaggttggatttggtgggtttttttttaagtctctgacagaatacctgtgaagtagtaactatacttgtcatcactttgggacagaagcaacaaattaagactgtaacttctagatctctgttttaaatggaggagtgaagagataaataaaggtcaaattctcttataacaaggtccatggagtatggaaatttattattgtgctgcaattttattggaaaagataaaaattacacttgtagccacgggagttgtaaataggagttgacagcccagatttttccattgaagttagtcagcagaggatagtggctaggtgaataaaagtacctctgaagtcacggcctttacatttcatttataccactatgggtaccactgctgctactatgtttgctacccaaacagctacatgtatttgaatgctttctatctgctagacacttcctcttaccctctcagcagttttctgcatgaagtattaacactgttttacaggcgaggaaattgagttttaaagaagccaaggagcttggccatagtcaagctagtaagtcaaaatgagtctaactccaaaaccagagcttttaaccaccacactttattgtcttcctaacagaacatattgcttagttttctgataaaattatttcacaacatcactcatcttttgccttccagtgggataaaaagaaaggtatcttgttttctaggatctcagagttaaaggagtcagtgaataaatactgaacagaaatattctttgaaatcatcatgatcactggattttttattcagttgctctgtctagccttttgagtagagtaggatgtgaaaaaagtaactgagtaaagcagataagaacactgtttctgcctctcgtttctcctcttagatattacaagtttggggacagaacctagaataggaaacatgtgcaaacacaataaatttaggttagatagaaagattcgttagttttctgactaggagaattttggactttgcaggattttttgagtatttgtttgtttttctgtgccctatttagtttgtgagttatcttggggaagatatttttgatattagcaaactggtaaggcataggagaaaataaacctaaattagacgtttgaaatttattgtaggttttgttttgttttgttttgttttgttttttgagacggagtttcgctctgttgcccaggctggagcacagtggcacgatctcggctcactgcaacctctgcctcctgggttcaagcgattctcctgcctcagcctcccaagtagctgggattacaggcacctgccaccatgcctggctaatttttatatattttttagtagagttggggtttcaccatgttggccaggcttgtcttgaactctggacctcaagtgatccgcccgcctcagcctcccaaagcactgggattacaggcgtgagccactgcgcctggccttattgtaggtttcgatgtcaaggaaaaagaaagggaaagataaagagctagctaaacttcaagtatctaaccaagtttaaaaggaaaaaaggtatggatacaaaggaatttttatcatagaatgctgttttctagaattctcctctggaatatttcttagatattgaatatggctactaaggtagaggaaaatgagaaactactggaaccccatggctcctaatgtagcaacagggataaaggtatcgtcaacaacaaagaagggattaggaggctttccttcaatacatttgtagttcatttggttaggtgattagattttatccttcaggtatttttctatgaaatatttttagtgtgtgtatttataaacactacagtatctcaataagctgggaaataatgagactgacagttgggcattgagttatgcgtacctataattctatctccctttagatttttaaaaatatcaaatagttttataattaggcatcattcagttttgcagataggactcagaaaatctttagctaaagaagtatgcaagtttttctaagttattttaagaataacataatgcacatttcatctttttcattctagcctttaaatctacaagacagcagccttcccgaaatgtcactactaagaattattcagaggtaagaaaaaaagttttatggttgtgtattaataatttatgttttctgcattatgaattgtcaactctctgatttacaaagtaaataaaagaagaaaaattatggaacattaaagctggaaggagctttaccaattatctctagggcttctaggatttgattttttttttcttggttgctctctttttttaaataatggttattatagaaatccataaatgttatgtatacagtaatgttttcaaggataacagtgttgaaccaaaagagctcatacatggaatactaatattgaaggtgagttcaatggttatagaggttttttctatgctggatttccttttgttacttatcttcccaaaatactagctgtgccttaacagctgttgctagacttaagatgaatgaaaaggctggagtccagcgatccatgtggtttgccctaggtttagcctgggccttctgctcttcctttcgattccaagaagagtccaatatgggcttgattctcttattacttcactttcaaaactgtgtgtcttaactcccgagccaatactcttccctttacatcagggtttctccatagtagcactgttgacattttggactagataattctttgttgtgaagggttgtcctatgcattgtaggatatttaacagcatccttagcctcaggggctgttcgttcagtatttggtctttggcttcatcctcatctgtacttaagttagatgaagatatggcaaatgtatgtatcaaatgtcaagataacaaaatgtagagaaatagtattttgggtggtagaatcaacagtcagaaatatctttattgggtcttaacactaacaaatggtatttaagagggacagatttaacagaaagatatctagtatttcccacatggtctgatacctcatttaaagttggagatggaacactgatggtctcacctctcataagaaactaagaggaaagtcataaggtctgcatatgagcctatgcaagtcattcaccagtgtaactgtgttcccttaggtgctcaggctcctgggatggccaggagagaggtgagcaaaaagtaacatttgtgaatgaagagggacattggagggaggtcagactgagtgttagttttaatggttatggctttctgtctccttttttgtggctcatatataacttaagatttaatcgtgtaattcatttcttcattttcatttttattcagagtctattctcacaaaaactgtttgttgctttgtttccttgccaggtgattgaggtagatgaatcagatgtggaagaagacatttttcctaccacttcaaagacagatcaaaggtaggtgcagtgattttctgcaaaagaaacatctgaaaaaaattaaaaattatccagaattccaaagttacacatttttctatgccatgtaagtttaacagacttattttcaactagtaaagtatgtagaggaatgaaaacagaccaagggctagtttatagagttgatgcagcattagtacaaggattttcagtgaaaattgaaatagcctgtaatttttttccttttgactttattagtgcttttctttctttttatttatttatttattttttgagacagtgcctcattctgtcgcctagactggagtgcagtagtgcgatcttggctcactgcaacctccactttctgggctcaagcaattctcccacctcagcctcctgaatagttgggattacagacgtgcaccaccacacgtggctaattttttgtatttttggtagacacagggttttgccatgttgcccaagctggtcttgaactcctgagctcaggcgatccacccacctcgacctcccaaagtgcctggattacagatgtgagccagtgcgcttggcctcagtgcttttcttaatggaagactgtgttctctccaaataacagaaaataattttgtattttgctatcatttgatttcagctttttgtcattgtcttatttttatattcttaactacacatggtactgtactaaacacttaaaaggggatcacgtagactcagtctgccttcagaggacttgcatgctcttcctgtgtgttttgggattttttgcctattgctgttaagcttgacttgattcactattaccatttgcttttatacgttaacattttggttgaatactgcttaactaaagctcgaataatgagaatttctacttaataaagtaatcaactgccttattttgtacttattttctgtttgagcattatattaggtctgatgagggaggggcataacgaatgttttaatatggcctctgccttcaggtaacttcaattatagtggaaaagagaaatgaacatatttgaattcatcaaagaatgaattagtacataattaggtgtagaattttatattacagacccataagtgtgagtgcttatgggctggtgaaaaaaggaacaaggaatgtgggctagaagaagcagcttcatggagggagtaaaattgacctgaggtttcaaagataagatttggcttagtagggtggaaaatggtggtcccagctgagaataagggcatgagcaggaactccagaaagaagggtgattgaggaaaaagccttatatcagtgtttctcaagctttttttccattatctcagccatttcttgattatccaaggagaagaattaagtaacttagatgtaagtcaatttctccctaacgttagaaattaaatacttaaagaatgaaatttttttgggtatggttgagtctgagagggccaaaaaccgtagctttttcatcccactctatcccctggagccaatttttgttctttatgatactgaccccactgagaatataagctgtatgtgacttaaaggttaatgttagagcaagtgtaagtatagttccacgttcacttattagatccttcaaacatcatgctaggttctggggatagaaagataaatgtttcttccttcaaggaatttacactttagtggtatgctaattacagggcactgctaatccaccaagataaatgttttcttcaggtgtaatgaaacctaagggacgtgccagtatcttcctgggaaaggtcattgaaggttttacaaagaagataggtgacatttgagctggtgatcagccgatcagttagcatgcattaaaggaaatgatctggtgtagagagaagaaacagtggcacaggacgggcatctactttgaaggatggtcatggaaagcctctgaggaagctacatttaagcggaaattttaataagggaaatgtggccttgcaaaaagcagagggacaagtgcatgcagcctgtattagtccattttctcactgctgataaacacatacccgagactgggcaattacaaaacaaagaggtttaatggactcaaatttctacatagctggggaggcctcataatcatggcagaaggtgaaaggcatgtctcacatggcagcagacaaaagaagagaaaaagagccaagtgaaagatcttgtgagacctattcactaccacgagattagtatgggggaactgcccccgtgattcaattatctcccaccaggtccctcccagaatacttaggagttacgagagctacaattcaagatgagatttggtagggacacagccaaaccatatcacagtctattgaagaagcaagtttaataatgttatttaggagccaatgactaatgtgtggtggaaaaggaggttgtttgagatgagaatagaaaagagacacagggtaaatcatgctgcaggaacaggtgagcactacaaaggtattggatgttgttataaatgcagtgggaatccacagaaagattttaagagaggagtggcaccttgtgatttacatttacaaaggatcactgtggttgcagaacaagtgtaaacaagcttatctgaaaggagggtgctgcaggtagtctgagctaagagagacgatggaggcttgcacaggctggtggtaggtgaaatggaggaaacagatggtttcaggatatattttgaagatagacatgacaaaacttgaagatggattaaacatttggagtaagggagaataaggaatcaagactgattttctggtttcttgctggagcatttacattgtgccatatattgagaaggggacaaaagaaaggacagatgtgttgtagggaatgataggcatataattaaaagttccactttagatgtgaaaagtttgagatgcctagaaacttacatgaagggaagttataggcaattgaatgtgtgaattcagaactcagataagggtttttgttttgttttgtttcgttttgttttgttttgttttttgagacggagtctcgctctgtctcccaggctggagtgcagtggcgcgatctcggctcactgcaagctccgcctcctgggttcacgccattctcctgcctcagcctcccgaatagctgggactacaggccctgccaccatgcccggctaattttttgtatttttagtagagatggggtttcaccgtgttagccaggatggtctggatctcctgacctcgtgatccgcccgcctcggcctcccaagtgctgggattacaggcatgagccaccgtgctcgtcccagataaggggtttgaaatggtacttacatttacctctggacagcgtgcagatggtacttaaaaccattgggatggataggatcacctcaaaaaagaaggcagagcagaagagtgtttgttttcctagcctgcagttttaaccttactcagcctttgggtagagtagaaaaaaacaataaagacatgagaaaaatccgggagagtatagagttgcagaaggctgtactggcctttataggagtaaaaaataccaagatgggcgcagatgcaaatcagtttatatgtctatggtaagtagtggagggacttattttagctcacgaaggtttacttgaatttctcaggctcatttatgtgtatttaacaggactcctttggttccagctgatagaaacctaactcagattctcttacagaaaaggagatttattggaagattatcgggatacctcaggttttggaaggaagtaagggcccctttctgagtccttgtttggttgttcttgtctttgtaaattgaagcacacacaaatcagatctagctttctaagtttttttttttccagaaatggatcaaaatgctattctgatatttttgatatatgcttaaggatattaaagaaaaaatagtttgcttttgatatcacagtagattgtttacttttcagctgtataaatgtctgccgatttctttagacatgaaatagtaatataactcacagttgtttggtacttcctatgtgccaggcacttctctgagcattttacatgtgaattagcttgcgtggtgctcacaacttccccaggagatagattatagttataactttatcatccccattttacagatgaagtgtgaagcacagtggctaagtaacttacctaaggtcacccaactagtcatacagtccaggcattctgaccccaaactcatctctgttgttgcttcttggtatggtaactaacttctctgaccattgtgcaagcaataagaatcatttaagttttgagaggctgtttaacattttagaggcaatttccaaaattgacattttggaaacacatcagaaatcagctttggcagattggtgtttctaattacagcatctaaatgataatttagactgtttttgcagaatgttttagtaattgcaggttatgcatggtgttttatttataatttaaactatttaagctctgccacttaccagagtggaccttgataattgtgctaatctgctacctctgaaccttagttgctcttcaagtttgcctgataaatccttctgtcctttcctttagtgcaaaggacctgtgaatttttctatttacttctgacataagatctcgtgattctcattcttttttccagataaaacctttggacatatttcttttgctataatgacatcccaaagcatgttaataaaattgtagactaagaatttataaacactacttttattgaagacgggaatcagcagactttttcttaacaggccagatagggagtattttaggctcggcaggtcaagaggcaaaaccggggatattatgtaggtagacacttgtataaccatttaaaatgtaaccatttcaaaatgtgaaaaccattcttagcttataggccataaaaaaaacaaaacctggtggtgggctagatttgcttactggccccgatctaaagtgacttaaatttcttattaattaaaagacataggaatttactgcaagttaagctttgtaagagtaggaatcggctgggcgtggtggctcacgcctgtaatcctagcatttgggaggccgaggtgggcggatcacgaggtcaagagatagaggagatagagaccatcctggccaacctggtgaaaccccgtctctactaaaaatacaaaaattagctgggcatggtggcatgctgagggggctgatgcaggagaatcgcttgaactgggaggtggaggttgcagtgagccgagatggtgctactgcattccagcctggtgacagagcgagactccatctcaaaaaaaaaaaaaagagtaaaaagagtaggaattatgattttcttattaactgagatttgaatagaaaatatttcaatgttcccatggttttcagaagtggaagatggtaatgtatacattttggtacatgataagtactataataatataagtaagtattgttgtagtacttaatatgtgtcaggcactgttctaagtgtttaagcatattaacacatttagtctttataaaaccattatccccgttttacagatgaggaaattgaagcacagagaggttaagtaacttgctcaaagccacataggtagtaaagggcaaaaccagagttcaaacctcggccccagagtccttttccttacagttaagttttattgccgctaatgtagattttaagggaattgtgtgttatttatattcgtggcagctgctggattgaaaaacttagccagaaaggcacacttgatgaattatgtagttcattgtgtttgtttttgtttttgttttgcctcaggtggtccagcacatcatccagcaaaatcatgtcccagagtcaagtatcgaaaggggttgattttgaatcaagtgaggtaaataagtaatattgttaaattttaattaatttttaactttataaaatttaaatagagactgccagctagttgctgaacttttttttctttgataaataacttcatcttttatgttcagggagtacatgtgcaggtttgttacatgggaattgcgtgatgctgaggtttggtacagatcccatcacccaggtagtgagcagtaggcagttttccaacacacatcctactctcagcctccactctctagtagtccacagtgtctgttgttcccatcttcatgtccatgtgaactcagtgtttagctcccacttgtaagtgaggacatgtggtatttggttttctgttcctgttaatttgcttaggatagtggcctccagctgcaaaggacataattttgttctttttatggctgcatagtgttccatgttacatatgtaccaccattttctttatccaatccgtattgatgggcacttaagttgattccatgtctttgctactgtgagtaagtgctgcagtaaacatgagtgtatgtgtctttttggtagaatgatttcttttcctttggttatatagccagtaatgggattgctgggtcaaatcgtagctctgttttaagttctttgagaaatttccaaatggcttataatggctgaatgaatttacattccaacaatgtataagcattcccttttctgacaacctcactagcatctgttgtcttttgactttttagtaatagccattctgactggtatgaaatggtatcattgtggttttgatttacatttctccgatgattagtgatgataagcactttttgtttgttggctgctttgtgtgtcttcttctttgtaatgtgcctgttcatgtcctttgcccattttctgatgcagttatttgatttttccttactgatttatttacattccttttagagtcttgatattagacctttgttggatacgtattttgtgaatattttctcccattctgtaggctttttgtttactctgttgatagtttcttttctcttttttttttgacatggagtttcgctcttgttgcctgggctggagtgcaatggtgtgacctcagctcactgcaatctccgcctcccgggttcaagcgattctcctgcctcagcctcccgagtagctgggattacaggtgcgcatcaccacgcctagctaattttttgaatctttagtacagacagggtttcaccatgttggccaggctggtctcaaactcctgaccttatgatccacctgcctcggcctcccaaagtgctgggattacaggtgtgagccactgtgcccagcctgatagttttactgtgcagaagctctttagtttaatgaggtcctacttgtccatttgtatttttcttgcagttgcttttggggacttagccaaaaattatttgccaaggccagtgttgagaagggtattttcttggttttcttctaggattattatagtatgaggtcttactattaaatctttaattcatcttgagttaatttttgtatatggtgaaaggtagggatccattttcttctgcacattgctagccggttatcctagcaccatttattgaatagggagtcctttctccattgcttgtttttgtcagcattgtcaaagatcagatggctgtagatgtgcagctttatttctgagttctctgttctgttccattggtctgtgtgtctgtccttgtaccagtaccatattgttttggttactgtagccttataatatagttcaaagttgggtagtgttatacttctggctttgttctttttgcttagggttgctttgtctatttgggttcttctttggttccatgtgaattttagaatagttttcttctaatttctgtgaaaaatgacgttggtagtttgatagggatagcgttgaatctgtaggtagcactgggcagtatggtcattttaatgatactgattcttccagttcctaagcatggaatgtttttgcgtttgtgttatctgtgatttctttcagcagtgtttcatagttctccttgtagagatctttcacctccttggttagctatatagctatgtatttaattttctttgtagctattgtaaatgggattgtgttgttcttgatttgactctcagcttgaacgttattggtgtatagaaatgctactgacttttgtacactttttttttttattctgaaactttgctgaagtcgtttatcagttctaggagccttttggcagggtctttagggttttccaggtacagaatcatatcgtcagcaaagagagagtttgacttcttttcctgtttggatgtcttttctttctttctcttgcctgattgctctggctaggacttccagtactatgttgaataggagtggtgagagtgggcattcttatctttttccagttctcagggagaatggttctagcttttgcttgttcagcatgatgttggttgtggattttcatagctggctcttattattttgaggtatattccttcagtgcctagtctgttgagggtttttatcatgaagggatgttggattttatcaaaagctttctctgtgtctgttgaagtgatcatatcgtttttgtttttaattctgcttttgtggtgagtcacatttatggatttgcatatgttgaatcaaccttgtatcccaagaataaagcatacttgatcatggtatattaactttttgatgtgctgctagatttggtttgctagtttcttgaggatttttacatctgtgttcatcagggatattggactgaagttttctttgttttgttgtgtctctgccagattttggtatcaggctgatgctggcttcgtagaatgagttagggaggagcctcccttgatttttttggaataatttctgtaggattggtaccagttctttgtatgtctgatagaatatggctgtgaatccatgtagtctagggcttttttggttggtcagttttttattactgattaatttcagaatttattattggtctgttcaggttttcactttcttcctggttcaatcttgggaggttgtgtgtttagagggatttatccatttcctctagattttctaatgtgtgtgaatagttattcatagtagtctctaaagatcttttgtatttctgtggggtcaattgtaatgtcatctttgtcatttctgattgtacttagttggatcttctctttttcctttgttaatctagctagcagcctatcaattttgtttattattttaaagaaccaattcttgatttcattgatctttggtatggatttttgcatctcagttttgttcagttcttctctaatttatttcttttcttctgctaatttgggggctggtttgttcttttatttctagttcctccaggtacaatgttaaattgttaatttgatttaaattaacaaattgttaatttgattctcttaatgaaggcatttagttctgtaagctttccttttaacagttttagctgcatccctaagattttgtaagttgtgattctatttttattttcattaatgaaattaatttcattaattaatgaatgaatttttattaatttcaaagaatttttttatttctgccttaatttcattattgacccaggagttatccaggaataaattgtttaagttccatgtatttgtgtagttttgagagatcttcttaatattgatatctctttttattgcactgtagtccaagagtatacttggtatgattttgatttttttgaatttatttagacttactttgactgaacacgtgatctatcttagaatatgttctgtgtgtagatgggaagaatttgtatcctgcagttactggatgaagtattttgtagctttcaattaggtctgattggtcaagtgtcaagtttaagtcctgaatttgttagttttctgcctggatgttctttctaacactgtcagtggggtgttgaagcctcccactattactctgttgctgtctgagtctttttttaggttaagcagaacttgatttatgaatctgggcatgtatatatttggcatagttaggtcttcctgttgaatcaaaccgtttatcattatataatacctttctttgtccctttttactgttggttggtttaaaatcggctatatctgataaaagaattgtgactcctgcccttttttgtttttcatttgcatgttagatctttctccatccctttactttgagcctgtgtgtgtcattacatgtgaaatgggtctcttgatgacagcagtcaggtcttgtccttttatccaacttgccactgtattccttttaagtagtgacatttagacaatttatattcagagttagtattgatatatgagatttcgatcctgccatcgtattgttagctggttgttttgtagacttgattatgtagttgctttatagtgtctctaagctatgtccttaagtgtgtttttgtggtagtaggtggtggttttttgtttccatgtttagcactctattaaggacctcttgtaaggctgatctagttgtaatgaattcctcagcatttgcttgcctgagaaggattttatttctcctttgcttatgaagcttagtttggtgggatatgaaattcttggttagaatttcttttttctttaaggatgcagaaaataggtccccagtctcttctggcttgtaaggtttctgccgagatgtccgctggtagcctgatggggttccctttgtaagtgacctgacccttctgtctagctgcctttaagatcttttctttcatgttgaccttggtgaatctcatgactgtgccttggggatggtcatcttatataatgtctgataggaattctctgtatttcttaatttgcatgtcaacctttctagcacgattggagaaatttttctggactgtatcctcgaatatgttttccatattgcttattctctcttctctctcaggaatgccaatgagtcataggttttgcctctttacataatctcatatttctcagaggttttttttttccattcttcttcattctttttcctttatttttctctgaccaagtagatttgaagaactggttttgaagctctgagattctttcctcagtttggtctgttatgttgttaatactttcagttgtattatgaaatccttgtagtgaaattttcaattccagaagttcagtatggttctttcttaaaatggctattttacctttgtaaaattgttttactggattcattggattgggttttaactttctcctgaatcttgatgagcttccctgccatccagattctaaattgtatgtctgtctttcagtaacttcaatctggttaagaactattgttggtgagctagcaggctcatttggaggtaaggggacattctggctttttgaattgccagaattcttgcactgattctttctcatgttagagggctattgttcctttaactgcagtgtaagtcgagtatagtcaactggccttgtttctgggtgctttcagagggccacagctctatatagatctttactgtgcctagattcttgccctgggtgtcacagagatgtatattggcagaattattttggtgttgtaattttggctgtgatccagtagctggcatttaacattagtgtccagtggataggctcttactcagctgcatagttcttttgtatttctgtgtgttcacagccgtgctctgtggtggggttggggagagagatgaccactcataagggccactcctggaccatgggtgaggtccctcctatcactggcactgtacctgcattactgttgtttggtgtcttgggttgcagggctcccttagacagaggccatggctgccagacaggccacacccttcccagaccagcactgtggaggaaggcatgtcccattcctgcactggcccacgaacccacgtgtctcactcctttcagtgttctgaaagtgggatttctcccctacttgagtgccagccccagctcttagctcgacagccccagctgtgtgctgtagccctgtagcactgggaccagcctgtggctccatcgtctggaccctcagggtcaggcaccagctgtgctggggaatctgaaatgctcccaggctgccaggaaggtactcaggtggaaccaccagcaaaaaacaaggctaggcagcagaggctgccctgtgcacacattcctgcagggcagcttggcaggggccctggaaggggctgtaggggaggagggcctgcagaacagatgttcctctgtcccacagggaagctggccccaggctggcctgccccagcattcaggtggggctagtcctactccaggggaaataagaagtcttaggggatgggcgcctatggccaccttctgctgcagctgccttagatatgaaaacccctgggctccatgtattctggagctctgtctctgcctactgtttgggccaatccccctgccagttgaaacgtctccagggggcatggaatcttgtagctaggatctctgaggtccatagtgagagtgtgctgccccatcatccattcactcacccctttctaggagcctttcaaggccaagaaccagccctggcattgggcaacccccacaaggttaccagcttcctccctcttcagcttccagtttgtatcacctctctatcagctcttggtgctttttctccaaagatctgctcaaaatatgttggcttactcgatattttggtctttattagtggcagtggtgcttcttggccctgtctagttggccatcttgtccttcttccactaaaaattatttttaaaaatagtttcaggctgggcgcggtagctcatgcctgtaatcccagcactttggaaggctgaggcaggcggatcacctgaggtcgggagttcatgaccagcctgaccaacatggagaaaccccgtctctactgaaaatacaaaattagccggacatggtggcacatgcctgtaatcccacctactcaggaggctgaggcaggagaatcgcttgaacctgggaagtggaggttgcagtgagccaagattgcaccattgcactccagcctgggcaacacgagcgaaactccatctcaaaaaaaaaaaatagtttcattgataaccttcctttgaactatagttaatgttaagagttaacaagtaacatatgttgagtgcccatcagtgtaatacctcagatataaaagtcctgtagatttttaaaatatgatattcactcagttcttatttgcccagttaacagtgggatcggaattttttttagcttctaccatttacttatatttggagaaatgatgatgatgatgatgatatcccaagagcttttaatattactttaatgaatatttattaagtactcactatatgctctacatgtgtcatgtagagggtggcgcatggtggtgatttcatgacatacaggtattcaggcattgtccgaaatgttctctgggaggatgtctggaaaaaactccagttccagatcgcgtctgcaaccatgaaatctccccaccatgaatgaggaggaggaggaagaggaagagttataagtcaggacttacctcttgcctttattaatttgctgtttcaattaagtttaaataaaactacatgactgaaggatactgcccttcccctttccttcaaggctgccatttgaagggcctttgctagtttttgttgatttgcttgaaagtgtttctcttaggcccatgacccctttcatttatttttttatttaaaaaattgttaattgtagcaaaagcataacataaaactaaccattattaagtgtacagttcagtagtgttaaatagatccatattaaacagatcttcagcactttttcattttgcaaaactgaaaatctatatccctgaaataacaagtctctgtttccccttcttcatcccctggtaactaccattccactttctctttctatgaattcaactactctaggtacttcatagaagtagaatcatatagtatttgcctttttgtgactggcttatttcacatagcgtaagtacctgaaggtttatctacgttgtagcctgtgacttacacctttcatttttagctttggctgctgctgccatgttccctgtatttaagctgtggtttaaaacagcttgagaggactcaactcaggctgccaagaaaaatggcagcaagagctcattctacctattaaatactaacatgttgcttccaggagggaagtgagcaattattgtttattccaaaacatctggatatatatgcggttatatgttacagttaaaaatttgtatactagttcatgttaactgcaaagacaaactattagcaaattatctattagacttcatttggatttgtctctggtttatttaagttttgtctttgatagcagcagaaaatgaatcaataaatgaaaatgaatttatatttcttaaggcatccattactcatcagagatagttaatttagctaacatttggaagtgctgataccaccaacaaagcctagcatcaaataatttcttttaatttcttttaatgtcttaaacacaaataaaaaacttataaacaaatttgctttattttctgaatatttatagaatacgtaagaattggttttatcttcataaaattatataattgggcttatctgaggtttgttttcattctctttaattaaattattagttaatatctgatattcctatttattcttaccatgcatacaatctatagcccaatagcatgggaactcttttttttttttgagatggagtctctcgctctgtcgccgaggctggagtgcagtggcacgatctcagctcactgtaagctctgcctcccagtttcacgccattctcctgcctcagcctcccgagtagctgggactacaggcgcccgccaccacacccggccaattttttgtatttctagtagagacggggtttcaccgtgctagccaggatggtctcgatctcctgacctcgtgatccacccgcctcggccttccaaagtgctgggattacaggcgtgagccaccgcgcccggccagcatgggaactcttgaaataactgcatgtatttctttttttatccaaaaaactatttgaaagcttgctttgctaggttgttttttgcataagtgtgagagtagctagctatttctagtattaaatggtaatgggaaataaaattacagctgtttctgagttggatctccatgtggcttcattattttttcgctgtgaatttccagaagagtagatacaactgtaataaaatgtaaatgagaaaatatattcaaaaaccaaatataaaatgacttgaattatttttctggcttacctatacttcatttatctttattaaggttagtaagggaaatgtgtgtggtttatattgtagatacatgcacacacagcaggataaattttcattttaatgctcattaagaatttaattgtacttaatatattttgcagttataaaggaaatagaaaaataaagtctatcccatgtgaaatgactctcactggtattgttttgcccataagaacttctgtcttgtttcagtgaagcagggaacaatcactaatacaacatttgtatctcatttcaggatgatgatgatgatccttttatgaacactagttctttaagaagaaatagaagataatatatttaatggcactgagaaacatgcaagatacaggaaaaatgaaaatgttacaagctaagagtttacagtttaagattttaagtattgtttcctgagcataactccataagtaagaaatttctagttcacagacatacaatagcattgattcaccttgtttttttaacctggttgttgtagtaagagctttgtttcaatatcactcttgagtaaagattaaaataaagctaccattttacatttctatttcataatgaaaaactatgtcagtattttaatatggttacatttagccaaagttgagggaaagagcttataaaatttaacttcttcataattttagtaatttcctagaggttctgggttttctgaaagtaaaacaatttatgcgaacctatgtctaaattcactgtttgttactatgtatgtttttttccaatgcttcttataagactaaatgattagaagtacctaatagtttgaacagatatgtttttatttaaaagagtagaataacctttcagaattactgagttttttattccagttgtagcaaagatttcaaaagattgtgttcccattaagtggtagtaatttcctttattattctgtatccttaatggtgttctctctctctctctctctctctctctctccctctcccccccgttccccactcttcctttctcctttgctttttcttctctttcatacatatatgcgtgcctagttctaggaggaaacgggttaaaaattgttttaaactacatcttgaaaatattgaagaatttgttttaggtagagtggtcagttgaaccttacagtaaagtatagaaatatatttaatgtggaatgtcaatgccaggatttctcattaacaatattttatctcaactttggttcctgtgatacatttctgaatgggcaattccagaaatcttagtagcccatgttaagcttctattttttacttgttttcggggagaaataagaattagacatcttcagatttaagttaaataatcccattctttataatcctctgtaaaaagatccctgagattattccttcttctagttttatgcgacagctttactttaaaattcaagttatacatcttgggagtacaatggcccgacatttcttcataggtagaaacaaatacttgactcagtgatactcatgaccattagaatagtcatacctggaatgtgtcaaattataagagacagacacttggttagtggctgcctcatatagcacttttgaagaggcctaagtcaaaacttgcaatataacattctattgactttcttaaaaatattttttctgtacctaacttgagcataagggttatttgagcaagtaacattaactcagtggaaggcattgtcctgtgaaatattcttaggcagatctgcccacatctttattgaacttgaaatctaatatttctagtatttgaacaaagcagaaggttaagtcagggaagagcagtgctgtccatgatgtaatggaagctaccaggggaggcagtgtctggatgatgctgtgctacctacccctgcacaagccatgctggctcagtctgagctgtgggccacatcagctagtggctcttctcatgcatcagttaggtgggtctgggtgagagttatagtgagggaatggtcactaaagtatcctgacaagttcctaggaaaaaaggaataaagtttttttccttaaaaaaaaaaaaattgctcttggctgtgaaaagaggtactaaatgcgattcagttcaccgctaaggaaagtgatgacatagcagttacagagggtgataaatctctccagctaattcaggtcattttgtgaatactatgtatcaagccctgaaaatatggtaaataaaacgtgacagggaaacctttttttgattgaatattgttacatagttaaatgtgctatatatccttaatattttatattgatcctgcaaaatctgttggttttaggggagttttgttttttgtttctaacaattttcagacctgttggtataggaatgtagaagtctttcagatgatttgaaagcagctgcatttgctcttggaggctttgggagagcaggaatgaaaacattcagaggaagacatctgtagggaattcttctgttacttaccaaagaataagtgtctttctggtgttttatttcctatcataaaaatacaacagtgcatttacaaggttaaagattcctcg

SEQ ID NO: 12509 - DNA, 77940 bp, Human
ggtgactggcaaagacatcatgtgtctggcaaagacaacatgataagtactactacaagaccttgtctagaaaccatgagtatacaggaggttcataattcccctagtcctaagggattaaagaaggcttcctgaaggaactgatgtttattctgctaagctgccatattaatttttaaaccaatatcagcttaaagggttacacaacatataaaccttaatcaattaaagaaaaggagaataaccaatagataatttacaaatacgaattcccagcctctcaactctatttgttgaaatataatcagtctttcaaggctcttctctgatgttatctctttcattctttcttgatcctctcatttagatcgctttctgctttctactttttttggtgctacatttcacctctaactttgttcttgttttagccccttaaaagattataagctgaaagataaggaccacatttaacttatatttatctcctacttgtctatagaaggcattaagaagtatgtgtagcattacatttaattaaagtcttgtcacttgattttgcctggaatggattctgagaagttccagagttaggcataaccccaagatactgatttcttgatacctaatctcacaagtttaacagtatacaatcttaatgtggtattaaactttattactagtggcaatagcactaaactcaagtttaaatgtattactcatgtccagtaacttttctggtcctgttactttattgtaaaatgtaagaattttactaaagtattcctaaggccaatccggcttttcagtcacccaatcagagacacccttggaatcagagatatccaatcagaattgctctgtgttttattaattctcctggagcttccactttttctttgattctcaaactaattcctgaaccttgcaacacaaaaatgaccatacatcaattcattaaacacttaacagatgctaataaataaaagttcacttgtaattatatcaaatatagtaaccttataccacagatcttaccctctcccccaacatgcttttcctttcaataaaaactccctttatataaattttgagtttacagatccagatacaaaaaattatgtacaaaattttactggtatatttagtttaaaaagccaagcctaggcgcatctacccgacttacagttaagaaacaaaactgatgacttgatgatgatattcctgatattccatcaggaatgtcagggtatgtttcctaacttaaagggcatatcctattttgagagagatccgaactatgtcaactccttacaaacaactcagtgataggcggggctataaaccttactggtgaaggaggttcagatagattaaaacaacttgccctagatcaaggacccttcaatggaactgaaagggcagacgttctaattcaaaagttctacattatttttcgctgcactatacatcttactgctctcagcacaaagcagtgcagatgtgctgaactcaaggacctaggggcgacacctgtagagggtctggcgactgggagggagggagaggggatccagctccggcactctgccaccagccgggagctcacaggcccgtgagctccgcctgcggccttccaaacagccaagagcggagaagcggcttcggtcctacctggggaccacgaagcggcctgacctgcagggctcggcctgtgtccacaggctacccacccccacgggctcaggagttcttagatggcgccggtccatcaaaaagcgaggtccgggacagggaataacaacccacctgacagaagggaaaatcgccgccttgcatctcacttccgggttcgtctcctagcctgctcaggattggctcctgcgtgagggcggggcctcgccgctactttacccgccccctcactgcgtgcggtagccaatgagagccgaactggacttgaagcatctacgttatccataaagtgtcgcgagagaaacggacgccgttctctcccgcggaattcaggtttacggccctgcgggttctcagaggcaagttcagaccgtgttgttttcttttcacggatcctgccctttcttcccgaaaagaagacagccttgggtcgcgattgtggggcttcgaagagtccagcagtggggtaatttaggaatcgcattcgtctcctgtttctgcaggttcccaggcggaagcccagagttaactggaacctcgggaagagcgggccgagtgggcaggggaggggtcctggcgggctcagcgttctgattccgaggttccctgcggtgagggcgtgttgaggcttggaatcccgacggaatctggagctccagatgtggtgggggttgtctcgcggtggcagccactcttccccaaacctggctattttcagtcatcctgctggtgcctaaaggtgttcctccgcagaccacgtgtttgtttatttacactcgctttaaacgcgggcccgttcccttttccaaactagccaggtcctttaaaaaaaatcgtggggtttgaataggaaatacaggattgcctctgttctccagagtaacctatgcgtgcaacttaaaaatatctgcacatctagagttgtttgtgtgttgaaccagaaccgtatgtgaccctttctgcctatttatttagcatacattaatttcccataagagcacgggaaaggaaaataggagtttaatcatcttggtgaaactaggaaacaggatgtacactggagatatattattttctatgctcagttcattaaaaaaaagtatagtgggtgcttagatgaaaatgagacttctaaatttgccagtctaattaagacgtctgtaccttgtgcagcgtaaatcatgttggttaaatacgtgcaggcttttaaaaaatgtgttttatgatgtaattttgtttttagaatttctagaatttggaatcgagtgcattttctgacatttgagtacagtacccaggggttcttggagaagaacctggtcccagaggagcttgactgaccataaaaatgagtactgcagatgcactgtaagcacctgacttctggaatcccttgttatttggggtttctaaagctcgtcaactgtgatcacagtaaaagaaaacttatttaataagcagtaaataaggaacctgtttatgaacagaaatattagtcatcaaaaagggtatttggaatgttttaaatatttatctgtttgttaactggaagctaatatgcagctatagattggagtcttgcagtaatttgatatattgatatagtattgtttatgttcttaggcttcatcttaaattattgaagtgataaatattcttgaattttcctgacaaattcttattagtcaatgcagttctgtttaagatttttagagtaaattcctctagtattaaataagctggaaatgaatttgaatggaatgggaataaataaaaggactgtaaaagttatgtgcactttgggaggccgaggctagcgggatcatctgaggtcaggatttggagaccagcctgaccaacatggtgaaaccccgtctctactaaaaatacaaaattagccaggcgtggtggcgcatgcctgtaatcccagctactcaggaggctgaggcaggagtatcatttgaacccgagaggcggaggttgcagtgagccgagatcgtaaaaaaaaaaagttatgtgggaaagactttagacttggagtcttttaccctagtttcaagtccttggaccctactagctgtgtgaccttgggcaagtcagcagttctctgagccttgcctcaattttgccattggtataattggaataattatacctttttcagattaattttgaggcttaaatgagagaattcatgagaaaatacttcataaattgctacagaaacatgtagtattatgatttgaaaagtattctgacctaccttcttggatatatcagtgagaactgtgtgcatatcatttttgaagtttttgaagagaaatcgtttgtggaaatatcttttgtttgtaaagatttgaattttggagatatatacagagattttttaaaaattcattgtggtttattgaaaatagcctgagttttcatcatgggttttagtcctgtttctgtcactagttatgtgataaagcagttaatttctctgggtttagccttctcatttgtcagagataataatgcctgactctttatctgtgagggttgagatgagatcataaaaataaaagtatttcatacaattaaatttagtgtaagagtattaataactattacattgctacttcacattaaagtacctttgaatattaccaaattcaaattgaaacaattctgtgttggccaactttattaatgaaatctaactctgtagagagtagagtcatgcaagtgtcttcaaggccctgaatgtaaattattgcatattagtataaaattgactcataaacttagaggaaggctttttaaattaacttcgattttcctggaagagtacgaagtcagataaataacaagtttatttatctgaggaaaacaagcaaacttttgggcctgggttacatgagtttgtaaaactggttataacaaggttataaatttttgaagcagttatagaaccttgtaaagatttatgtacatttgttctgtattgaactagtggttaggaaaactgtaatgttaatgataacgttgaatacttcagattttcagatgaactctaaggctaaaaaaaatgattttactctataactgttattatttattttataagtttgtctcaatttgtttgaatatcctttaatgaattattaatatattgaaatgtttcttctttcttaatatagtgatgatgaaaacacatttaaaatattagttgcaacagatattcatcttggatttatggagaaagatgcagtcagaggaaatgatacgtttgtaacactcgatgaaattttaagacttgcccaggaaaatgaagtgagtgtggtttgtatttgtgcactatctaccatattcccttggttaacaagttatttttccttctaaagttagagatttgttttataagctcaggtgcttaccttgcctgcttgaatatcaatatactgaaagctcaaagccgattttgtatgctttgtgtcttaaattcaagtaggagctacttttgtaaatagtctgttaaaatttacaaatgtttttggggtgtttactgaatgcaggatcctgtggcagtgtctattcgaaatgtaaggtgactgtcaaagcttctgctttcagataacgtagaagaaaactggtgtgaaagacaaatatccacaatccacagatgcaaggttgtatgtgataggagccctaagaaaattctaaataacatttcctttgagtttagaggcagaaaaaatcacgtttagattatagcaagatgagtttaatgaagaaggttgtgtttaacttgggctttggaggaagggtagacttttggccagtggggagcatagagaatgtacatccatgtgaagcaggagtgaggaaacccgtgagacagtataaggtatgttaggggccctgtagtcaatttggctcaccagcaggtcatagttagcaagcatgctgagagactagaaggaaggatttgagctgcattaatgaggacttcaaatatcagattgagaaatttgtatccagttcaagagaaagtcttttggcagcggagtataataccatgaattggagaccagttagaggctttttttgaagtattgaccttagggatggaaaagaggaaatgaatgcaagggatactgcaaaaagaggatttgtgtactttggttagttgtagcggggtggggatgagggcaaagggatgacagtgactctgaagtgtgtggagtttgggtgaatagttgtaccaaaaatagaaataggtagataaggaagaggtactgcttcatgtgggaaggtgacaaattctttgtttgatttcgacaaacttagagttggagactgcaatgggacattcagggaaaaatttcagcaggcagttaacacgccagcccaggagagagttggagaataaatgtaaaaattgacttgcaaattaacaccgccagccttgacttttctggagagttctcttaagtttatctgctaggtccttagttcttcctcccaaatatatatggttcctctctactactcttttcacactaataaacttagtccaaaacgatcacatttcacatggcctgcaggaggtccccttccatctttctgcttctattcttttctgctacatctactcagcatagcagccaaagtgaacttttaaaataataaatcagatcatggcactctgttgcctaaaattttccaagtgtccttccattgaatctagtataaaattcaaactacaaggttcgacttgatcttgacccctgccatgaaacttcatctcctactactctctgcctgatttacagtgctacatccacaccggcatgttctactctgaggcccttgcacatctagttctttctgcttggagcacattgatcttggtggggccgacttctgagagttcaagtcttacctttttggagacgtcttccctgatacttccaagcactgttttatcacattactctgctttttttcatagcatatttttaatagcactatctgaaataatttattgaattatttacttgtttattgtctgttgtcttcactagaaggaaaactccatgagagtggaaatcttttgtttgttcatgctgtatcttagtgcttagaaagaatcagaaagcagtgggtatacatattttaaatttcttaattaagtgaggcaatggctggattctttcttttattttaggttcaggggtacatgtgcaggtttgttacataggtaaactcatatgacagggattgttgtacagattattttggcacccaggtattaatcctagtacccattcattatttttcctgatcctctccctcctcctatcatctgctctctggtaggtcccagtgtctgttgttcccctctttgtgtccatgtcttctcatcatttagctcccacttacaagtatttgatttttctgttcctccattagtttgctaaggatgatggcctccagctccatccgtgtccctgcaaaggacattatctggttctttttaatagctgcatagtattccatggtttatatgtaccacattttctttatccagtctaccattgatgggcatttaggttgattccatgtctttgctattgtgaatagtactgcagtgaacatatgtgtgctgtgtctttgtggtagaatgatttatattcctttgggtatataccaagtaatggaattgctgggtcaaatggtagttccatttttagctctttgaagaatcgtcacactgctttccacaatggttgaaccagtttacacccccatcaacagtgtataagtgttcccttttctccgtaatttcaccagcatctgttcttttttgacttttcaataatagaatgtaaggtgcatttttccttccttgaaggcaaaaaaacttgtggccaaaggaggtctgtttcctgccagagaatcctgtatgtgctctttcttttttaactcttgagccctaaaacagaatcttctcctgagtgtaagctacttaattctactttgccctttccttcacttctgcttctactgtttctcttccctgcgtcccttaattgtaactgttccaccccccataaccccaggtagggacttctagatgtgtattatatttactcattctcttgatttgtatttagtatttcttattattgaatctaaagtcttcctgacttttaagtcccttattatgtgggcccatgcccactaaccagtcttagttctgttccctagtttcttggagtctttttttaaaaaaactttttattttgaaacaacatcagtctcacagaaaagttggcaagaatagcgcatagaattccttacccgtcacccaggttttctaacattttgtcacatttgctttatcttctctttacaaatacacacgatttttttcctgaaccatttgagagtaaaccgcatgtataatcatagaaaaccagaaaattagtattgattcagtgctattatataatgttaagatgttgccaattgtccctgtaatgtctgttacagcactttggaggctggttggtggtgtccaggatccagtccaggtttacatattgcatttagttgccatgtctctttgtctcctttaatctggtacattttcctgcatctgccttgcctttgtttttcatgaccctaatattttgaagagtacacaggccagttattttatagaatcttcctcaaattggctataagtggtatttcctcatgattaggttcagattctgcactttcggcaagaataccacagaagtgagtcgtgttcttttcaatatttcctggagtcactgccagccagtttaaaaaatttttttaaatgtttgaatgatggcaaaatatattaaatacataacataaaatttcccttgttaaccatttttaagtgtatagtacagtagtgttaaatatgttcatattgctgtgcaaccaatctccagaattactctcatcttgcaaaaatgacacccattaagcaacaacttcttttcgccccagtatgtttttcatttggtttgttgtttttgttttgtttcttccatgcctttgattgagatcattttcttccttttactcaaatagtgttcattctggaaggcctagcttaaacctcacatttttattaaagttatcctaactaccatacgcacagtgatctataccttgtattcttttgtgtgattaagaacttaagtttctttaggtgcatcgtatacgtcttgaaagcctgtgttagactttttctgtatgatttccctccttcactgaagttattcctagaattctcttcctcacaatcatttatctttcctagtgcaactaacatgccaccatgttagttcattccttctagactttctgtcctcaggcgaattgtcctcccttgagttcaaattcatcgtagtgtcatctctgctgctggttgcttacgtgtccattctagtgcaccccagagtttgacttatgtttaaatgtataacagtttgcctcttccattagagtttgaacatatttaggatagggatcatattttattcatcattgtatcctcaggactcagtagagggtcttgcatagagtcagtatttaatgagggcagggatataatctattttgtagattgctattttttgagcttctagaacctgtaggaattctgtaaataaatgctgaatgaattaaatgaatgatttggattgaatttggtatctcttcccatacgttctgttaaagtgctaagtttatgtttgattcaaataatagaaaaaatatgatcaccttgtgtggcctgaatcagagacttggtgtaattggaagatggcttttttgaagatagcttagtcagctaaattagaaccagattaattaccagattgaaagtccctttgaataaataaaatgtaaatttttaagttgccatatataatagtgtcttttgtgagtttttttttatctctttcatctgtagtttacaaaaattttacctgtaaaacatactaattttaacacctttttctgttgatcaggtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtaagtatatttatttacttgagtgagtgattacttgtgtatggtatttgctgtataagacacgtaaacacacaactgttttgccttccatataagctattttcttagtaaatatcattctttgaatttttttgtacatcattgtattaatttatattttcctaattaatagtggaactgacccagctactcgggaagctgaggtgggaggattacttgagccccagaagcagaggttgcagtgagccaaaattgtgccattgcactccagcctaggtgatagagcaagactccatctcaaaaaaaaaaaaaaaatacatggtgggactgaatatcttctcaggtttatattgtacattttggtatcctctcctgttcatatcctctgcctattttaaaaattgagatttttttgtttgtttttctacctgaattgcagaagttacttatatattctaattagtaaacctttgtgatacatatattttttcccaatcaatggcttgtcttttgactttgtttatggactcttgttgacagaaatatttaatttttatgtagttaaatctattggtttttctttttttccatttgtgcctttgggactatttatgatatttgtcaatccctatattataaaaatatcatcatgtgttttttctttttttttttgatggagtcttgctctgttgcccaggctggagtacagtggcatgagcttggctcactgcaacctctgcctcctgggttcaagcaattctccctgccttagcctcctgagtagctgggattacaggcgagtagttgggattacaggtgagtagctgggattacaggcgcccatcaccacgcccggcaaattttttgtatttttagtagagacagggttttgccatgttggccaggctggtcttgaactccagacctcaggtaatccacctgccttggcctcccaaagtgctgggattatagacgcaagctaccgcttctggcccatcatgtcttaaacattgtacaggatctcacattgcatttagtagaaacgtttccttaatttcttcagcccatgtcaggttttctgtctttccttgtctttcatgaccctgatacttataaagaggtcaggtattttgtagaacgtccctcaatttggtattttctcctgctttctatgattagattgggattacaggttttgggggagaatattcaagaagtgaagtaccctttcagtcgcatcatatcaggaggtgcgtgacatcaacctgatttatcactggtgattttaaccttgatcacttggttaagctggtctctgccaggtttctccagtgtaaagtcattattttttcctttccatatgctgttggttagaattgagtctctgagtccagcttactctcaaagggcagggagttaagtttccacttctgatggacataagttaaaaccaccaaagtaattaataaatattttagggtagatattttgaggctgtgcgacttttctgttcctccttaaatttgttcattaattttagattcatcagtggatcttacctacaacagttataactgtgatattctaattgtgattttccatttcctatattctttctacatgtattaattgggattcttttgtaaggaagatttgtcccttgtcccacatttgtttattcaattgtctatatcagtagaaacccatttttttttcctttgggttataatttattactatcataatttacttgtggcttaaattgttccagctttagccattgggctccttttgagattggctcctgtatccttttgatatatcccaccttttcttctgattttttactttgtctttcttgtcttcagactcagccatttcttcaaggaaccctggttccttttggagaatggtatttggaaaccaagatctggatgttacatgtgcacattactattgtattgttgcttctaggctctcactggacagagctaagaaaaatatgtgtacatactaacccatgagaatagacatactcatgtttatttatttatttatttatttatttaatttttgcttttgagacagggtctggctctctttcctatgctgtagtgcagtggcatgatcatagctcactgcagcctcaacctcctgggttcaagccatcttcctgcctcagcctcccaagtagctgggactatatgcatgtgccactgtattagtccgttttcatgctgctgataaagacatacccgccaagactgggcagttcacaaaagaaagaggtttaatggactttcagttccacctggctggggcggcttcacaatcgtggctgaaggcaagaggagcaagtcacgtcttacatggatgatggcaggcaaagagagaggttgtgctgggaaactcccatttttaaaaccatcagatctctttagacttattcactatcaccagaacagcacaggaaaggcctgcccccatgattcaattatctcccacgaggcccctcccataacacgtgggaattatgggagctacaagatgaaatttgggtggggacacagagtcaaagcatatcagccaccacacccagctaatttttaagaaattatttttggtagagatggggtctcactgtgttgcccagctggtcctgggcccaagcaatcctcctgccttagcttctcaaagtgctgtgattacacttgtgagccaccatgcccagcccatatttatttcttatttagtttttaaagtgtgactttatattgggaggtaaatttttttttgagattttgtccacatgaaaatgtttatgttcactttccccttgattgatagtttggctgcatatataattgagttttaaaagatttgtataatactttgtccttgtttttcaaaattgtgatcaatgtctttaccctccttctattcaaatctaaaacttgggacattttttattttttattttttatttttgagaaggagtcttactgtcacccaagctggagtgcagaggcacgatcttggctcactgcaacctccacctcccaggttcaagcagttcttctgcctcagcctcctgagtagctgggactacaagtgtgcaccaccatgcccagctaatttttttatgcgtttttagtagagacggggtttcaccaggttggtgaggctggtcttgaactcctgacctcaagtgatcctcccgacttggcctccgaaagtgttgagattataggcgtgagccaccacacccagccgggacattttttaacttcagtattttctttctttcatcttatttttaaattgcattctgttttgaaaactgtttccccaccctatatacatgtttacctatttctttgctcactgttgttccttgtatttcatttcttttgtgtagattcagtttccttctttctgaagcacagttttcagtagttttttcatggagtgtcagtgagtggtaaactcttattttttgttgctgttgaggagtctactgttaggtgagttgctagaaagtttagcatagtgattaagagcatgggttccggtataaaacagctggagttcaaatcctggttctgtcatttagtagttgtaaaattatgttagtcacttaactactctaccttagttctgtccttcataacatgggaaagaaatgtgccaatcttacagagttgagaagattgagatgataagaaaaatggctagagtagtgaccagcataaagacaatacttgggtaacttaagattttctcattgttcttaacatgttgcagtcttatttagctgtggatttaattctgtttgttccgcgtgggctttatcatatattctaatgtaatattgtttttcagcaacttggggaaattcccattctattcattatgttttcaaatattgtttcctttctctttctgaatatcatttatatagcatactattaaaaaaaatattgcccataactttacctctttgtgtttcattttggataatttaatcttccagttcacagttcatgtagaaaataggcaaagatagggaaatcccaaaaaagaagactactaaggagttagtagccaattagatttgaagtataacaatgctacaataattgaaaatgtggtatggctcatgaattagtagataggtaagtgaaagagaatagaaactctagaaatagcctcaaatacatgtaggaattgagtatttgatgaaggtcaccatctcacaatgtaggggaaataatggattcagtaaaactgctaggagaaactgttacacatattttaaaaatctaggtgtggggaaggcttctaagtatgacacaagacccagaagtcataaaagattcatacatttgtctttgcaaaaataaatttctgcatgccaaaaactgcctgaagcaaagccagaagtcacagttcaatcaggaagaatatttgcaaccaattgcaaattaaggttgaattccccaataagcagttctttcaagacaataaaattcatgagttagtaataaataaagaatatggacatacttcacagaaaaggaaataacatgacatttaacttttatttttttttttcgagacagagtcttgctttgtcgcccaggttggagagcagtggcgcgatctcggcttactgcaacctctgcctcccagattcaagcacttgtcctgcctcagtctcccaagtagctgggactacaggcatgtgccaccatgcacggctaatttttgtgtttttagtagagacagggtttcaccatgttggccaggctcatctcgaactcctgacctcaggtgatctgcccacctcggcctcccaaagtgctgggattacagatgtgagccaccgcatccggcctaaacctatttttaaaagtttgatttcactcataagaaaaagacagagctatactgaaatatttttctcctataaggttggcataggtctgtgactctcaatcctgagtgcacagtacagttacctaagaacctttgaaaatatggatggccccctctccaggccaactaacttagagtctctccaagtatgtcatgggcattggcatttcttgaaagatccccaagataattccaacatgctgctagcattaagaactgctagcatagatttaagagctggatgacctactgtgttagtgaggtaggggaaaactgtccctcttgtgcactgccattgcattatgtgtaaatctctatggtgggaaattggcagcacctatcaaaattacaaatacatgtactctttgacctaacaattcccttccaggtattcctttacaggtcgactcaccagggcaacaagattactcgctgtagaagattactttgtacaagattactgactgtagcattgtttgtaaaacaagactgccaagaatctaaatgtccattggtagggaactgctcaaacacattgtggtgatccatgcaatggagtactgtgtggctgacagagcagaagaaaggtcttcatgtactgatgtggaatgatttctaaaatatgttgagtgataaaagcaggatgcagaaatgtatatttttctatcatttatgtaaggagaaagaaaaatctgtttatttgtgtggataggtataggatccttttgaaagatgcactagaaattgctaacattatttgcctctgagaagaggagctggatggctgggggcaggggctgacaggagactttaatttgaacaggcaataagtgatagagctgggagttttaatctacctctttgggattctaaagtatatggattttcttccctccccccactacgaataaaaaccatatgctaagtttttaaaattttgaaggcttattaacttttcattaattagatatactactcatacataccacaagcactgtttattatagttggggtttctttaaaatgtagtgctttgagatattttcaaactaattgaaatgaattgtcgcctatgattttattttttaaagctctaaactagtggtcatatgccaatgtagattatgcagtttgcctatgattgcattaatattttggaggagaatcttagggaaaacagcttttgtcccgtatggaaattttaagtaactttttttttttaaggtttccatgggtgaactatcaagatggcaacctcaacatttcaattccagtgtttagtattcatggcaatcatgacgatcccacaggggtaattattgttttcttagagtttgttggaattttggaaatgatcagtttagtttgtctgtggaaagcatgccttccctttttctcattgtgtagtcaaattgagtcaaaagtcaagttgacttttcacattcatacaagcttttatactgctttttagattttttaaaaatctgaaataagaattggtgtatgagctatgcttttatttcattaatactgatgttaacaataagaagccaggagtaggagtgaacacctaacatctgtatagtggtttacagtttgtcagtgtttttataactatcttataaaatctcacttttaggaaatgattgttcaagaccatctttaaatctaaattagattatcttattacctgtttgatatggaagtaagactagagatcctacaagtattttttcattttatctggtcattaatattatgaatcactgattatctatggtcttttttccccaggctttaagacggttgcttaatattacaaagcatttatctcatggctaatttttatttttttgtggccaagacatcataagttttgatgagatattaaccttgcctttggcatgtgattccagttgctgtaggtgatttgtagtacaaaaatgtagcaaatacttttactattgtaattttgttttgagaagacactatcctcatctatgtttttgtaagtagaatatggagtatgcttttaacaggtgatacgatattcatgcagatacctacttttacatacacactaacattctttgaaattattttgcataggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggtaagacagttttattttactgtttatgtccatgtgtgattctttaaacaattgagaaatttggagataagtttgtatctgtttggaaaaaatggggcaaaccttattctttattggtgactataaaaaatgatggatggttttggtaaaaatttttggtgaaaaaatgtcttttcgttactatttattattttgggttttttttagactcaggtgtagaatcctgaatgttagaattatagaataattagcaaaactgcactttgatatcttggaagtctttgaaaggtctaatgcttcactgtacaataccgctagcttataattttgtgcagctttcataatacctctggcaagtagaaaagcatcatggttatttatattttagagataaggaaaatgaaatctggatgttatatctgattctgcaagtgaaagagcaggaagtgaaatatacttttcttaaaaaagctattaacagttgttttaatcactgcagtgttattagggatcatatctccagaaaattgcctttcctcctccattcagactaaggacagattccattatgcctcagtcaccaccagaagcacatctctccagtcatccattttctcccaaactcttatcttatcctgttctattataccttccttaactggactctgtctccaccctgcacccctccctgtcccccagctcttcattataaactctagaactctttttataattatcagattcctcattattatcagtctcttctctgaatgttacctccactttctaaccttcagtgaagcccagctgtcccctgaggttcctgtgtcccatgcagttctcttacccctgggcttttggaaagaagcggggatcactgttctccttgctccacccactgcttccttttctgcctgcaaacacactgttccctttaagcttctgccatctggctaaaccgcattgctttttctctcagactttttacctacttacctaccttcaattttgccagtgtttttagtgtttcaacactcaagtagattaatcttctaatgccttgggctttgtgtgccttgacttttttgtctccagttacatgttctacattccacctcagccatgtattccattggccactcctgtagcattctccttgggagctaggccacttctaacttctagacttctacattgttggcttttcttctgagaccctctctaatccgtatataaagtagcagtgttgtccacccttttaattccatagtgttaattcgccatcttagcatcctggctttttctccttttataatatttaatatttgtaactattttgttgacttgtttttgttagtttctttcactagatcaaggtgaacctgtggagtatgagaattgtttgaaagtcattgagttatttaaaaagcacaatatattaaaacaatgtaagaatattgtttttaaatacacttttatcatcccttttaatatttatttctgcacatgttataatgtatatattagatcaaaagtatatataatttataacaaagggatggtgaaaaatagtattactagaagttttaataagaattttaccatagaaaactcacatttttattctacattttgctggttttgaacatgtatatgtctgaaatggaaaatgtttttcaaatgcaactaactactgttatcaagaacctggaacaggccaggcgtgctggcacacgcctgtaatttcagcactttgggaggccaaggcaggtagatcacttgaggtccggagttcaagaccagcctgtccaacgtggcaaaaccccatctctactaaaagtgcaaaaattagccagacgtggtggtgcatgctgtaatcccagcaactcaggaggctgaggcacaagaatcccttgaacccaggaggtgaaggttgcagtgagctgagatcacaccactgcactccagcctgggcaatggagcaagactgtgtttagaaaagaaaagaaaagaaaaaaaaccctgaaacagctaggcatggtggcttatgcttgtaatcccagcactttgggaggctgaggcgagaggattgcttgagcccaggagtttgagaccagcctggacaacatagcaagaccctgtctcagttaaaaaaaaaagataaaaaaagaacctgcaacatacccacttataaattattccagaattcaaatatatctcccaacagtaaagtgaaatactttgagaaggacataatttagaagcaaaatagattcattttttaagccgaagtaagaaaacaatttaaaaataatgtaatgtccatttcaggatccattccagatgaaaggctctatcgaatgtttgtcaataaaaaagtaacaatgttgagaccaaaggaagatgagaactcttggtttaacttatttgtgattcatcagaacaggtaaaacttttctctgaaaaagtttgagccaagtgctgaggcttcccaaatctgtttctgagcttacctattttagtgaaatgcccttaatctttcaaggttgtcaatgcaagatcagacaaaacatagatttgctttgtgtgatttcattttgaaattgtttttagtatatattaatacctacaagaatatttgtaacataaggataaggcatacacatgaatactcctcaattcaacaaaaaggtagaatctttttgttggattatccattcctttatcccattccttttccctgatcccacctgcttccccctatcccaaagggaagcattattaattttgaattaattatttcattgcttttctttgctgtttaatcacatgtatactcatattatgctatatttacagccaacttatgttcagcattacattactgagatccattttgatgcttggatgtgtaatttatttttactgatgtgtacagttatgctttgcctcctgtcagtgaacaggagttttttgcttttataaaccttgctgttatgaacattcttagacatgtttcctgctacatatatgcaagtgttcttccaggatatacaaatatagctagattacctttcttttgttagtagttttaagaaatttaatctgttggcagggtataggattgattgaaaagaagacagacttgaagaagcaagatttattatctgatcactgcagtaaaaatgtgaggtggtgacagtgatggcaatgaaacagaaatgggagggacacaccggagaagttgtcagggaagaactcaaaggatttggggcctgattatataatttattacagttgtcccttggtatccacggggggtgttcggtccaggacctaaaatcctgggatgctgaaatcccttgaataaaatggtatagcatttgcatataacctacatatatcctcctatgtactttaaatcatctctagattacttgtaatacctgatacaatgtaaatactgtttaaatagttgttatactgtattgctttaaaaatttatatttttcgttgttattttttattgtttttttcctgaatatttcgatctttagttggttgaatccacgaatctgccaatacagagggccagctatatttattgaacacatttattgaatgcagactactctgtgcattcagtgaatgcagacttaggttaaatactcggtaaaagaaagggtttaagaggctgacttgtgttaccttatgtgtgagttcttgaataaactgtgagtttcaaaggaggggcaggccagagtttagatatgtgtgtggtcttcatataactttgcaccactgggatttgttccttctcttccatagagcttcccaggtctaccatttttttgtactatgccaaagtagggatgatgagttgaaaggaaaactcataagtaattctaagaatttaagccaaatgaaaggtagaatagcagcattggtaaggggaatgggtagtcaccatatgatgttgatttttctcattgcccccctcatcatttgattaagggaatgtgtaacagctttctctgctgtaaagttcccattttctacttttcaattaataaatatttttgggaaaatactttgagactatgcaaatatcctgtttcaccttaaacttttactcgctaattttagcatccatgggtgatcttatttccagtaattaatactgtggtattttaattgtaagttttgatttccttcattctttctatatttattaatggaattcttctgtaaggaaaatttgtcccttcttctctatttacttacttatttatgtcattatggacttgaagatccagtactatcagttttttggttgctactgttcctctgattgttgcagctttgaccattgcattctcttttatgttggcctctgtgtcctttcaatgtcttcccacctgttttgaggtcatgaccttagttagctttttggcacctcaagatggtctaggctcttggctcttgtaatggcaaaaatcacaattacttttgcaccaacctgatattttcctacctagccctggaatcaaccatttctccaaggtgctctgattctttttattggagagtggtattcagaaatccacaaatgcgtactaggtgtgcttactgctaccagggcttgctcagcactctgaatgaacagagttatgggaatagatatatgtgtatatagtaacccatgcatacatacatgtctatatatgtgcttaaaaaaccaatgataagttcagactgattctaatccagccctacaaggtccatttttgtcttctccctttccttacttgtgacttctttgtctaacagaagcctggatcatattataaatatatatgtttacttattttttcaatcttggtttaattatatttccaatcctggtataatttgaaattataaagtaatttcaaaattgctaactcatacccctgtgcaaaacaactttcccaactaggttacaatgtttgtgtaagttattttagtctttagcctttctgtatctagttgaaacctaatttttcaaacttacttagctcattttctccccacccccttcactgtggttatgtggttctttggtaatgctgttagattcatttgtcaccctgtgcattctcaagatacttctgctttcatatttaaaacaaagaaggttttcacagattgggtgagaatcttgagccttctgcattttgccttatttcccatttgtttctctacatcaactgtttttttctcttgtttcaaagaagaaagaatctgaatttggagatgacttggtcatgcaaaatctttcaacaaggatattgtgatcacttctaggtcacaaattacagtcagcctaccagcatcatcctcccttcttcttccgggaaagaaccagcactcaatgaaggcacaatggcatcatgttgtatttgggaattattctgcttttctttagtagttgtgataatctcataccttagatgtatgttttttacataaaaacattcctggatacacaagcctgtatattctgtcttccctgcatttattctgcttagcccttctgttctccttgctgttccttgaattcactgaacacattcccactttagcaccatctgctcttctactgcttaggactttctctctccgcgtactgatgcttcatctcagttctctgctcatttgatgctagtcagagaggtcttcctgactaccctgtgtatgtagagaggagtatggcacttctatgtcacttttccctttatttttctttacagcacctatcactaactgacaagttatacatgtgcatacttacacacatgcatatacatcttgtattagagattgagtatcccttatctgaaatgcttgggaccagaagtgtttaagattttggattttttggattttggaatatttgcacatatgttggggatggaacccaagtctaaacatgaaatttgtttacattttatatataccttatacacatggccttaagttaattttatacatgttttaaaataattttgtgcatgaaacaaagtttgtgttaagtatttatgtgtggaatttaccacttgtggtgccatgttggcacttaaaatattttggattttggattttcagattagggactcaacctgcattgcttgtttcccacactagaacaaggactttgttcactgctgtgtcttccatatctagaagaagcctgggacatctgacataaagtagacagtgtttgggtaacagtatttgttgggtgaatggaagaatattggtttggattaaatgaatgcttggttaaactatgtgaacacttttacttgaatctccaatgatgtaagttaatattagggaaaactattccttcttgtcttctatcaccttgcatttcatgtatctttaaataataactgatataggtataataccatagtttgcatatcacttgtttatttaatatttgatattgaaaactcttagcacttatgtgagattgatgtttttactcccattatatttattagtaaaaagataatgttaagaaattactggacatatttatacttacttgcattttctgtgtgttttctctagtatatagttagactgatttatagatttctactattgatagaattcatgcttttctgattgaccaaaggggaaatccttcctatgtaaaacctttcatgatcttcctccaaatatagaattgactgctttctcttttcgggtttccacttgtctgtgtccaataagtttgtaaagctctcaaggtcaggagttagcattgatgatctttacattcccaatcctgtgcacactttctggtacatagaaggatgcaataaaatctttagtgaatggagaaagaaagatctgtatagacttcaataatatgaaatttttctaatcaccgaatttatatttttcaaaatcttgatacaggagtaaacatggaagtactaacttcattccagaacaatttttggatgacttcattgatcttgttatctggggccatgaacatgagtgtaaaatagctccaaccaaaaatgaacaacagctgttttatatctcacaacctggaagctcagtggttacttctctttccccaggagaagctgtaaagaagtgagtgttatatattttgagccaatttttaagaaatctttgctataataactaatcatctcataggtttaaggcctatgttaaggttaccgctaactggcagtattgtcatttatatgatagctttatttttgaaaattgatcattctgtgtagtcttattgtttttccagattttaagccattttcaaaaagagagcatccaattggtgttattttgctgctcattaggcaaattcaagatgcacatttttattatatttcaaggtagatgttttaggttgatgattactaatttcacaaagttcattataaaaaattatcctaaaaccatttaattgaaaattttctgattataagtgcagtataatagatctcatttttaaaacatttttgggggaatgatatgattgtaagaagtagttaacagtgattaaactcaatttttattatgggttttatcttttgaatcacttgagttctgattgttacaatgataatagggttaaagaatatggtagtagaatctatgttggttggttttttttcttcatgagtccactgcaaaatcattttgtctatatgtgtacatgtatgtacatatacataggtatatagatgtaatactatagtctacatatgctaccatcatagtcctgttaacatttttttatgcttattatgtctatcttacaagactgatcagacagggataataatggatgagttgattttactctggggaaggaaaatgtctaccatcttttcctgtgatgataacattaaggttaaattagcagaaacatttatttttaagagtatgattttataaagaagcatttttagaaactaagaaatatgaaagctttcgtatgcacatcaccctgaggaaatttacactgtgactcggtgttcatttctctccacttcagacatgttggtttgctgcgtattaaagggaggaagatgaatatgcataaaattcctcttcacacagtgcggcagtttttcatggaggatattgttctagctaatcatccagacatttttaacccagataatcctaaagtaacccaagccatacaaagcttctgtttggagaaggtaattctttttgataaagtcaatgagatctactttagttgaagaattattcaccttcaattaagtaatttaatagagtagagggaagcctttatgttgattacattctcatgaagcctgtaaggacactgttcttcagtgaatgtgtttaattgtgtccaagatttttttttttaagtcattgagagagaggaatactggatgttaaaaaaaattaaatctctctcctagtttctttcttccttttcaaaaacataatacataatcttttctcctttttaatcctgatttgatgatttgttcattttatttatgaaagcaggcagtaactttgattgaggaatgggagactatcgtgtgtgagaaaagccttagcttctaataatctgtattaggcgtccctttcaccctgaaagctaccccaaatgaaatgtgaaaaatgtgtttgctatccaccctattgctgcaatgtaagtcccaaacctccctctctatgcacattgccacccctaaatctctagaaaatttcagccactactaaggttgggtggattaatgcatttaataatatgtggtttgacagcttaattagcatcacttgctgacgctcagttcttaactctgtgtcagctgtcctactatgttttcttttcatgaaaaatcaggtaacatagtaacaatgataataattatgaccagtgatacttactgatttactgtatgtgatgtgcactgttgacagcatttaatctagccaacaatactatatgtgagtagtttctaccatctatagtttagaggaactgaaccttagataaggtgactcattcagtgtcacagctttttgagcagtgtgtagctcacgtaaccaaaagtgtacgcttgtttcaagatgattgactctagaaactcaaacatagattaagattctggcatccctaaatccaatctctcaagccaaagagatagaaaatgcattaattgcttttgcattgattgatccaggcctgagtcatgtgcccttccctggagtcagacctgggtttttcaactttggcttagttgacattttgtactaataattctttgttgtgggaggcagttctgtgcactctgggatgtttagcagtattctccctggtttgtacccactagatgccagtagtaccccttctaactggtcgtgatgatcaaaaatgtttacagaccttgccaaatgtccttagagaagcaaagtcacctctggttgaggtctactgtatgaacttcacctaaatcctgtgggctttggtgacatgaatccagagaggaaagtagacgctggtgacacaaagtaatagaggttcattttaaacaccaggtgtgcacataactttctgttatctctgtattttatgtacatttctgttattgtacttagttaagttatattattttttataagcatgtgagtgtcttctgaactctttgaggacaggacccatatcttacttttctgtctcagcacttgacctagtacctggcaaaatgatgctctataaatgcttgttggattgaaataattgacctaggagatcatattcttatagattttctctgtgctgtctgatatgtattcactagcacatgtggctgtttacatttaattatttacatttaaatttaaaattcagtttctcacttgtactagccacatttcaagtactctatatccacatatggttttggcaaccatattgaatatgcacatagaaaaaattattgcagaaaactcttttggacttcattgttacagacagtttaaaggacaagattataaagtcttagatgtgaaagaaatctgaggacaaaaacacttgttctgtattgttcttgagatcaggaccaagttataggaaggcagtttttgttccaatacaagaactttctaagaactagaattgttcagctatgaagttggccatctggagatatctaatcactgtgcacacagccatttatgaaaataatctagtgctgtctccttgtaacttggttttacccttaagaacaatatagaacaagtgcttttgtcttcagaactctttcaagtctaagatgttataatcttatcctctcagagtatgagacaactccacatatttgaaaacatcagtcttattttcttttaccttgaactcttccaagataaataatctaaagtccttgcttattgatccctaaatcttctggtgagtctcccatggatcatatgactgcaaaaactagacttacttggttttaagttggtaagctgaggaaagccttattgaaacatgagtagtaatattttaagttttattctaaaagaattattttagagattgaaaaattatgaagaactttcatgaaaggaaaacattaaggaatagtattaaaggagcattacaagaaggtatatttgaaaaggtgtcataaatgacctaggaaataaagatgattatgtagttcaggaaaattcctgtggtaataagctgctattcagccaagttaaactcagtttactacgttgttttttaatctttttaaaaattttgagattgaagaaatgcttgaaaatgctgaacgggaacgtctgggtaattctcaccagccagagaagcctcttgtacgactgcgagtaagtcctatttatatagattgaatattattaattttcaaagcatagtaatgtacagtttacatggtttctttgaaaagtagtgaggagagtgctcatagtaataagaagagcaatcaccatcggaggcaaaaacaaagatataaggatttgagttaatcacagtttaagtgataggtttggtaacttatttttctcattttctaaataatttgttgttatatttaatagattggctgagctctctggcttcatctttaactacctcctctactcacttcattccaggcatcttggccttctcgcagtttcttgggcatgtgggatgtgctcttatctccctttagtctgctcccgtgtcacctcactgcagccctatcatcaagattgcagcccctaccttctctccagtgccctgatttcacttaccttcttctgcttcctcttttcttcttatttttttccccgtaacacatccttctaatctatgtacggtttatttgttttggttattattaggattgtttcctgtgcctataaatctgcttatcctttctatcgtgttataaacaaagaaacaacaacagacttcttctttaccactatgcttttcccttttccaaactcctaccccatgttgcttactctctttaaaagcccctaaaagtatataacctatatctctcttaactttctcttcttcagttcactataaccaaggctctgacttcaccataaccagtggaaaagatgacctttaattgttcaatccaatagatcgtgtctcatcttgctgaattactcttgggcattctctgagttatttgtatccgtcccgtctcatagttagccctcttttcagtgtaggcatacagctttaatgaccaccaatagagtgatgacttcaaaatctttacgtagacctccttcttgttctgtatctccaggagtcccctgaggcctggtactgaggagtgtagtctttaaaccagcagtgttgttgttgcctgggaaattgttaaaaatgcagagcctcagaccctgcatcagaacccactgtattttaacaaaaatctccaagaaatgtatatgttcatgaaaatttgagaagtactgggatgtagactgtggaggtaaagagtacagtgtagagccagacttcctgagcttcattctggcccaaccactagttgtatgaccttgagcaaccgcatcccttatcccttggtttgtattaggttggtgcaaaagtatttgcgggttttgtcgtagaaagtaatggcaaaaactgcagttacttgtgcaccaaccaaatgcttcgtagatttatgagatctaaatggattaaatagtgtctgttgcacagtaggtaatctgttcccgtttctttatcccactgtcgctggcatagtgaagcccttattaatacttcctggcctattgctgcagcctcctaccaggactctgcctccagtttccttctctctccacactaatgccaaaatgatctttgtaaaacacagttttgcatgtcttttctgctaaaaataacttaattattccccagcactaacaggaaaaagtctaaacttttttaggttagcattcaggggtctacatgatgtggtctaaaccaaaaaagctgccgtcccctgggtgcagtggagtttatttcactggaacctttgtccatgttgatcctgttgtgtgggacatacttctctcctcctttctctataccttcttcagcacccacctaaagcctctgtcttcaaagaagcctttcttgacctgcccacagagaacatgcttcttcctttgtgtcctcatccaactttgtacatacctcttatagcaccactcacagtctgcttccagtgatctgtttacatgtttttcttcccagtcagtttgtgaatttcttgacagccaagattgtatttatttatggttgtatccctggccctgaacagcatacttagaacattgaggacatccaataaaatttgttatgaccaaacatttataaatgagaagtttgaaggagagacctaatagctttagcatttagtattttgtcttttataacatggtagctgtagagatgatctgggtaaggctgggcatggtggctcacgcctgtaatcccagcactttgggaggccgaagtggctgaatcatctgacgtcaggagttcgagaccagcctgggcaacatggcaaaaccctgtctctactaaaaataaaaaaattagccaggtatggtggtgcatgcctgtaatcccaactacttgggaggctgaagcgtgagaatcgcttgaacccgggaggcagaggttgcagtgagctgagattgtgcctctgcattccagcctgggtgacagtgagacgccatctcaaaaaaaaaaaaaaaaaaaaagagagagagagagatggtctgggtaatacaaaaataattactttaagggaatcacatagttctcttcattatggcaaaagatcccaattttctcatctgtgtctgcctcacagcattaaaactaaccagactttaatagaaaattggcatttcttttcctaagcacagtaaattacgaattcattcataaaacagcacatattgtcatataagtaatattacaaaactacattgtactgactaaaagacattcattaattcattgactaaatcttactgagtacctgctattatggatgctgcaggatatagggatgataaaacagatgaggttttgaattcgtcgagcttacaggaggtggaggtgcaaagagagacatgatacacaaatatcaaataaatgaacaaaaaaccttagcagatagtgatgatgagtgaaagtgggagcactttagttagggagcattctggataagctgtgaggtggtgcagtgctggtccccatagcgtactttgggaacagctagttgagaagaacatatctctgagaaagaaaggtggtatttgtctttgtaaaggtctgtttaccactacagacttctgtagaaagagtctaccttgagagaagttctcagtttcagtgagataccatgttttggaggtaatcatttctcaaggctcacagatttgattctttattacctggatgttcctagcattcatctttctcttgaggcacatctctaagatgatagaccaatttactaatgcatttaaggctagtattttattttggtgtgtgtttgtttgtttgtttgttttgaaagttcagaaaattgttttcagatggtttgcttggtaggtacctagactattagtgttatcagggggagatgtaatcattctgcattgtggaaattattgcaataccttgattccatcgaacaaagtattttgcttatgcttataaacttttcaaacattagtttctcagtaggataaatgatatagctccatcatgatctactgtagaaaattaattcataaatttcaaagtatcaagcataaacactgtgaatactgaaggattagtgtgtgttttaaaaattggcaaattgttgtttcctagcgttcatagattattctgtgttttcaggtggactatagtggaggttttgaacctttcagtgttcttcgctttagccagaaatttgtggatcgggtagctaatccaaaagacattatccattttttcaggcatagagaacaaaaggaaaaaacaggtaagctagttatttttatgaggtaaaaaaatgttcttataggatttgtgaaggaatctttattaaaaactgtaacataataatggaagatgttttaatatgattgtaatgtcttaaacaaattgacagtgggaataattctcttgtcttctaaaaattagatagcaatcttttttattattattataccttaagttctagggtacatgtgcacaacgtgcaggtttgttgcatatgtatacatgtgccatgttggtgtgctgcacccattaactcgtcatttacattaggtattgctcttaatgctatccctcccccctcccccaaccccatgacaggccccggtgtgtgatgttccctgccctgtgtccaagtgttctcattgttcaattcccacctatgagtgagaatatgcggggttcggttttctgtccttgcggtagtttgctcagaatgatggtttccaccttcatccatgtccctacaaaggacatgaactcatcattttttatggctgcatagtattccatagtgtatatgtgccacattttcttaatccagtctatcattgatggaaatttgggttggttccaagtctttgctattgtgaatagtgccacaataaacacatgtgtgcatgtgtctttatagcagcatgatttataatcctttgggtatatacccagtaatgggatggctgggtcaaatggtatttctagttctaggtccttgaggaatcaccacactgtcttccacaatggttgaactagtgtacagtcccaccaacagtgtaaaagtgctcctatttctccacatcctctccagcacctgttgtttcctgactttttaatgatcgccattctaactggtatgagatggtatttcattgtggttttgaattgtatttctctgacgggcagtgatgatgagcattttttcatgtgtctgttggctgcataaatgtcttcttttgagaagtgtctgttcatatccttcacccactttttgaaggggttgtttgattttttcttataaatttgtttaagttctttatagattctggatattagccctttgtcagaagggtagattgcaaaaatgttctcccattctgtaggttgcctgtccactctgatggtagtttcttttgctttgcagaagctctttagtttacttagatcccatttgtcaattttggcttttgttgtcattgcttttggtgttttagtcatgaagtccttgctcatgcctctgtcctgaatggtattgcctaggttttcttctagggtttttgtggttttaggtgtaacatttaagtctttaatccatcttgaattaatttttgtgtgaggtgtaaggaagggatccagtttcagctttctacatatggctagccagttttcccagcaccatttactaaatagggaatcctttccccattgcttgtttttgtcaggtttgtcaaagatcagatggttgtagatgtgcattgttatttctgaggcctctgttctgttccgttggtctatatctcttattttggaaccagcaccatgctgttttggttactgtagccttgttgtgcagtttgaagtcaggtagggtgatgcctcgagctttgatctttttgcttaggattgtcttggcaatgtgggctctgttttggttccatatgaactttaaagtagttttttccaattctgtgaagaaagtcattggtagcttgatggggatggcattgaatctataaattaccttgggcagtatggccattttcacgatattgattcttcctatccatgagcatggaacgttctgccatttgtttgtgtcctcttttatttcgttgagcagtggtttgtagttctccttgaagaggaccttcatatccttgtaaattggattcctaggtattttattctctttgaagcaattgtgaatgggagttcactcatgatttggctctctgtttgtctgttattggtgtaggaatgctgtgatttttgcacattgattttgtttttattttcatttttttgagacagagtcatgatctgttacccaggctggagtgcagtggcgtgatctcagctcactgtaagctccgcctcccaggttcacgccattctcctgcctcagcctcccgagtcgctgggactacaggcacctgtcaccacgcccctgctaatttttgtatttttagtagagacggggtttcaccgtattatccaggttggtctcgatctcctgaccttgtgatccgcccgcctcggcctctcaaagtgctgggattacaggcgtgagccaccgcacctggtctgcacattgattttgtatcctgagactttgctgaagttgcttatcagcttaaggagattttgggctgagacgatggggttttctaaatatacaatcatgtcatctgcaaacagggacaatttgacttcctcttttcctaattgaataccctttatttctcctgcctgattgccctggccggaacttccaacactgtgttgaataggagtgatgagagagggcatccctgtcttgtgccagttttcaaagggaatgcttccagtttttgtccattcagtatgatattggttgtgggtttgtcataaatagctcttattattttgagatatgttccatcaataccgaactaccttgacgtcacaaggcaccagcagtacccatgattgcttttgcatcgtcagtgtagcaatgatggcagatggcaaaatggcaaataacatcttaggattattatgaaagtatttttgacgttattactccctgaatgggtcttgaggacctccagaagtctgtgcttcacccagtgagaacagctacaagacacctatcctggaggtatgaacgagaaatactgactgtggggaaaagaccgtggctattaacaaaaatggcttgttttgcctcaaaatttaccatgttgagcaagctggcagttgctaaagtttggccttaccttctccactgacaacttgcaatgagtatgcacattttaacattatgatagaagctattttttgatatacttctttttttctaggagaagagatcaactttgggaaacttatcacaaagccttcagaaggaacaactttaagggtagaagatcttgtaaaacagtactttcaaaccgcagagaaggtaatttcttacagttcacattttgaataatggctaccttatagtaacagattttaatttaggatatgtttagttgatagtttaaacaaaatgaatcctcaaaatgtttctatgaagtaagtagggtgacaattaattacattcatttgcagttgctgcacagcagggaaaattagtgtttaattaatgttagttattagtactgttattaatatagctgttattgttgatgttgttattctctttctttgtatctctgttgcaattattaaactgaataattttaacttaaatcagggacattcttaagtgaaacttagaagtaactagggtgacatttacattcatttgtagttgctgcacatcaaagaaaattagtgtttaattaatgttaattgtgaataccattattaacataactgttattgttgttgttattttcttactttatttgtatctctgttacaaagatctcaatccagatttagttttctcacatttggatgtaatttcagaattattctacaaacaaagacagccaaatgatggtgaagccactgaaacttacgtcataagtatatgccactctaagatcctccggttgtattagtttcctatgggtgctgaaacaaatttccacaaacttagtggtttaaaacaacacaaatttattatcttacagtcgtgtaggtcagaaatcgtacacaggactggaatcaaggttttggcatggctgtcttcctttttggaggctctaagggagaatccattttcttaccttttccagcttctagaggtgcctactatgttccttggctcttgctctccttttatcttcaaatcctgcaatgttgtatctctctaaccatttccccagagttatttttccttccagctcccatctgcctccctcttgtgcttttcaggacccttatgattacactgggcccacctggatagtctctgatactctccctattttacagacagctgattagcaacctttgttcctctttgccatgtattcacaggtcccagagtttaagacgtggacatctttagggggctcttattttgcctatgacactggttaatttcatctctattaatcatagctgccatttttggactccatatcctagccatcaggcctctacatttcacgtgtcctgtactcctcccccatttctggttttgactttgctttttctggttcctgatattagtaggcttaactacagctgttcactatattttttctctggtaacatatttggtaattttccttgctcatctataattattttgtaaggaataaaaactatttctgcatccagtgatttgtatcttacagaatgtgcagctctcactgctaacagaaagagggatgggtgaagcagtacaagaatttgtggacaaggaggagaaagatgccattgaggaattagtgaaataccagttggaaaaaacacagcgatttcttaaagaacgtcatattgatgccctcgaagacaaaatcgatgaggaggtaagtaactaatttgagtgtctaggtctatttaaatagtctgtctttaagagtagctctgagatttttttctggtaaatcactatttaacctctctgatttgtttagtttttctcatctataaaattgaaatgataaaatgaaggttaaattagaaaatgtagaaaatgcctagaacagagtcttgcatatggttggtactaaagtgttttgttccccatggatagtatcttctcttaaagatcctttgaaagggctttaaagtgaaccttgtaggatggtaatttttgttcattttaatttttttagtaagttttgattgagatcttgaatttcatttagaaaatttctgctaagcaagaagcagtggaaaaattacaggaaaagctgtctagacttgactacatagaaattataaatgtttgcatatcacattgtcaaaaaacaaaattaaaagatattgacatgaaaatatttgtatgtgggcagaaaaaagtttaatattcttaatattaatgagctcttagaaatcttaaaaataattaaacatttgatagaataatgaacaaaggacatgaataggtggttcataaaagaaatataaatagctaataagcatatgaaaatggtgtttagcctaggataatcaaagaaactcaaatacatcttttgtttgtcaaattggcagcaatttgagaaaaatagtatctagcacactgctggtagtagtattacgtttgaatagctttactgaaaagcagtttggcagagtatattaagaggcttaagatttaccctttaactcagcctgggaaatttccctatgaaaatagtgaggtagagatttgtgtatggagtgattcatcttagtgttgttcatagtggggaataattggaaatgttttgatacaataaatgttggtacatataccatataaaattttacacagcttaaaaatgacattttggaagaagaacatgagaagatatttctaatctaatgttaattgggaaaagaatttcaaagataaaaaactgcgtagtataatctcaattatttttattttatatgtaattgtgtatgtttatgtaaataaagaaaatatcccagatatattatcaacagttatgtcaaggtagttatattacaggggatcactttctctatttcccagattctccctaagcagaagaacaaaacaatgttatttaaaaaaaaaaaaaaaactcattcccttattttagtgcttttggttaacatggttctcttaaagccttatggtgtcaatgtgtaactaatattatttaataccaagtacttccagaggtaggacaggcagttcaccctctaaaaccattcactctatgactctggatgtgttgggtttgctaatttatagcataaatagatttctcaggtacataccagaaataaaacataaccatccccacctggagtgacatcatgactcctgagcagcaaagtctgtgtggggtgtgtgtgtgtgtgtgtgtgtgtgtgagagagagagagagggagagagagaaagagaaagagtgtgtgtgagtcatggtggctctgaccagacacccgtgttcaaaatcaaaacccttattagctgtgtacccatcattgagttatctaaacccacctatccctcagtatcctcatctgaggataaaatggtgatgataataggccctccttcaaggttgttgtaaggattagaagaattaatccatgtaaaatccttagaatactgtctgacacatagtgcctgttcagtgttcccactctgactctcatttctcttctgtgaatggcttagcacctttggtatgctacttatcacctagggcacgattacatactgtctcatcttttaaaatattgttattcttgtatttttcctctactgaatcataacaaacatgctgttatttctttcagcttaagaaacaaacaaaactctcgatcccattttcctttagctactgctctctgttcctcttctagagcagaatcgcttcaaagagttttctgtatttgctgactcattcttctctctccattttctattaaatctatccactcaggctcctgatcccatcattctagtgaagctgcacttgtcaagatcaccagtgactgccattgctaaatccactgtcagttttctatcttacatctcacttgaccttctttgaaacatgttttttattggatttcaggataccagactcttgttatcttcctgcctcactggctgcatattttcagtgtcttttgttgattcctctaattgctccagcctcttacattggagtcttatttgctgttccctctcccatatcatcaattgattatagattccatgagagcagctttttgtctgttttgttaataactgtattctcagtttctacgataatatatggcacattgaaggtgctcagtaaatatgtgctgagtagattattaaataaatgggcttaaagaacatatacatagctgtataataagagccttgtgagcaggaaccattaaaaaagaaacctgtagtctccttcttgataccaggaccatgctcagcaaaccttcatgagttgactcttaataaaaatggatcttcaggggccacccacttcagatcccatttcacagagcctcctggatgtcttgcagcaaggtgcacaagagtgatttgcaatgtaataaatatttcaagccttgtcaaggagatatttttgtttttaactagtttactgaagtgtaatacccatagggtattagaatttttcctgtacagtctgaaagactttttcagtgatgtgaaacattttggcagcaggtaatataattttgcttcgggtcaatatgagtttttttttttaagagtacattgtgcaattttaacgttaataattggaaaaatatgatttacttttgtgagacattgttaaatttgcaagttttataacataaagcatttcttaattgtagccccttgttttatatttacataactggaataggcaacatgtttgtgatttactctgttatgatctaggtacgtcgtttcagagaaaccagacaaaaaaatactaatgaagaagatgatgaagtccgtgaggtaattattctgctgcaaattcttgtgtttatatatcactttcttaaactagaataaccagtaggtttagttagaatagtcagtccataggtctaggggataggagtgagctggggttggcttaggatggctgcttttggttgatttcagttcagcctacaaatattctgctcattgctctttttttccattttgttcttgtctaaaacctgtttagcaagtgcagtgactcacacctgtagtcttggctacttgagaggctaaggttggaggggattgcgtgagcccaggagttcaaggctgcagtgaactatggctgcaccaccacactctagcctgggcaacagagtgagaccctgtctctaaaataaataaataaaaataaataaaacccatttaattgtatgtgtgtggggatatatacaacaaaagcccctattactcaaaataatatctctttgttagcagagcatcttatagataaaatcttatcttactgagctgatattattttgggcaaaaaagaaacttaaagtgttttggttagcaatgttaaccataagtaagcaagcatgggcaaatagacaatttctattatctattctaaaatattaaaattagcttaagcaccatcatcactgtcttctcagtctcattgcaggtttgaatctacaagttagcaaccatttacttaaatttggggcctctacctggtacttgttgaatttatgattgaaatgtattttcttattttctgattgcccttagtgttttatgattgctatctagtatttaaaagttataaactatgtactgttagttttgtcttgattgctttcattcagcaaacattttatattgtccctgttatgggttagatattctgctttatattaggactgtacatataaaaaagctgaggtctgtagccacaagattttctcaatttagtagataagagacatttgtgtaaggaagatatttattgaattatttttcctaggtgcccattttataaatgaggagacagaccagactcaaggtcatggagtggcgctagaatttgaacatatttctgactccaagtgtagacttttctatcatcctgtgtcctatcaaaattttagattattataatattaattcggtgcattgcaaatggatggttttctaaaaatgaaaaacttctaaaagtgtcatgcaacacatcagaatcactgttgaaatacacatagttgcaaccactgtatcttttacaggttgttttttggaagctaaggaaaagaagctatagattagaaatggcttaacacgtttattatatttctatttatcttataaggtgcatttaaaatagaaatagtttgccaaattgcaagaataatgctaggaagaaatgattcctgattcttaaatatctagcttaaaattgattaaccctttcaatttaacagggtacagaaatatttctttacgtttgagtgagttcttcatgtttgaagcgacaaacctcaatttttcattaagcttttaaaagagttaagagtgaacgtcttatacaaggaaggtgggagaggctgtgacaaatttcatatgggagttttacagaagaaataacttacaagttcagatattcagctatattttaagactaaaatgtaattggggcttcctaggtaatttttcagcatatcataagatattatatattttttcattttcagcatactatttagaacttaggtaatggagtctgaaactctgccaagctgtaattcacagctttgcagaatcatttggcttagaatatgaatcccagcgccatgcttaaattacttatactgacaaacaagactattagctcttctatttggagaaaaaacagtatgctttaaagtctttcaggctgggcattgtgacttacctgtaatttcagcactttgggaggccgaggcaggtggatctcttgagctcaggagtttgagaccagcctgggcaacatggcaaaaccccatctctacaaaaaatacaaaaattagccaggcatggtagctcccacctgtagtcccagctactcaggagacttaactgggaggatcgcttgagcccaggaggcagaggttgcaatgagccgagatgacgccactgcactccaacctggatgacagagcaagaccctgtctcaaaaaaaaaaaaaaaaaatcttttgttcacatagaaaaactctcaaatcttttctttaatgataaattcatatttgaataaaagagcaaacagtaaccattaggctttgcgggacatgtgtggtctctatcacatattcttgtgtttttttgtttgtttgtttttttattaatggccctttaaaaatataaaaactattcttagtcttacccacagtcgttagtttacctggcctctgatttcttatgttctacctcaatttgaggtgggttgataccctctttcaaaatataataccaggcactatcaatagtgaagaagtgacccacagaatgagagaaaatatttgcaaatcatacatctgataagggattaataagcagaatatatttttaaaacttctaaagctcaacagtaacaataacaaaaaaacccaatttttacaatgggcaaaggacttgaatagacatttctccaaagaagctttacaaattatagcacatgaaaagacactcaagatcaccagacattagagaaatgcaaatcaaaaccacagtgagataccacttcacacccattaggatggctgttattaaaacaccataaaataacaagtttcggcaagaatgtggagaaattagaaccatatacattggtggtggggatgaaaaatgggtcagctactgaggaaaacgatagcagttcctaaagtagttaaacatagaattatcatgtaatatagcaatttcacttctaggtacataaccaaaagaattgaaagcaggaacttatttgtacatcagtgttcgtagcagcatgattcacaatagccgaaaagtggaaacaacccagttggtcatcaacagatagatggataaacaaaatgtggtatgtgcatgtaatggaatattattcagtcttgaaaaggaatgacattctgatacatgctacaatatggatgaaactctgaaaacattatgagtgaaaaaaaaacagttgcaaaaggacaaatattatatgactctacttatatgaggtacctagagtaatcagattcatagaaacagaaggtagaatagtggttactggggagagggaggaatgtgaagttactgttgaataggtatggagtttcagtttgggatgatgagaaagttctatagatggatggggggatgattgcataaccatgtgaatgtacataatgtcactctactatacctaaaagtggtaaaaagagtaagtttatgttatgtatatttcaccacaaaaaaaaagtgtttaacagtaggatagtatgttttcaaatctcacaaaatgtatatggaaacatttttgccattggctctagacctgcactcatgagttaagctcttagaagtaatacattccaaagataacagtaaactctgtttttcataggaaaggtagagttaaaatacaatttgaatatacaatttgagatgataaaaatgaagatacagtatttagacaaagggaaaatacaaagtttagaaatgatggttagtaattgattccaagaagtaatcataatagggcatatttattttaaattttgctacatactgccacattagtccaaagatgtcttaactagtttatattctcaccattagtatttgggagtgcttgtttcctcacatctttaccatcgtgatgtattactgtatcttttgatctttacaagtctaaggggtaagaaattatttcctactgttgttttcagttcatactacttttttttactaatgagtctgcctaatttttatgtttataaatcatttgtatttatatgaaacacatggtcattttgtttggccacattttctctttcgagtagggtattggtctttctcttttttttttttttttttgaggcaaagtctcactctgtcacccaggctggagtgcagtggtgtgatctcagctcactgcaacctctgcctcctgggttcaggtgattctcgtgcttcagcctcccgagtagctagcgcgcgctaccatgcccagctaatttttgtatttttagtagagacagggtttcaccatggtggtcaggctggtctcaaactccttaccttaggtgatccacccgcctcggcctcccaaagtgctgggatgacaggcatgagcaaccgcgcctggccgggtattggtctttctctaattgatttgtaagagcactcacttgaacacatttgtgtgtgtgtgccctctctttctctctctggatatatacacatagtaatatagcatatttagggttttttgacacataaagtatccacttattcatcagcttatttgtttaaatcaggaatgattggtgattacatggttctgattttatgaagatatacatttgggttttttctttctttgttccattaatatagtgagttatattattatgtacatagcttattgacccatcctggtaatatatccattaccccctggtaatggatatattggtctttccataagcttctggagtctctatttgctttcataattataaataagattctgtaattttctttttgtgcacgcagttctttgtcagtactgtgtcatactggcattgtgaaaacagtttggaagctgtctttctgtatgctctggcactattgaaatagcagtgggcttatctgttttttgaaagtttggtagaatttacctacgaaactttctgattgtggtccttttttgggagtatttttcttttaataattttctcaaaattttctttgataattggtttgttgaacctgtttttttcccaccttggatcagattaagttattcattttccagattatttagaattgagcattctctcataagtcttgggtcttccctcccattcttccttctttctttttttcgagacagggtcttgctctgtagtgtgctaccactcccagctaatttttaatttttttttttatatagacggagtctcgttatgttgcccaggctggtctctaactccagggctcaagtgatcttcctgacttggcctcccaaagtatggggattagagatgtgagcttctacacctgtagtgctagtattagagatgtgagcctctacgcccgtccctcttatttctaatgatgtatatttgtgttttcttcctttctttaaagctttgtgatttttattaatgttattgttttgtcccaaaggaccagtgcttatatttattcattctaatgtgtttttgtttaaaatctattaatatatggtttcatcttcattctaatacttggataggctttattttgtttctcctagctttttggatacagaattaacttatttacatttattcttagcaggctataggctttcttataagcattgctttagctctctcatatgttgtgatgttcagtattcttgttatgattttctagatgttctgcaactttcgttttgttttatagttttgactctggtttgttttcaggaggcaggtttttgctttattattaattttttattttattgcatgatgattagacagtgtgataaatttatttctcctatcaaaaatgtattgagatttttgtttgcaccctgttatgtatcagctaaaaagtttcatggggtcttgaagtatattattaattttcagtgtatagaattcaacatttatcaattagatctatcttattaattatgtgatttagatcatcttttttctcttaagtctgctttctaaaagcatacagctggttccttttatttgtggtagttatgtcgtataaaatcacttccagcacagaattagcaaatggtgaatcattgctcctaggggaaatacaaaattagctttctatgagccactgataacgtttttgtcagctgatcaatacgtaatctttttaatgtgtttctgtttaaagatactgtatttaacatttgattcattagcattgaactcatagccagtagcactttaacttatacttgaattaagtttatctaatatacattttttctccaaaagtcatattgcagcctttttgcatgtaggaatgaacactaaacatgttgagggggtcatttgaaaacaccacattaccaaagcaaaagtacaaaaatgcagaaaatgcaataaatatgtagtcatgtgccacatacaacattttgatcgatgtcagactgcatatccagtggtggtcccatgagattataataccatatttttactatatcttttctattaagatatgcttagatacccaaatacatagctatggtgttataattgcctgcagtattcagtacagtaacatgttgtacaggtttgtagccaaggagcaataggctatctcctatagtctgggtttgtagtagactgtaccatttagctttgtgtaagtacacactatgatgtttgcacaataatgaaatcacctgatgacacatttctcatgaggcatccatcattaagcaatgcatgactatcacagaaaggacactttaaagtacacaagtggaaacaagaaggcagagtggctcattgttcagcctcagctgggaatatgtgtgtcaggcaattcaaaatatttaccactctgcgtctccataaatgatgccaaaagtatcgtgagtgttgatttttagggttacagagaaattttggcaagtcggtgaatttgcaaatataggattaatgaataatgaggattaactgtatttcatgtgggacaggaaagatgaattgaaatcactgttgtttcttatattttttgttgtatttcctgaagtgttttctttttgcattgtaatgctgtattgaaccctgcatgcagtgagttagctgtgatttcacctcagctgagatcatctcatcatgaagttgccacttcagtcccactttatgctgcctgccttgttcacatctcctcatttagccctgggtctccttactttatggtatcacagagcttagaaatgttctggtcagctattcttagacccagaactgccattccaagcaagagagactgttatcatgtcttcttgggatttatacatcagttttggagagctgtataatacctgaaactcttctcacctttctcccttagctaggtcaaatatttatcatattcattaactcttctttatagtttgtgtgtttgggggtttggaactattttttaattttatggaaaatgtattttgtttttgttctcttactaccttttgattggtttaagggaagatcaaggcaaaattgcttttatttatattttattttattttttggtgacagggtctcgctctgttgccaggctggagtgcagtggcacgatgtcttttctaaatggattcttaccaaattaaaaatgcgtggcatgttcttggtcctaaggtgtttattccttcttaggcttaggctttcagttgatatattctccttaattcttccgtttcttttcattttttttttaggcaaggtctcactgtgtcacctaggctgaagtgcagtggtgcaatctcagctcactgcaacaactcccctccccactgcttcccccaggcttgagcgatcctcctacctcagcctctcaagtagctgggactacaggtgcatgccatcacacctggctaattttgttcttttgtgttttttttttgtatttttggtggaggcagggtctcgccatgttgcccaggctggtccctaactcctgatctcaagcagtccatccacctaggcctcccaaagtgctgggattacaggtgtgagccactgcgcccagcccttaattctctttaccatatatttgtgagagattgttactcatgtttttttctgattataaaactaattttttagaaaaagtgtaatatagaaaatatgtaatattcaagaacaaaaaacaaaagcaccctaaaatattagtgcccagagataacggctattttttgtaagtttttttcttattatttcctaggagccgattctaaaaagtagctcaaatgatgacagtctgttactgtcaaatgtggcattgaattagggatgattgccagtattccttctagttctgaaaattttgattctgtaaaattttatttttcttggtaaaccttttcaaagggtctcattttataggtagtatggtagattggtctgacagataataagtattaaatttgattggtggggaggttctcctttacacatatataaatattttttgtttttatttttatttttgagacagggtctctctttgtcacccaggctggagtgcagtggtgtgatcatagctcactgcagcctgtatctcctaggctcaagtgatcctcctgcctcagcctcctgtgtagctcgggactacaggtgcatgccaccatgcctaattttttttttttttttttttttttgtagagacggggtttcgctgtgttgcccaggcttgtctcaaactcttgggtgcaagtgatcctcccgcctcggcctcccaaagtgctgagattacaggcgtgagccactgtgtcagcctcctttatgtttttatagtatgattagttcatgtcaatgcctaaattaatgatttttaggatggtacgttatctcattgtgtgtactttctccttcttctccctcttaggctatgaccagggccagagcactcagatctcagtcagaggagtctgcttctgcctttagtgctgatgaccttatgagtatagatttagcagaacagatggctaatgactctgatgatagcatctcagcagcaaccaacaaaggaagaggccgaggaagaggtcgaagaggtggaagagggcagaattcagcatcgagaggagggtctcaaagaggaagaggtgagcactgagttcagtcctgtgcacattcacacttggcagttgagtggaaaatacagaattagatcttgtcagagttgaattataagttttatttctaaaacacggttctttaaaaatctatttttataatatataaagacagtctttaaggcagttctgacatgtgccttttacttaaataaattttgaatggccacatgcacttagggttttaattgttcttagcacataccttataaaagcttcactgtgtttgtcacgtagtaccttttggatacatttaatgtcatatgtattttcacatgtgcaaagtaataggcaaatatgagttgttaaagaaaatagctaaaagcctttggcaacaggaggaaaactccagatcatacaattattatttttgttactgtcataagatacaaatacacatatgcttatcaagtagtctttataaagtcagtttaagaaagaaaactgccccccaatttgattcctaaaactagtcattaacatagtcaacattgtatttactgtgagactattgtcattgaatagttcacgccaatagaaattggtcattcagtgactttctcacacattatgtcagttcatctctaaagattttttaaaattgtttttattaaatatgcatccataggaattttaagctggtgaaatgaatattaatttggtttaaaatctccagggagagaaatcctcatcttttaatgatgattattttcactattcttacatttacaaaatttttccttaaaaatttttatttttgttttttaatttttcttgagatggagtcttgtctttgctctgttgcccaggctggagtgcaatggtgcgatttcagctcactgcaacttccgcctcccaggttcaagcaattctcctgcctcagcctcccaggtagctgggattacaggggcccatcatcatgccagttaatttttgtatttttagtagaggtggggtttcaccatgttggccaggctagtcttgaactcttgacctcaagtgatcctcccgcctctgtctcccaaagtgctgggattacaggcgtgagctaccacgtccagcctatttccttacattttaattggataaattaaattggataaactgaagtgtggcctaaaagaatagtctctgaaaattggtcagactctagatgtttgttcttatatatatgtctggctttttacagacaaactatttgacataagtttatttagctttcattttttggtgttgtatgaaataaaccttagctgctgataggcttgtacattgactgttcatttttctaacagcagacactggtctggagacttctacccgtagcaggaactcaaagactgctgtgtcagcatctagaaatatgtctattatagatggtgagtatagactgcaagtgattatttataaattccaacattagaaagaccaaggtaatcaccattggtagcccttatttgtgttgcaatcattgggaagttataagggcaattaggatcacaggataaattattttttaaaagatctttgctatgcattagagttactgaagagggtaagcttttaaaatcatgttttataggccaggcacagtggatcacacctgtaatcccagcactttgggaggccgagacaggcagatcacgaggtcaggagatcgagaccagcctggccaacatggtgaaacccggtctctactaaaaatacaaaaatcagccaggcgtggtggcacatgcctgtagtcccagctacttgggaggctgaggcaggagaatcacttgaacccaggaactggaggttgcagtgagccaagatcatgccattggactctaccctagcaacagagagagactccgtctcaaaaacaaaacaaaacaaaacaaaaattatgttttataatttcttactttcagacaaatgctgtttctgtttggcagagagaccctggaaacaggaaagtgaagtagttggtcactatatggacagtggtcgaaagagagaggaactgtctctactgtttccttgcttcccccatactgccctgtcagtctctgctttccatatagagaagtcatgtgacctatatttaagagaaattatggctaggcccttggaattaatttgtgtatatcctatggtctaaaaattggcctcaaggggatctgtttaactatttttaatattatagatgatgagatcagcctaaaatgttagtcatatttacaaaaagtatgcattaagataggtggtgatacttttttctacctagcatttagaatatattcatatgtatattatttatattatcagttatttgaggttattgtttcacttttataattataaatattttttaaatattataattgtaatatttataatcttatagctaggattaattgttgacacactggggagctgaactaattctcagaagatgaagtttatcaagggtaatataaaccacatttatgtccaaaaggacagctgcacaagtagagttgtgagaggtatgtgagtttaacagcaacccaggtgaaaaagacttaggtcagtaagagttatgcaggcatacccaactgtccaaatctattgatattttaaacagcatttaatgagtcttgcagaggtgtccaagggagagaatacagtcatggattcttagtttctgtttctggttgggccagtaaagcccttttctcatccttcttttcctcatatcactagcgacagaaactaaaaaccatggcttcagctgctaaaagcctaaaacaaaagaaaacagaacaaaaacaataacaaaatgaggtgggttggacaagcttgcacagcaaggaagttctctctgtgtactaaattggccataacatgccaaggatactgtactcctctttggaattatatttcaaggagactgtcaactatatatgatcattcagaagagataccaaataatataaaaaatggttggccaggcgcagtggctcatgcctataatcctaccactttgggaggctgaggcgggcggattgcctgagctcaggagatcgaaaccagtctgggcaacaaggtgaaaccctgtcccctactgaaaatacaaaaaattatccaggcagggcggcgtgcacctgtagtcccagctacttgggaggctgaggcaggagaatacttgaaccgagaaggtggaggttgcagtgagccgagatcatgccactgaactgggtgacggagcgtctccaaaaaaaaaaaaaaaaaacaattggttgaaggaacttaggatttaggatatctaacctgggaaacattcagatctttatgtagattatgttctatcgtgtaaaatgtggaatgaatagatttgatctgtttagtcccaaaggcaatgctttttaatctattttggcttatggattctctaaaaatctgatgaaagctatgtcttctctccttaaataagtactcacatgcaattgcacccaatttcaaagggttcagccactcccatgaggcgcattcgtgttttccagcttaagaactcctggcccaatggggatggatgggaatagctagaaacatactgatttaagtttctcatctgatagaatggacctggaagatttaagaacaactttgttcccctgttttatatgtgagggaactaagccaagcagttttgccctgagttgataaaaccactaatagtagcaataatagctaatatttatgaaactgcatgcctcttaacaggtctgtggggtaggtacttactatattatttctgttttacagaaaaggaaacaggctttaaaaagataggtagcttatcctagatctcataacttgtcagtaccagatctgggaatgatctcacattctctgcactctacaaccagtagttgaccactgtactagtttccagagcaaggtaagattagagacctagctactagttctccatagaataatttttgcattatgcagaataacctatgtaattaatataaagatggactaatttgccttggaagtaagtatcactccattaaaggaattttcaacatttatcaaatgacagctgacattgaagaaaagatacaaaatcaggttgattaaatgactcttaaaccttacaaaaaattccattgctatatttttactcaagtattatttagtacttcagaagagctagctaagatccttagctttttgcttcacaaacatgttgtctttattgccatttagggagtggtatctggaaagatgctgttccattcttggtaggtttaatataaaagcagagaggaagaaagagagaaaaggcagcctggaaaattgtaaaggattcatgctgagttcaaccttgcattcaacaaatgacagctttgtgacttgagacaaatcagtcactctcctagtttgtttagatatgattggaaataataatctctattgtattgggttattctgaagattaaatgatcaaaaagcctggcacagtaggcatttatcaagtgttcttttaaaaatgagaaaacaggaacatagaaaaagagtgaataaaataatgaacacttccatgttaaaccaccaaaattggttagcatgcaatcgacagagtcatagatgtagattacccacctttaccttagcccaaatcgtctttttttgtcctgtcttgttttttttttcttttttgtttttgtgtttttgtgtcctgtggaatccagtgtcctggcttgttttatgttaagctttccttgactccagtgggtagaattcatcacttaaaatgagtcgtctttgagtttccactgtaattaagaaatcagatatcagttaagcttgttggtttttgttttttaaaaaataacctgtttttctctcagcttgctgtttttggtgttctgcagtttcactgtgatgaatctaaagatggtactcttgtttagcctgcttagcaattattgggcttcatgaatctctgaactgctatcttccgtcacttctagaaaatccttagctattatcccttcagatgttacctctatgctattcttattctccttctgagtcttcagttaaataatgataagacctctttactctctcctcacatgactcttgtattttctgttttctctttctgtgctacattctgaataattatttctgatcacttttttttttttttttttttttttttgagacagagtctctctctgtcgcctaggctggaatgcagtggcatcatcttggctcactgcaacctctgcctcccggggttcaaacaattttcctgtcttagcctcccgagtcgctgggattacagatgtgcactaccacacctggctaatttttgtatttttagtagagacacggttttactgtgttggctagtctggtcttaaactcctggcttcatgtgatcctcctgcctcggcctcccaaagtgctgggattacaggcatgagccaccttgcccagcctatttgcttcctttaaaatatgctctgtcacttttaatagtttttagaagttttctgaagatatttttaggcctgttttaatttttcgtgtgtacacagtaaggacttcttttattttgtatctaataacctagtgtctgaatgtctttggcctctttctgttgtctgtttctgtgggttcttatttatggtgacttatttccttccatgctttgttacttactgtccctagaaaattatcaacaggaataatttgagaccttggatgaagccatcttccttcagagaagattcacgtttgtttctctaggtttgtagggcaccacaagtcatagaccactttaagctaaatttgagggtttcttggaccagtcatttgatacgtacttgtaactaaaatgcaggttcagtcacttgctgcttgcaaagtccaattaacaagagcaaggtgtggtataaagaaagtgactttttattccaaagcgaacttaggggaagaaatacaggcttcctaccttaagggtactgcttccccctttgcagcagaaagtggactcttttaaaggggacctatcaggagtggcatgcaggggaggaagcgagcaagtggggggtttgcattctagtttggtgtcttatctaccaggcagttgaattggcatcttcatgggtagaaataggctataaaggtggccgaatactctctaggttggcgagagtttcatagcaggactttggattgtgaattgactgttatctctagaggcaaccccctggtgggtgatagttcaactctggagcttccaagcacatagttagatgaactccccttttagggagtctctgatgaagaggaagtaaaagactatagttgcatttctaaagaactaagtagaaagtgggggaaaggagaaaagaagagagagaaaaagtaatgaactacctcttagaaaaatgagggtactcagttacatgcttatgaaatcctgtttacctctgcttctctcttcaaccactggggctccaccttaggaagggaaatgcatcggggttttcactttgggcagccgtgggctgtggtagccctctctatttttcttcaggattctcaaaaccaatgttaacattttcccaattgaaaagtgaactcagggaaaggactctgcttacctctctgagttctagcttttcttcagttttggcctggtaattccttggtatgtgatcagctcttcaatgccattgagaatttttttttttttttaaatgtttgaggtactaatttggattgttgtcagcagaagtgagtttgaagacaatgagaggtcattttgtctgaataacctagcctgcaatgactgttacccattgacaacatagaataaagcttctatttgtgtagaaagactggagaccagttatgatgccttaaaagttttacagaatggcttgactaatttttttaaggaaacagtattcatctatgaaaagaggctatgtaaataaactaaatacgaaacgtcagatttcctgaattatgttgtaagcaaaaatcttattatggtaccttttgcagcagagcatgatggttaagaatgcaggctctggagtcaggtccattgggtcagtcacagccagctctttactgctggcttagcacccttgcactgtaagtgctgtgagaaaggggtctgcatcattcctcctcatcactgtatccactatatttggcacataacatagtagatgcttgttaaatacttgacaatgactgagtaaaaattacttggagattgtgtagcgtaagggtgaagaccatggttctaaagtgaggaagatcttggtttggatcctgacttctcaattttactagttgtgtgtcctccagcaaatatgttaagtttttcatctttaggaatgagtgttctcatctgtaggatgggacaatgattgcgtccacctcattgcgttattttgaggattaatgagaaaatgcatgtgaagtatcaggcagtgtctatgcatattaagccctcagtaagtgcaaactggtgttattctacaagcatcagatcccttagctataaaatttgacaatgttgtactgacttcagagtaattttattaaatgagcttaagtatttacagtactgatcacagcacctggtaaaaatgcgacagatgatagctgttattaatattagtggtagtgttttgcaataagattatgaagatgaatattatgtgaatcattggtctaaatttgtcttttatctaattgatttgatataatggtttcgctaacttaactgattacctccagtactaggcctttttttgaaaaatgaactgattttttaagtataaatttgtgaaacatttttatcaggttggatttggtgggtttttttttaagtctctgacagaatacctgtgaagtagtaactatacttgtcatcactttgggacagaagcaacaaattaagactgtaacttctagatctctgttttaaatggaggagtgaagagataaataaaggtcaaattctcttataacaaggtccatggagtatggaaatttattattgtgctgcaattttattggaaaagataaaaattacacttgtagccacgggagttgtaaataggagttgacagcccagatttttccattgaagttagtcagcagaggatagtggctaggtgaataaaagtacctctgaagtcacggcctttacatttcatttataccactatgggtaccactgctgctactatgtttgctacccaaacagctacatgtatttgaatgctttctatctgctagacacttcctcttaccctctcagcagttttctgcatgaagtattaacactgttttacaggcgaggaaattgagttttaaagaagccaaggagcttggccatagtcaagctagtaagtcaaaatgagtctaactccaaaaccagagcttttaaccaccacactttattgtcttcctaacagaacatattgcttagttttctgataaaattatttcacaacatcactcatcttttgccttccagtgggataaaaagaaaggtatcttgttttctaggatctcagagttaaaggagtcagtgaataaatactgaacagaaatattctttgaaatcatcatgatcactggattttttattcagttgctctgtctagccttttgagtagagtaggatgtgaaaaaagtaactgagtaaagcagataagaacactgtttctgcctctcgtttctcctcttagatattacaagtttggggacagaacctagaataggaaacatgtgcaaacacaataaatttaggttagatagaaagattcgttagttttctgactaggagaattttggactttgcaggattttttgagtatttgtttgtttttctgtgccctatttagtttgtgagttatcttggggaagatatttttgatattagcaaactggtaaggcataggagaaaataaacctaaattagacgtttgaaatttattgtaggttttgttttgttttgttttgttttgttttttgagacggagtttcgctctgttgcccaggctggagcacagtggcacgatctcggctcactgcaacctctgcctcctgggttcaagcgattctcctgcctcagcctcccaagtagctgggattacaggcacctgccaccatgcctggctaatttttatatattttttagtagagttggggtttcaccatgttggccaggcttgtcttgaactctggacctcaagtgatccgcccgcctcagcctcccaaagcactgggattacaggcgtgagccactgcgcctggccttattgtaggtttcgatgtcaaggaaaaagaaagggaaagataaagagctagctaaacttcaagtatctaaccaagtttaaaaggaaaaaaggtatggatacaaaggaatttttatcatagaatgctgttttctagaattctcctctggaatatttcttagatattgaatatggctactaaggtagaggaaaatgagaaactactggaaccccatggctcctaatgtagcaacagggataaaggtatcgtcaacaacaaagaagggattaggaggctttccttcaatacatttgtagttcatttggttaggtgattagattttatccttcaggtatttttctatgaaatatttttagtgtgtgtatttataaacactacagtatctcaataagctgggaaataatgagactgacagttgggcattgagttatgcgtacctataattctatctccctttagatttttaaaaatatcaaatagttttataattaggcatcattcagttttgcagataggactcagaaaatctttagctaaagaagtatgcaagtttttctaagttattttaagaataacataatgcacatttcatctttttcattctagcctttaaatctacaagacagcagccttcccgaaatgtcactactaagaattattcagaggtaagaaaaaaagttttatggttgtgtattaataatttatgttttctgcattatgaattgtcaactctctgatttacaaagtaaataaaagaagaaaaattatggaacattaaagctggaaggagctttaccaattatctctagggcttctaggatttgattttttttttcttggttgctctctttttttaaataatggttattatagaaatccataaatgttatgtatacagtaatgttttcaaggataacagtgttgaaccaaaagagctcatacatggaatactaatattgaaggtgagttcaatggttatagaggttttttctatgctggatttccttttgttacttatcttcccaaaatactagctgtgccttaacagctgttgctagacttaagatgaatgaaaaggctggagtccagcgatccatgtggtttgccctaggtttagcctgggccttctgctcttcctttcgattccaagaagagtccaatatgggcttgattctcttattacttcactttcaaaactgtgtgtcttaactcccgagccaatactcttccctttacatcagggtttctccatagtagcactgttgacattttggactagataattctttgttgtgaagggttgtcctatgcattgtaggatatttaacagcatccttagcctcaggggctgttcgttcagtatttggtctttggcttcatcctcatctgtacttaagttagatgaagatatggcaaatgtatgtatcaaatgtcaagataacaaaatgtagagaaatagtattttgggtggtagaatcaacagtcagaaatatctttattgggtcttaacactaacaaatggtatttaagagggacagatttaacagaaagatatctagtatttcccacatggtctgatacctcatttaaagttggagatggaacactgatggtctcacctctcataagaaactaagaggaaagtcataaggtctgcatatgagcctatgcaagtcattcaccagtgtaactgtgttcccttaggtgctcaggctcctgggatggccaggagagaggtgagcaaaaagtaacatttgtgaatgaagagggacattggagggaggtcagactgagtgttagttttaatggttatggctttctgtctccttttttgtggctcatatataacttaagatttaatcgtgtaattcatttcttcattttcatttttattcagagtctattctcacaaaaactgtttgttgctttgtttccttgccaggtgattgaggtagatgaatcagatgtggaagaagacatttttcctaccacttcaaagacagatcaaaggtaggtgcagtgattttctgcaaaagaaacatctgaaaaaaattaaaaattatccagaattccaaagttacacatttttctatgccatgtaagtttaacagacttattttcaactagtaaagtatgtagaggaatgaaaacagaccaagggctagtttatagagttgatgcagcattagtacaaggattttcagtgaaaattgaaatagcctgtaatttttttccttttgactttattagtgcttttctttctttttatttatttatttattttttgagacagtgcctcattctgtcgcctagactggagtgcagtagtgcgatcttggctcactgcaacctccactttctgggctcaagcaattctcccacctcagcctcctgaatagttgggattacagacgtgcaccaccacacgtggctaattttttgtatttttggtagacacagggttttgccatgttgcccaagctggtcttgaactcctgagctcaggcgatccacccacctcgacctcccaaagtgcctggattacagatgtgagccagtgcgcttggcctcagtgcttttcttaatggaagactgtgttctctccaaataacagaaaataattttgtattttgctatcatttgatttcagctttttgtcattgtcttatttttatattcttaactacacatggtactgtactaaacacttaaaaggggatcacgtagactcagtctgccttcagaggacttgcatgctcttcctgtgtgttttgggattttttgcctattgctgttaagcttgacttgattcactattaccatttgcttttatacgttaacattttggttgaatactgcttaactaaagctcgaataatgagaatttctacttaataaagtaatcaactgccttattttgtacttattttctgtttgagcattatattaggtctgatgagggaggggcataacgaatgttttaatatggcctctgccttcaggtaacttcaattatagtggaaaagagaaatgaacatatttgaattcatcaaagaatgaattagtacataattaggtgtagaattttatattacagacccataagtgtgagtgcttatgggctggtgaaaaaaggaacaaggaatgtgggctagaagaagcagcttcatggagggagtaaaattgacctgaggtttcaaagataagatttggcttagtagggtggaaaatggtggtcccagctgagaataagggcatgagcaggaactccagaaagaagggtgattgaggaaaaagccttatatcagtgtttctcaagctttttttccattatctcagccatttcttgattatccaaggagaagaattaagtaacttagatgtaagtcaatttctccctaacgttagaaattaaatacttaaagaatgaaatttttttgggtatggttgagtctgagagggccaaaaaccgtagctttttcatcccactctatcccctggagccaatttttgttctttatgatactgaccccactgagaatataagctgtatgtgacttaaaggttaatgttagagcaagtgtaagtatagttccacgttcacttattagatccttcaaacatcatgctaggttctggggatagaaagataaatgtttcttccttcaaggaatttacactttagtggtatgctaattacagggcactgctaatccaccaagataaatgttttcttcaggtgtaatgaaacctaagggacgtgccagtatcttcctgggaaaggtcattgaaggttttacaaagaagataggtgacatttgagctggtgatcagccgatcagttagcatgcattaaaggaaatgatctggtgtagagagaagaaacagtggcacaggacgggcatctactttgaaggatggtcatggaaagcctctgaggaagctacatttaagcggaaattttaataagggaaatgtggccttgcaaaaagcagagggacaagtgcatgcagcctgtattagtccattttctcactgctgataaacacatacccgagactgggcaattacaaaacaaagaggtttaatggactcaaatttctacatagctggggaggcctcataatcatggcagaaggtgaaaggcatgtctcacatggcagcagacaaaagaagagaaaaagagccaagtgaaagatcttgtgagacctattcactaccacgagattagtatgggggaactgcccccgtgattcaattatctcccaccaggtccctcccagaatacttaggagttacgagagctacaattcaagatgagatttggtagggacacagccaaaccatatcacagtctattgaagaagcaagtttaataatgttatttaggagccaatgactaatgtgtggtggaaaaggaggttgtttgagatgagaatagaaaagagacacagggtaaatcatgctgcaggaacaggtgagcactacaaaggtattggatgttgttataaatgcagtgggaatccacagaaagattttaagagaggagtggcaccttgtgatttacatttacaaaggatcactgtggttgcagaacaagtgtaaacaagcttatctgaaaggagggtgctgcaggtagtctgagctaagagagacgatggaggcttgcacaggctggtggtaggtgaaatggaggaaacagatggtttcaggatatattttgaagatagacatgacaaaacttgaagatggattaaacatttggagtaagggagaataaggaatcaagactgattttctggtttcttgctggagcatttacattgtgccatatattgagaaggggacaaaagaaaggacagatgtgttgtagggaatgataggcatataattaaaagttccactttagatgtgaaaagtttgagatgcctagaaacttacatgaagggaagttataggcaattgaatgtgtgaattcagaactcagataagggtttttgttttgttttgtttcgttttgttttgttttgttttttgagacggagtctcgctctgtctcccaggctggagtgcagtggcgcgatctcggctcactgcaagctccgcctcctgggttcacgccattctcctgcctcagcctcccgaatagctgggactacaggccctgccaccatgcccggctaattttttgtatttttagtagagatggggtttcaccgtgttagccaggatggtctggatctcctgacctcgtgatccgcccgcctcggcctcccaagtgctgggattacaggcatgagccaccgtgctcgtcccagataaggggtttgaaatggtacttacatttacctctggacagcgtgcagatggtacttaaaaccattgggatggataggatcacctcaaaaaagaaggcagagcagaagagtgtttgttttcctagcctgcagttttaaccttactcagcctttgggtagagtagaaaaaaacaataaagacatgagaaaaatccgggagagtatagagttgcagaaggctgtactggcctttataggagtaaaaaataccaagatgggcgcagatgcaaatcagtttatatgtctatggtaagtagtggagggacttattttagctcacgaaggtttacttgaatttctcaggctcatttatgtgtatttaacaggactcctttggttccagctgatagaaacctaactcagattctcttacagaaaaggagatttattggaagattatcgggatacctcaggttttggaaggaagtaagggcccctttctgagtccttgtttggttgttcttgtctttgtaaattgaagcacacacaaatcagatctagctttctaagtttttttttttccagaaatggatcaaaatgctattctgatatttttgatatatgcttaaggatattaaagaaaaaatagtttgcttttgatatcacagtagattgtttacttttcagctgtataaatgtctgccgatttctttagacatgaaatagtaatataactcacagttgtttggtacttcctatgtgccaggcacttctctgagcattttacatgtgaattagcttgcgtggtgctcacaacttccccaggagatagattatagttataactttatcatccccattttacagatgaagtgtgaagcacagtggctaagtaacttacctaaggtcacccaactagtcatacagtccaggcattctgaccccaaactcatctctgttgttgcttcttggtatggtaactaacttctctgaccattgtgcaagcaataagaatcatttaagttttgagaggctgtttaacattttagaggcaatttccaaaattgacattttggaaacacatcagaaatcagctttggcagattggtgtttctaattacagcatctaaatgataatttagactgtttttgcagaatgttttagtaattgcaggttatgcatggtgttttatttataatttaaactatttaagctctgccacttaccagagtggaccttgataattgtgctaatctgctacctctgaaccttagttgctcttcaagtttgcctgataaatccttctgtcctttcctttagtgcaaaggacctgtgaatttttctatttacttctgacataagatctcgtgattctcattcttttttccagataaaacctttggacatatttcttttgctataatgacatcccaaagcatgttaataaaattgtagactaagaatttataaacactacttttattgaagacgggaatcagcagactttttcttaacaggccagatagggagtattttaggctcggcaggtcaagaggcaaaaccggggatattatgtaggtagacacttgtataaccatttaaaatgtaaccatttcaaaatgtgaaaaccattcttagcttataggccataaaaaaaacaaaacctggtggtgggctagatttgcttactggccccgatctaaagtgacttaaatttcttattaattaaaagacataggaatttactgcaagttaagctttgtaagagtaggaatcggctgggcgtggtggctcacgcctgtaatcctagcatttgggaggccgaggtgggcggatcacgaggtcaagagatagaggagatagagaccatcctggccaacctggtgaaaccccgtctctactaaaaatacaaaaattagctgggcatggtggcatgctgagggggctgatgcaggagaatcgcttgaactgggaggtggaggttgcagtgagccgagatggtgctactgcattccagcctggtgacagagcgagactccatctcaaaaaaaaaaaaaagagtaaaaagagtaggaattatgattttcttattaactgagatttgaatagaaaatatttcaatgttcccatggttttcagaagtggaagatggtaatgtatacattttggtacatgataagtactataataatataagtaagtattgttgtagtacttaatatgtgtcaggcactgttctaagtgtttaagcatattaacacatttagtctttataaaaccattatccccgttttacagatgaggaaattgaagcacagagaggttaagtaacttgctcaaagccacataggtagtaaagggcaaaaccagagttcaaacctcggccccagagtccttttccttacagttaagttttattgccgctaatgtagattttaagggaattgtgtgttatttatattcgtggcagctgctggattgaaaaacttagccagaaaggcacacttgatgaattatgtagttcattgtgtttgtttttgtttttgttttgcctcaggtggtccagcacatcatccagcaaaatcatgtcccagagtcaagtatcgaaaggggttgattttgaatcaagtgaggtaaataagtaatattgttaaattttaattaatttttaactttataaaatttaaatagagactgccagctagttgctgaacttttttttctttgataaataacttcatcttttatgttcagggagtacatgtgcaggtttgttacatgggaattgcgtgatgctgaggtttggtacagatcccatcacccaggtagtgagcagtaggcagttttccaacacacatcctactctcagcctccactctctagtagtccacagtgtctgttgttcccatcttcatgtccatgtgaactcagtgtttagctcccacttgtaagtgaggacatgtggtatttggttttctgttcctgttaatttgcttaggatagtggcctccagctgcaaaggacataattttgttctttttatggctgcatagtgttccatgttacatatgtaccaccattttctttatccaatccgtattgatgggcacttaagttgattccatgtctttgctactgtgagtaagtgctgcagtaaacatgagtgtatgtgtctttttggtagaatgatttcttttcctttggttatatagccagtaatgggattgctgggtcaaatcgtagctctgttttaagttctttgagaaatttccaaatggcttataatggctgaatgaatttacattccaacaatgtataagcattcccttttctgacaacctcactagcatctgttgtcttttgactttttagtaatagccattctgactggtatgaaatggtatcattgtggttttgatttacatttctccgatgattagtgatgataagcactttttgtttgttggctgctttgtgtgtcttcttctttgtaatgtgcctgttcatgtcctttgcccattttctgatgcagttatttgatttttccttactgatttatttacattccttttagagtcttgatattagacctttgttggatacgtattttgtgaatattttctcccattctgtaggctttttgtttactctgttgatagtttcttttctcttttttttttgacatggagtttcgctcttgttgcctgggctggagtgcaatggtgtgacctcagctcactgcaatctccgcctcccgggttcaagcgattctcctgcctcagcctcccgagtagctgggattacaggtgcgcatcaccacgcctagctaattttttgaatctttagtacagacagggtttcaccatgttggccaggctggtctcaaactcctgaccttatgatccacctgcctcggcctcccaaagtgctgggattacaggtgtgagccactgtgcccagcctgatagttttactgtgcagaagctctttagtttaatgaggtcctacttgtccatttgtatttttcttgcagttgcttttggggacttagccaaaaattatttgccaaggccagtgttgagaagggtattttcttggttttcttctaggattattatagtatgaggtcttactattaaatctttaattcatcttgagttaatttttgtatatggtgaaaggtagggatccattttcttctgcacattgctagccggttatcctagcaccatttattgaatagggagtcctttctccattgcttgtttttgtcagcattgtcaaagatcagatggctgtagatgtgcagctttatttctgagttctctgttctgttccattggtctgtgtgtctgtccttgtaccagtaccatattgttttggttactgtagccttataatatagttcaaagttgggtagtgttatacttctggctttgttctttttgcttagggttgctttgtctatttgggttcttctttggttccatgtgaattttagaatagttttcttctaatttctgtgaaaaatgacgttggtagtttgatagggatagcgttgaatctgtaggtagcactgggcagtatggtcattttaatgatactgattcttccagttcctaagcatggaatgtttttgcgtttgtgttatctgtgatttctttcagcagtgtttcatagttctccttgtagagatctttcacctccttggttagctatatagctatgtatttaattttctttgtagctattgtaaatgggattgtgttgttcttgatttgactctcagcttgaacgttattggtgtatagaaatgctactgacttttgtacactttttttttttattctgaaactttgctgaagtcgtttatcagttctaggagccttttggcagggtctttagggttttccaggtacagaatcatatcgtcagcaaagagagagtttgacttcttttcctgtttggatgtcttttctttctttctcttgcctgattgctctggctaggacttccagtactatgttgaataggagtggtgagagtgggcattcttatctttttccagttctcagggagaatggttctagcttttgcttgttcagcatgatgttggttgtggattttcatagctggctcttattattttgaggtatattccttcagtgcctagtctgttgagggtttttatcatgaagggatgttggattttatcaaaagctttctctgtgtctgttgaagtgatcatatcgtttttgtttttaattctgcttttgtggtgagtcacatttatggatttgcatatgttgaatcaaccttgtatcccaagaataaagcatacttgatcatggtatattaactttttgatgtgctgctagatttggtttgctagtttcttgaggatttttacatctgtgttcatcagggatattggactgaagttttctttgttttgttgtgtctctgccagattttggtatcaggctgatgctggcttcgtagaatgagttagggaggagcctcccttgatttttttggaataatttctgtaggattggtaccagttctttgtatgtctgatagaatatggctgtgaatccatgtagtctagggcttttttggttggtcagttttttattactgattaatttcagaatttattattggtctgttcaggttttcactttcttcctggttcaatcttgggaggttgtgtgtttagagggatttatccatttcctctagattttctaatgtgtgtgaatagttattcatagtagtctctaaagatcttttgtatttctgtggggtcaattgtaatgtcatctttgtcatttctgattgtacttagttggatcttctctttttcctttgttaatctagctagcagcctatcaattttgtttattattttaaagaaccaattcttgatttcattgatctttggtatggatttttgcatctcagttttgttcagttcttctctaatttatttcttttcttctgctaatttgggggctggtttgttcttttatttctagttcctccaggtacaatgttaaattgttaatttgatttaaattaacaaattgttaatttgattctcttaatgaaggcatttagttctgtaagctttccttttaacagttttagctgcatccctaagattttgtaagttgtgattctatttttattttcattaatgaaattaatttcattaattaatgaatgaatttttattaatttcaaagaatttttttatttctgccttaatttcattattgacccaggagttatccaggaataaattgtttaagttccatgtatttgtgtagttttgagagatcttcttaatattgatatctctttttattgcactgtagtccaagagtatacttggtatgattttgatttttttgaatttatttagacttactttgactgaacacgtgatctatcttagaatatgttctgtgtgtagatgggaagaatttgtatcctgcagttactggatgaagtattttgtagctttcaattaggtctgattggtcaagtgtcaagtttaagtcctgaatttgttagttttctgcctggatgttctttctaacactgtcagtggggtgttgaagcctcccactattactctgttgctgtctgagtctttttttaggttaagcagaacttgatttatgaatctgggcatgtatatatttggcatagttaggtcttcctgttgaatcaaaccgtttatcattatataatacctttctttgtccctttttactgttggttggtttaaaatcggctatatctgataaaagaattgtgactcctgcccttttttgtttttcatttgcatgttagatctttctccatccctttactttgagcctgtgtgtgtcattacatgtgaaatgggtctcttgatgacagcagtcaggtcttgtccttttatccaacttgccactgtattccttttaagtagtgacatttagacaatttatattcagagttagtattgatatatgagatttcgatcctgccatcgtattgttagctggttgttttgtagacttgattatgtagttgctttatagtgtctctaagctatgtccttaagtgtgtttttgtggtagtaggtggtggttttttgtttccatgtttagcactctattaaggacctcttgtaaggctgatctagttgtaatgaattcctcagcatttgcttgcctgagaaggattttatttctcctttgcttatgaagcttagtttggtgggatatgaaattcttggttagaatttcttttttctttaaggatgcagaaaataggtccccagtctcttctggcttgtaaggtttctgccgagatgtccgctggtagcctgatggggttccctttgtaagtgacctgacccttctgtctagctgcctttaagatcttttctttcatgttgaccttggtgaatctcatgactgtgccttggggatggtcatcttatataatgtctgataggaattctctgtatttcttaatttgcatgtcaacctttctagcacgattggagaaatttttctggactgtatcctcgaatatgttttccatattgcttattctctcttctctctcaggaatgccaatgagtcataggttttgcctctttacataatctcatatttctcagaggttttttttttccattcttcttcattctttttcctttatttttctctgaccaagtagatttgaagaactggttttgaagctctgagattctttcctcagtttggtctgttatgttgttaatactttcagttgtattatgaaatccttgtagtgaaattttcaattccagaagttcagtatggttctttcttaaaatggctattttacctttgtaaaattgttttactggattcattggattgggttttaactttctcctgaatcttgatgagcttccctgccatccagattctaaattgtatgtctgtctttcagtaacttcaatctggttaagaactattgttggtgagctagcaggctcatttggaggtaaggggacattctggctttttgaattgccagaattcttgcactgattctttctcatgttagagggctattgttcctttaactgcagtgtaagtcgagtatagtcaactggccttgtttctgggtgctttcagagggccacagctctatatagatctttactgtgcctagattcttgccctgggtgtcacagagatgtatattggcagaattattttggtgttgtaattttggctgtgatccagtagctggcatttaacattagtgtccagtggataggctcttactcagctgcatagttcttttgtatttctgtgtgttcacagccgtgctctgtggtggggttggggagagagatgaccactcataagggccactcctggaccatgggtgaggtccctcctatcactggcactgtacctgcattactgttgtttggtgtcttgggttgcagggctcccttagacagaggccatggctgccagacaggccacacccttcccagaccagcactgtggaggaaggcatgtcccattcctgcactggcccacgaacccacgtgtctcactcctttcagtgttctgaaagtgggatttctcccctacttgagtgccagccccagctcttagctcgacagccccagctgtgtgctgtagccctgtagcactgggaccagcctgtggctccatcgtctggaccctcagggtcaggcaccagctgtgctggggaatctgaaatgctcccaggctgccaggaaggtactcaggtggaaccaccagcaaaaaacaaggctaggcagcagaggctgccctgtgcacacattcctgcagggcagcttggcaggggccctggaaggggctgtaggggaggagggcctgcagaacagatgttcctctgtcccacagggaagctggccccaggctggcctgccccagcattcaggtggggctagtcctactccaggggaaataagaagtcttaggggatgggcgcctatggccaccttctgctgcagctgccttagatatgaaaacccctgggctccatgtattctggagctctgtctctgcctactgtttgggccaatccccctgccagttgaaacgtctccagggggcatggaatcttgtagctaggatctctgaggtccatagtgagagtgtgctgccccatcatccattcactcacccctttctaggagcctttcaaggccaagaaccagccctggcattgggcaacccccacaaggttaccagcttcctccctcttcagcttccagtttgtatcacctctctatcagctcttggtgctttttctccaaagatctgctcaaaatatgttggcttactcgatattttggtctttattagtggcagtggtgcttcttggccctgtctagttggccatcttgtccttcttccactaaaaattatttttaaaaatagtttcaggctgggcgcggtagctcatgcctgtaatcccagcactttggaaggctgaggcaggcggatcacctgaggtcgggagttcatgaccagcctgaccaacatggagaaaccccgtctctactgaaaatacaaaattagccggacatggtggcacatgcctgtaatcccacctactcaggaggctgaggcaggagaatcgcttgaacctgggaagtggaggttgcagtgagccaagattgcaccattgcactccagcctgggcaacacgagcgaaactccatctcaaaaaaaaaaaatagtttcattgataaccttcctttgaactatagttaatgttaagagttaacaagtaacatatgttgagtgcccatcagtgtaatacctcagatataaaagtcctgtagatttttaaaatatgatattcactcagttcttatttgcccagttaacagtgggatcggaattttttttagcttctaccatttacttatatttggagaaatgatgatgatgatgatgatatcccaagagcttttaatattactttaatgaatatttattaagtactcactatatgctctacatgtgtcatgtagagggtggcgcatggtggtgatttcatgacatacaggtattcaggcattgtccgaaatgttctctgggaggatgtctggaaaaaactccagttccagatcgcgtctgcaaccatgaaatctccccaccatgaatgaggaggaggaggaagaggaagagttataagtcaggacttacctcttgcctttattaatttgctgtttcaattaagtttaaataaaactacatgactgaaggatactgcccttcccctttccttcaaggctgccatttgaagggcctttgctagtttttgttgatttgcttgaaagtgtttctcttaggcccatgacccctttcatttatttttttatttaaaaaattgttaattgtagcaaaagcataacataaaactaaccattattaagtgtacagttcagtagtgttaaatagatccatattaaacagatcttcagcactttttcattttgcaaaactgaaaatctatatccctgaaataacaagtctctgtttccccttcttcatcccctggtaactaccattccactttctctttctatgaattcaactactctaggtacttcatagaagtagaatcatatagtatttgcctttttgtgactggcttatttcacatagcgtaagtacctgaaggtttatctacgttgtagcctgtgacttacacctttcatttttagctttggctgctgctgccatgttccctgtatttaagctgtggtttaaaacagcttgagaggactcaactcaggctgccaagaaaaatggcagcaagagctcattctacctattaaatactaacatgttgcttccaggagggaagtgagcaattattgtttattccaaaacatctggatatatatgcggttatatgttacagttaaaaatttgtatactagttcatgttaactgcaaagacaaactattagcaaattatctattagacttcatttggatttgtctctggtttatttaagttttgtctttgatagcagcagaaaatgaatcaataaatgaaaatgaatttatatttcttaaggcatccattactcatcagagatagttaatttagctaacatttggaagtgctgataccaccaacaaagcctagcatcaaataatttcttttaatttcttttaatgtcttaaacacaaataaaaaacttataaacaaatttgctttattttctgaatatttatagaatacgtaagaattggttttatcttcataaaattatataattgggcttatctgaggtttgttttcattctctttaattaaattattagttaatatctgatattcctatttattcttaccatgcatacaatctatagcccaatagcatgggaactcttttttttttttgagatggagtctctcgctctgtcgccgaggctggagtgcagtggcacgatctcagctcactgtaagctctgcctcccagtttcacgccattctcctgcctcagcctcccgagtagctgggactacaggcgcccgccaccacacccggccaattttttgtatttctagtagagacggggtttcaccgtgctagccaggatggtctcgatctcctgacctcgtgatccacccgcctcggccttccaaagtgctgggattacaggcgtgagccaccgcgcccggccagcatgggaactcttgaaataactgcatgtatttctttttttatccaaaaaactatttgaaagcttgctttgctaggttgttttttgcataagtgtgagagtagctagctatttctagtattaaatggtaatgggaaataaaattacagctgtttctgagttggatctccatgtggcttcattattttttcgctgtgaatttccagaagagtagatacaactgtaataaaatgtaaatgagaaaatatattcaaaaaccaaatataaaatgacttgaattatttttctggcttacctatacttcatttatctttattaaggttagtaagggaaatgtgtgtggtttatattgtagatacatgcacacacagcaggataaattttcattttaatgctcattaagaatttaattgtacttaatatattttgcagttataaaggaaatagaaaaataaagtctatcccatgtgaaatgactctcactggtattgttttgcccataagaacttctgtcttgtttcagtgaagcagggaacaatcactaatacaacatttgtatctcatttcaggatgatgatgatgatccttttatgaacactagttctttaagaagaaatagaagataatatatttaatggcactgagaaacatgcaagatacaggaaaaatgaaaatgttacaagctaagagtttacagtttaagattttaagtattgtttcctgagcataactccataagtaagaaatttctagttcacagacatacaatagcattgattcaccttgtttttttaacctggttgttgtagtaagagctttgtttcaatatcactcttgagtaaagattaaaataaagctaccattttacatttctatttcataatgaaaaactatgtcagtattttaatatggttacatttagccaaagttgagggaaagagcttataaaatttaacttcttcataattttagtaatttcctagaggttctgggttttctgaaagtaaaacaatttatgcgaacctatgtctaaattcactgtttgttactatgtatgtttttttccaatgcttcttataagactaaatgattagaagtacctaatagtttgaacagatatgtttttatttaaaagagtagaataacctttcagaattactgagttttttattccagttgtagcaaagatttcaaaagattgtgttcccattaagtggtagtaatttcctttattattctgtatccttaatggtgttctctctctctctctctctctctctctctccctctcccccccgttccccactcttcctttctcctttgctttttcttctctttcatacatatatgcgtgcctagttctaggaggaaacgggttaaaaattgttttaaactacatcttgaaaatattgaagaatttgttttaggtagagtggtcagttgaaccttacagtaaagtatagaaatatatttaatgtggaatgtcaatgccaggatttctcattaacaatattttatctcaactttggttcctgtgatacatttctgaatgggcaattccagaaatcttagtagcccatgttaagcttctattttttacttgttttcggggagaaataagaattagacatcttcagatttaagttaaataatcccattctttataatcctctgtaaaaagatccctgagattattccttcttctagttttatgcgacagctttactttaaaattcaagttatacatcttgggagtacaatggcccgacatttcttcataggtagaaacaaatacttgactcagtgatactcatgaccattagaatagtcatacctggaatgtgtcaaattataagagacagacacttggttagtggctgcctcatatagcacttttgaagaggcctaagtcaaaacttgcaatataacattctattgactttcttaaaaatattttttctgtacctaacttgagcataagggttatttgagcaagtaacattaactcagtggaaggcattgtcctgtgaaatattcttaggcagatctgcccacatctttattgaacttgaaatctaatatttctagtatttgaacaaagcagaaggttaagtcagggaagagcagtgctgtccatgatgtaatggaagctaccaggggaggcagtgtctggatgatgctgtgctacctacccctgcacaagccatgctggctcagtctgagctgtgggccacatcagctagtggctcttctcatgcatcagttaggtgggtctgggtgagagttatagtgagggaatggtcactaaagtatcctgacaagttcctaggaaaaaaggaataaagtttttttccttaaaaaaaaaaaaattgctcttggctgtgaaaagaggtactaaatgcgattcagttcaccgctaaggaaagtgatgacatagcagttacagagggtgataaatctctccagctaattcaggtcattttgtgaatactatgtatcaagccctgaaaatatggtaaataaaacgtgacagggaaacctttttttgattgaatattgttacatagttaaatgtgctatatatccttaatattttatattgatcctgcaaaatctgttggttttaggggagttttgttttttgtttctaacaattttcagacctgttggtataggaatgtagaagtctttcagatgatttgaaagcagctgcatttgctcttggaggctttgggagagcaggaatgaaaacattcagaggaagacatctgtagggaattcttctgttacttaccaaagaataagtgtctttctggtgttttatttcctatcataaaaatacaacagtgcatttacaaggttaaag

SEQ ID NO: 12510 - DNA, 94987 bp, Human
ggctgctacagactgaggaaggggtctttgctttgatgaagaaattgccaaaactcatgtctcattagtgtttcctaaggttctttggaagtgaacaacagtttaattaagggctgacgtaaacacgtttctgcacactttccctgcagcattttatcacattagaattgatcaaaattgttgccttgggctgacttgaacagatatacatctggagcgcaatttgtgcaagctgccgatgagtcgagtacatacgctgtgtttcacagcgactctcttcctttgtagatgaaattaccttgttgggagatgagttgatctaactctttatttgcttaagtccttatctctttgaagtgatgacgtgaaataaataacacatcaaggcctaggatgtatatatgttacagtgccaaaaatatatatagtatggtcaggaaaaatcgtgtgataatttgattttgcaaaatacttatttaaagggatgcttaagaataaatgaaccaactttatcagtagcctacttgaacttttttcttacatggtgatcttttattccatattcaactacacgatgagtttctaaagtcatagctaattttccagttataaatgtaaacatgggtgtacacattgaagaataacaccatcaatgtgaatctttttaaaaaaattattctctctaatctgtcattaagaagaattctttctgcaatccagtattattatgattgcaactatttaatgcatttctgtctttaatttctgccctctctactaaaccatgagcatcaccaagacagggaccacgtggttttgtttggcatcttgatgcatagccatagttcctcacacttactagaatctcagtgattgattttcttttctctttgctttacagtcagctacttctcatctggtgatatttattcatggaacatgaattttaagatatactggctatggttatttttctcatcctgcactactagtcatcacttcataatacagtttctttcacatgccagagattctaaaataagctgcctagacacggtgcctgctttacctcttctttctttcatttctacttttttttttcattctcttcccaagtagcatattcttccagcctctacatctttttgtgtttttggtaaaagcatgttccttaggaggtaagccattagtcacctttttaaaaaaagcatacgcagtggatacaagtaaataacaatgaaaaattcatcaagcaatataagatacaaacaaaagatcattaatgaaatctagatctcagggatttccaagagagattacttaaggagaaaacaagtttgttcagtggataaaacattgttctatgcgtggaataaggagagtggaaatgcctcattttctagttcaagggaatgtcatagatcagggatggcacagagttaaaaacatatttctcctgctcctaatggaagccataagaaaattagcttcactgaagtttaaacaaaatggaataacaaagaaaaagagctatttaaaaatgtgatactgtggtagatcttgcaatgagaaagatactgtttgaaggatacgatgccagctgctggtttttataaagtgccatggagaggaaggcctggaggagactaggaagaaaatttttggttcagccaggtacaagtgaaaagggcggtgagaacagaaaaaaaaagtcaaatttttggaaagttttttcttctaaaatcaattcatttataaattattactttctaaatcaaatttaaattgttctgtctgattttaagccatcactggcctctacttgtttctcttcaactaccagcaactcctgcctccctcccaccagtagaaacatcagctaatcctttgcctatcattttgcatctcttttcagcttctttattttatgtattattcaacttatgcattattatgtatgcattattcaagttattatatatttatgcattattcaactttattattattcaacttattttcaacttaatctttttatgtagtattcttcctgcttgagggacagtagattgtgtaaagcgtggtatttgtttttcttcacagaaaggtcactttaaagtatcttttctatatattcattcttcaaacttttttttgtagcatatgagcacattacacatagaaacaatatcatttttcaccttggcatgaagccttttagactgtagacattcaaaataaattaaaattaaaataacactagtttggttcatgattaaaatgtaatagctagaaactctatctttactttttccccagataattgatcttttatttccccttctagtctagagagggtgttttttttttgtttttttgtcttttttttttttttgagcggggattcacttttgtatcttcctaagttcttagcatagtgccttctgcatgctgtgtagcagtgtatttttattaatgggccaagaattaatttcatttaatgagaaaacaaaggcaattaaacctatattctgatactaccgttcttcacctgtctctaaagcaaatcctttcagtttggtcagtgaaccttcccattcttatgtttactattataagttacttttgttgtttaaggaaagagtttgtggttccttttgcaacttgaacagcaaattgtattctgtttcttctgtgttggtctgtataatcctctatgaacgtaccgttattattaggtgcatgcccaaaaaagaattgaaaaaataaatggacccataataattactcagtaaaagcaagtgtgtcattttggctaagaaaatacaaatgctttgcttcttaaaatttatataatttacattaaaaattacataatcatcttcaacttctatataaacacccttgatttatgtgccctttacaaaaggagacccatgaatttgcctgagtttaatgaaaagtctgatatagttacagtagttgcagttgccttaattgatcctcttctccagaaatgacatacccagaacgacactgttctgtttctcaagctgtggtcacattaatttttttttttttttttttgagacagagttttgttcttgtcgcggctggagtgcaatgacactatcttggctcactacaacccctgcctccaaggttcaagcgattctcctgcctcagcctcccaagtagctaggattataggtgcccaccaccacgcccagctaatttttgtatttttagtacagacggggtttcaccatgttggccaggctggtctcgaactcctcacctcaggcgatccacccgcctcagcctcccaaagtgttgggattacaggcgtgagccactgcacccggcctaaattattttaaaatgaggtataattatgctttattatttattctatggaatttttagaaactgatttacccagttacattttacttgaaatttatatttaaacataggtaaagcagaagagtatcaataaaaagttcccagtttctttttcaaacagttaattttaaattaaaaatttggaatggcaagtgattgcatcatctataacaagaaagacagaatagaggttctttccacctcttaataatctgtatgtctatgattttacatccattagttagaggcctatatttgtagtattaccttttgaaatcacatagctcttatgcgacattaagtattatttttggcatcttgaagatagcaaaatgagctttgtctattttttaaaccatggtttaaattttttttctttttttatagtggcattaattgctgtggttttatgaacaatttatttctggtttttttttttttttttgaaaaagatatacagaaatggttctctgactcatcaaagttctgatagattcacaacagccagttagtcacaaattgtagcttacagctacaaatccgcctggcattttttgtagactgtgatgtctactgcctttacagtagcatattcatcctttaaatgccaccatgctgaaaatgcatatttaattttatgaatgcctttaccagagcttaggtaatttttcaaatggtaaaatgtaatgataattagtttctcatattaatagcaccataaggtctttttctaatttcaagaaaactcaaaaatgcaaattgtgtacattttgtatgtgtgataaagttttggtgtttttttcttttaataaagatttattttcttttagagatacatgctgaactacttagaagcaaagttatatgatatctgggatttgcttcaaagtaccacagggagagaaagtgtagatggggataaagatgaaataagatttgttatgagttgatcattgccgaagttgggttatcggtacgtgaggattcattacaattctgtctacttgtgaatacagttaacatttttcataataaaatacaaattttatagctcatcatttttataacattttactatgagttgataaacttccattaaagtcaacagcactcaagatgttaaaaccaaggcatatctctcaactccctgcttattccaacaaactgcatggtatagtctcttagtcaactaagatgatgacagtctacattgcttaataatttaattgggtgaaccctgttaaaatatttattgcattagttctatcatgattcttatttcaagctctcatgatctatcttttggcagtattaaatatttatgaaatgaatgagtgaatgaagcccgaaatctctgaattcttttcctatcacagcacctttgcaattccttcttacttgtccacatcgcctcactagattttaagctttaaaggagccgaaagtgagtccagttcaccagtgtgtcccaggctagtgcagcatgtggcatacattcggtcttgaacaagtatttatggaatgaatgtattgatgaatctgtcttctgaagtggtcttcatgatttctgtctctgttttggccagtccgccctccatttagtttctgggggaattgttttaaactgtcattgtgatcatgttttgcccatctatggcgtttctcctatgagggtaagcattcagacgtttgtacaggaagctggagacccgtcatcctgtgggacctgcaagaggcttgctcctcttcttcatctttcaccactccacacactgtttacttgtgtattctgtgccatctttttttctgagtatttcctctctgagaatgtcatcctcattcacattttgaaaatggcaccaatgagaaatgccttcctcatcctggggagactgagacgatatctgtcctgtacatcgcagctggcgatgtagcagcaaatgccaaaacttccctgctctcaacacacattgtacctctcaaccattcacaaccattttcttctaatcattttcctcctcaccaacagtgagcatccctagagcaggaattacttttaatttctttgacatcttcattttacctggccagtacagaaacccagtaaacgtttgcagaaggagtaaattaaggaatgtactttttgctaatcaagtgaatgagttttccataaaagctgtgaaatcagtgatatcgtgaccaacatacctgaaggttgtttttcccatttgcagcagttatcctctgtcgaaagacaatcttctgaatcatataaatctcagaatgaaatactgaggtaaagaaggcctttgtgtgaaccaaggggctaaaggaaacaagactttgggtttttagaagtttaagatttatttagtaatgggaataattctgatgataattttaatgaaggcttctgctagcttccatggagattgaacaaatatttcagagctccaagacagctggatcgttgacactcagaatatattttgtaaaagagccaaagtataagaatactaaaatgttgcaagatgagatctgtcatttgttgacatgaaccttagagcttaagaaagtcatggagctttgggtttttctctgtttctcgcagatatgtcttctccgactactatgaagaagcctgaaaagccattgttcagctctgcatctccacaggattcttccccaagactgagcactttcccccagcaccaccatcccggaatacctggagttgcacacagtggtgaggagtttcaagcatagaggagaagcctccttcttgtctgtagggcctaacccccttagggacggagcaaaagtttataaatagagctatggcaaccatattttctcaacccatatggtgaggggcacaatccgatcaagtattttttcttctcaatttatgagaaaagatttctctgggtgcaggggctcacgcctgtaatcccagcactttgggaggctgaggcgggtggatcacgaggtcaggtgttcaagactagcctgaccaacatggtggaaccccgtctctactaaaaatacaaaaattagcctggcatggtggcatgagcctgtaatcccagctactcaggaggctgaggcaggagaatcgcttgagcctgggaggcaaaggttgcagtaagccgagatcgtgccactgcactccagcctaggcgacagagtgagactccatctcaaaaagaaaaaagaaagattttcaaagtcatacaagtaaataatatttataatatgtgttttaaaattaccttaatcaaaaagattgttatcagaagaatgtggaaaatatgggtacatagctatcttcattatagcttcaggattggtcctgatattttactaagggaaagatggaatttcagttatgttgctgagtttagagtgtttctaaaggcattaagacgtaaggcactatttctgtagatgttattttctacatataaatcaatatttatctatatgagagtaatcagagaataaaaggtactttttttgacacttgttttatatgcccaaatcctttgggctagtacacttgatattgtgtctgatgtcttaatttaagtaggaaaatgaatccaatatttgacatttgtactttaaccaacagctaataccaaatctttcaaaaattaaaaatgagatacagctaataattaacactgtgtactttttacctagagaggagtagactgcattttaggtggaaaaagttttatatataaatatgttaatagtgaaactgttattggtttaaatttatagttaggcacttcctcatccttctgactaatcgaatctggtttttaaatctttatgcaaacaatgtaacatcttttaaaataaagtccttattagctttggtttgtaagtatatgttgatatttgttggtgctatacttaaaaaaatgcatggcctttattgctatcattaaaaaattacgaaattgagagaggactatacaacttaaatgtggtataagaacttttgcatttattacctataccattgagataggtgaaaaaatcagtaactgtttcataggtttgtaatgttgaatatttggacagaattaactgagaagtcaaatcacccatttgttacgacacctgatgaaaatattcttatttctaacgtgaaaaaaagtagacagtatatttttatataacgaaacaggagagacctagatgagccctccaccttggtccttcacccgatatttgttctgtatctgtatattagggtctgtgttaggcatcttgttcagaaagatcgtttctgtccttaaagagttcaggatatagtggggagagagtggggccacgtcattggctgggcatctaatctgaacatgactagataacctgaagaaggtttagatacctggaagatatgtgttctgagctaaagtgtgatggcaaagttcaccacaagaaggaacaacaaactaggaagaagaggggcaacctgggaggcagagggacatactaggaggaagaggggcaatgtgggaggcagaggggcaaactaggaggaagaggggcaacatggaaggcagaggggcaaactgggaggcagaggggcaaactaagaggaagaggggcaaactgggaggcagagaggcaaactaggaagaaaaggggcaaactggcaggcaaaggaggcagaggcaacagcatgtatcagtgcattagaggccattgcagcaggcaactgccatatagccaaggatccacaaatatcttcgtctggccagagatgaagccaaagaagtgatccaggactcggtctcagagtacctgaggttgtgtgtactgaaaaacctgttgggattttattctggaagcagtaggaagccactgaaataattttagcggagaagttacatgattataatggtgtttttaaaaagtaattcacatagcactataaaggatgttttggaaggagcaagactgaaggaaagaagacaataaggctttgcaataatgtatgcaagaaatacacatacatgtgtatgtattctttcataataaaggaaaactttttgtcttgtattttacttttcttatttttttttctttttcttttctttttttttttgagacagggtcttactccaggctggagtgtagtggcgtgatcttggctcgctgcaacctctgcctcccaggttcaagcaattctcctgcctcagcctcccgagtaactgggattacaggcactcaccaccccgctcagctaatttttgtattttttttagtagagatggggtttcaccatgttggccaggctgatctcgaacatctgacctcaagtgatccactccacccaccctgacctcccacagtgctgggattacagccgtgagccaccatgcctggcctgcttttcttatttttaaaggactagaatggcttttatggaaaaggtagtcatttttactctcagtttgaaatacgacattttacccagtggtatcaggccacctacagctcatgcaagcacagtgccaggttgcccatagatgtgagttcgggtttgatttctgcaatttcacttgaaaatagatctcctccagaactattaaggccaaattaatctcaaaagctaaaggacccaagatggaactatgtatatatctttccagggtttgtgtacagatgtgagcaaaaatcatggttaaaatgagctgagattaagagcatttagacactaagtaaaagatgcccagtttttcttagatgtttgtatttccttaaatgatactttcaaatgggtatacttcttaaataaagtaatacttcagtaaagagttttgttttaagaaatacgcatttgttctctgaaatgcatacatttgatggaggatgctcaaacttcagtatgtaggaagattacatggacacttatttaaaatatacattttggtgccttacccctagaggtcctgatcccctaggtctgtgtgtagaccaagggatctgcattgtaagaacaatacagagaatttcagaaacagtgctctggacgttcagagaacaaagtcgtgactataaaattgaatttatgttttttctattctatacattcttaatttcttatatcttctgaaaaagttttttttgggagaggtaagcaatacatcccataaataggtcccacccccccacccacatagtttcaaagttggaaataaatcattctaggtgatttccctttgtaggttatggctaaaatttattttttttcatattctttaagttgtctcataaaacattagacatttatcgtttataatttcctattatttgaattgggaaatattaaaatagaaagacatttacttttcacttctacatatatttgttggtagttttaatttgtatttctatgattatttctctcaacattttagagataatgatcatacgattacactctttctccatctttcaaacttaagatttatatttcaaaaactgaacaataaattataagaatactaatgttgagaagttatagtaaaattgaacattgtccacattgcatgtgttttatatagtatttccctttataaaattattataaaatatgtgatatatgggtaaagtaatatacttacctatatgaaagcttaaattttcattgctgtgtgttttattcttggttttatattaacaatatcttttaaactacatatagtaaaagttaaagtagaaagaaaaatagttgcagaatagagctcttttggttttgaaagaaacattttcattaggagagtttctagctctatgttccaatgttcataagcatttataccatgaccagacaattataaatgacatgagatgatgttgtattagttattgtctttccttctaaacaattgccaggtaggatgtacagggaaacgttttatttgaaattgaatttcacttttgtttttaattttggtagaaaatttttggctcttttgccctctacttaatgctgtgacttgctctggacttatgagacaaagtgttttttgtttgtttgtttgtttgagatggggcttatgagacaaaatgttttttgtttgtttgtttgtttgagatggggttctgtcaccaggttggagcgcaatggcgccatctcggctcactgcaacctccgtctactggattcaagtgattctcctgccttaagctcccaagtagctgggattacaggtgcccatcaccatgctcagctaattttttgtattttcagtagcgatggggtttcaccatgttagccaggctggtctcgaactcctgacctcaggtgatccacctgccccagccgcccaaagtgctgggattacaggtgtgagctactgcacccggcctaaagattttataatcaaagaatatgttttcaacgggatatatctttgctcaaagaagtgttttatcaagtattgacataacctataaaagagaaactgattttgtaaccactcacagagccaggaagcaagattgttaattttctagagtgatgttttatctctgtgtagttagccgtactggtgttgagaataaaaatgaaaaagtaactgttgatttaggagagcttggttaaatcatggggacaaaaatgaatggttaccagttttgtagtttcacagcattcttcaggatcagaatggagcaataaggtaaccagctgacgagtcaatctttccttttctgtcttctgcagtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccaggtaaaaataagagagaaaataagattagcacctaagggagatgggacagatctaattctgagacacaaaggttagtcagacagtgtgtctggcagaacgtcaagccttgaaatccatcttcaggaagttgcttggtgactcaataagtttttatttaaaggtggctgaatgacaggtaggaagtgtgttgccccaaagggtacatttgtgaagatggtttaatgtttttggattttcactgactgaagggaaagtttatgcagaaagtacattgacaggaaagctctgggctggagttcacacctcttaaatacctggtttgacacagagacaatgtgcttatttcaggcaggagtaaggtatgtgctaaaataaacacacacaaaagaacttacagttgtatttatagaccaactattaggtattaaaataagctttggtaatgtaaacattctcagtgtttgatgactacttgaatattctttgcagagacatgacttacatttaataatgagtgacattactagaagcgtctttcttttttttggaaacattgtgcagtggttttggggattcattttgtaagtgtagtgactcatgagcatttctcactcccctagacatatggtttcttctaccaagaggttacttcataggaatttggtatatgagcattttccacaatcaagtagacagtctttgtgccagacctggggctatcaataattgtaatatctaaaacatgtaatgtaattttgatattaggatctgatatttagctttgctgctttacctctaagactcctgtccacttattataccttttaatattttggagaattttcacaaacattccgtcattactacggtggaacattcctgaaatgctagtaaatagtgtgtgtctatcaatttaaattagcaaagaaaggtgagaaaaaaatccctttggtcttaatttgttaaaatgaaacaaaatggtcctttctgaacttttaatttagaataacaacgcatccaggaccctttgggttacttaaaaagttatcattacttttagtttgactgactgagatattaaactcaatattgaattttgaatttgaagttaaaattattatttgtattttagaagaaaatgttaaaatgttgtagcacttttcatgactgaagtactaaagacagctaagtgagagtgggatcttagtatatcgtttagaaataaaatttgttgtcagctcatggattcagaagtctcagttccatagagcattttgctagactcagctgggaacagtgcacacaaggtctgattttaatttgtgtagaatttccatgaataacaaagtctaattaagacatccattaaaagtccttaacgttaattcagtgtggaaaatcttagagttccattggattttttttttaactgatgtcttaattaggcactgttaggggaaaaattatgcaaattaaaatcaggcccttagtgttacacatttctttaattattcagtgcttgttttacgtatatttcaatttctttataagttaagagggcatattaggtgataatctgcctatattgttctcagtttttcttcactttttcaagatacatatcaccttctaaggaagcatattactctcatctcaaaaaaaaaaaaaaaagaaaaagaaaaactagcaacaaaaaaactctcaggattttgtataataggaaccgtgtataaagtagaataatcctttcctaatgctgttagcttcaccttcagacaagacatctctcttttctatctacagtatgaaagttcatctattaacagccttaaaagatagaaatttttagtgtagcttcatctgtttgaaccagtagaaaactgaggagaaaatagccctcaattcttctcaccctgagttttaggaaagttgtctgcattggcttgggaattctttctttgtcacctttattcttttcaaatgagagaagtgtctactagttcatgttgttcaattccagtaggtgaagtttgtagaatggtcagggtaggataatatatttggtggcagcatttccttgaaattattgtcattctgctccagacattttgttccaggtaggtactttcagactgttttggtgaacactgtatgtagaaacatttttaccattgaatgtaccaccaatgataaaatgagacctgtcttctttcttaagatatttaaagcacttatttccagtgttcagataaccagaaatggatggcctgctgtagaaacaaactactttttccctttgaaaggaaaaatgggtctttatagttaactgcagattttttttttaaggaacagtgtatctgctttgatttttaactccaactcaaaaccaattaatttgcatttcaaattagaattcttggtatttaccattttagctttagaaatggaaaaacatcagtattccttcaccattcacttctagtcagctgttgcttcccaatattctccagcactgcactgattttgatttttaagataagcaactgagatgccttttcctccccacagcaattttgagattaattgcattactgctgcaccaattatagtgagacagtcatgctattcaatggaatattttgaataaaattagtttaaagatgtaactctcccataggtttccatattggaaaactctggtcaattttcctgacatcaagttaaatacttaaaattacccatgatgaataatcaggatattcaggaagtccattttctttatagaataaataatgtggcctctgaggagcctaaccgaagacttagttcatgtctctaagtcacaatatttaagtgttattagctgttcatctttttctctaaataaatgtctacttgtaatttatgtgcagatatttagaaaaatattctgcttcattttttttttgcctttaacagttcagattataaagactatatacttgccgagaatagcctcccagcaaattgcgatgaacaccgtgcagtggagaattccaacatgggtataatcaaaaataacattctcagtctagaaaaatatattccactatttcttcaaagagtgtatccttaggattttgtttcctaccacggaaactatttttgtacccaggagctaaaactcagatagtaacatcttttctatcattgcccaggggattttctcagttaattcccacaaatgtcaacaagaaatgttttgtgtaactctccatgcaccaccatggatgtaagagtaactcaaataacaatgctcatttgcttgtcctctgcttcccctcagtacagtttaatttactttggaaatcttttatttgtaggtgtaaggacaaacgtagctcagcattttatatcattgtatgacctctgaaattttagatgctttacatcttattctatcttcttgtattagtaaatcatcaaaagttgaccatagatctcggaatctaaattgcctaatgtgtgcatctcagcacacctgtgtgtaagagagctagagttttgtatgcaggagaatggttcttgactgtaaatgatgaaaattccagaattcgttgtatttgatctcctagatatttttgtgtcctttgtttcagtgatatcatcatgtaggtgaaaattgtgttctaaaagccaaaactgactcattatagaaaatgaagagcagagaataaggaagcattgggttccaactgtagctagttcagtaaggaattccattttagcctttgggctaagcatttaagtctgcacttgagtttcttggcctactacatgaaaggatcaagtctacctggctctcaggggtgctgtaaagaggaattcacctataccatgacgtgctttgaagatgaaaaccttctttgaaatgctgctgctccttattactaccaaccattgactggcctctccgactccgactcgagagggcctgtgtggcgcctatgcgcagtgtgctggatccacacagtcgtgtgtgctgagtggacttgttgaacaagatgactgccttttggattgcttcacccggcattctgtttttgttttgtagcctaacggcagtggtcaagtagtagggaaagtgcctggccatttcactcctgtcttggcaccctctccccatcccagtgcagtgcgacctgtgaccctgagcatgacagatactaaacccatcactacatccactgaaggtgaggcagcttcacctacagcaaccagtaagtatttccataggaaatgagaaatgtccatcagaggcaccattggatatctgatccaaggtggaaaacacggcaatttttccagctacctgaccagatggagatttctcatttaagtggagctagcaggcatggatgtggccctgctatcacaggctctctcttctcaaattccagtcagtgaatcatatttgaaaagggagaagctcacttgtttaagttaacagctataacaaaaataataagtcatgcctgcttgttcaaggtatacattgaaattgcactgagtaacataacgcagaatacaaagttttcgtatcacccaaagagagattaggtaattggtacttattggagcattcctatagaaatcaagccccttcacaaagcagatggaatcagtgcctctgtaaggtaattgcatgtttacatcattgtaggttatgtcattgttaaaaacagtcgcataaggttgggaacagatgaggacatttcaaaacttagtattaggcacatgtaagctacctgtactttcactatctgcaagctttttttttaaaaccttttgattattttgcttatcattggtacatcaaatactgtgctttttagtgtggccataacatttaaatgtcagagatttagccagtgaaccttcctaacacgtaccaataagccgcatcattcctttgttttttcatgtaaaatacttagaagtatagaagaaattaattttgaggtggtttcacccaactgtcagcttcttagtactggagctggaatgtacaaattggtgaagtagaatggataaagctatcgaattggtggaattagcatgcacctcaccaattatacagatatcttcaattcaaaccttttttttttctttcttagagcaagaaaatccccatgatcttgaaatttccatgtgaatcagagacaatcagaggcatgcaccactcattctttctcagccattggaaagatgctcttttttttttatggtttctgaaagactaggaaggaaccctataagaaaaatggacaatactttgtacagtgaattcagcatttctttctcaaaattcatgagccccgtcaattaataagttcctataggcttgtaatacccatcagtaattcttaatgcttagaatacttccctgaatgcacagatggatgcgacctactcaggaaaaactaaaaattattttgttctagaggtttgctatgtgcattacagtcaccaaaacactaagtactcattttaaaagtggatgtcttcacatctttgagcaaacaatgtcagcaatttaaataaaagcacacagaaaacaaagatttttttttaagtagttgaaagattatcacaggataaatggtcaaaaccaagttctagaaactctgatgcctactcttgtggtgttattaatagaagagattcaggagaggatcagacccaaatgatcacagttcacttataggagtaccctcagcctgtttgttaatgaattgtttttatacttacatacaggttgttcaaaaagggatctgatttgactagtaaaattacaaaatattcaaaaggagtatcttggttgtataaagatggctgcatcagtccattttccactcctacataaaagaaacatagtgagtagtttttctttcctataaacaagcttgtagctccagcttcttaggcaccaccagtaataaaaaactggtcattgaattgatatagtactatggtcaaagaaaacacagaagccaaggaaggctctttctcatagttgaaaagaaaaagcagcatagatttggtgctcttctgtaagggtgaggctcatctccggctgtctgtgaggtgtggtgaattccagaggcttggagattgagtaggggtcactggttgctgatggctgccttgcatgtccccttattcaggagcaattaaaatatgaattgtgagcatcttcactgtttttaaaaagttgacctaaaaaagcttccatggatcaaattctgcagtcctttaagtgaacaaggcagaattaatatattggttttagaaagccagttcatttaaaatgaagcctggattcctcattaatctggtggttttaaaccaaacagtgtagctttcttcagaacaataaaggtaatatatggtaatatggagcagtgggattgcctagttctgggaagatacctcagtcctttccttgtgaaaagtaacaaaagtctttaggagtagctccctattcattttttttgtgtgtgtgtgaaaaatttactctataccaaaaagcaaaaagcagttgtacaaaaagtacttgcaaatgagactataacaatgtaaggaatagtcaccatatatacttactacctagtggccaactatttaaaggtgcatcagctttcttcctggatcagttacaagtaattgatttttgtatgtgtgcttatgggaagtactttttttcaaaaacattcctatcagacttgaggccattttcacaggtaaaataccgagctgattcattctacatgatacaggcttctccttcatgatagtaagatttgatttcctttttagcaaaacttttaagaaagacattttccatcccatatcattaagaacatctgcttaaattccatcattaaaagctgtcactttttcctggcggactttcagtctgctttacatttagaatcatataccatcattgattattttatattagacaactactatctggtgaaaaagtacgtctaggaacagggcccttctatttatccaatccttagtacctccacaggacagttactagagcatgtaagtgtgagacacccacactgaagtatgagatctgctttactggatagattttttagggggaataaactagttgatttgaagtcaattattatttcttttctatcacttggtgttcactcagacaaaagagaagagaaatgaagacactttttttttttggttgcaaatcccacttctctgggtttcttatacatggacagggtgttcgttctgatagttcacaatttttatctttgtttttgttcttccttaatcagcctacacagcctcaggcacatctcaagccaatcgatatgtgggactaagcccaagagacccatccttcctacatcagcaacaggtgggcaagtttcacccaggtgtgacggtgtagccacgctttcgcttccgtgcttctccatgttgcctctcagatccggactcagaagggggctcccggggcttctgagaccaaaactgatcatttcatttcccagaattttttctcattgatcctttgtttctcacctctttgagtagagtttctcaaattggctcatgaccttttccatctctgtagcatatattgataacatccatgagtaatagtgtttcagccaaagtgtatttttctcagtctcattggctattgagaacttacagactatagctttcaaagacaaaaactgcaaactgttttaaagccaactagaatagaagcagtatataattcgagtttttgagtgatttcttattttccagatgttttgctcctcacatttgtattttagtccaagacgatgagttacgaagttaaaatctcaggcgacacttcattcctattattttaatagctttaaattggtttactgatttcagatgtgataaaacacttttttttggttctgctttcttacatcatttatgtttctagtagcattttaaatttcacatctcattaatgctgtaaatttaatgcaaatgaagtgtttacccaaactgtgaaaacatacagccaggattaatggtggcttataaacagatcagccacagtcaaaagcatggaccataccaatgtagaaatcccacgattctagttacaggataagagacgtaattctaaacagttccgaatttaaatatattttatgatgcatatgtttgctgctctcaagttttgatagcagagcagtttgaaattaacagtatgcaaaatattacataggggaaaattaggctataataaataataaagagctggtgttaactaactcgctctttatttataagttgcctgtgcatatatatgactttttgtgtaggtagtaagatacttttgcccacttacttcattcttgatctgttcacctcacatacccttgttgtgacctacctcaactgtgcttggtgtggagttctcaagtcctttccagttgcagcccaagggggcagactgcatattagaggtcaccacatgcagagctcagagaaaatcataaagatgatagcttattcagaatacttgatgttttgccaggtttaaaaaaagcaaaacaaaacaaaccaaaagagtgagaactaactgaaaacatctgtacacagttatgaaaataccaaataataataattagtggttttgccagccattggcttctcaacataattctctggaatgttgcttttttttcacctctaaaattgttataacacgaaatgagttataattactagaatatggttctatttgacagatgtatgtgtccattgtgttttttaaaaaacatatgcaggatgtataagtttagaaacttgttcttttaaaaatcattacacatattctcaggaatatttttctcatgggatttgcattattctttatgacacatctctaatttccagttaatttttaatgcataaaacatgcctccattatttaaacctttagccccaaatgctagttagaatactctgaccaattccatgtatttggaggcagccttcctcctccactaccctaacctatggcagctttaattttcttatcccttatgataaatgtcgaagcctcatgtaattatgattactaaagtccattaacataagaattacttctttcacatatctaaaaatatatcaagaaaacttagcaagcatcatgaaaatatgaattttaatgtagatagcattctggcacatgatatattttaaaaactatgagttctagaactataaactattttaaaatcaaagaagacagccacttatttaagtggacaacattgaatcgagaccacttacaatgtgaatacgttttgttcagtcaactatagttaatacttatgggatacatgatatatattaatctttggaagcaaaaaaaagttctttatagctgaaaatgttaaataccatgcagacagataatttgtcctctatgtaatgaaagagttagtgctgctttttaatttgaagaagcccatatatgctttattttataatgaactccagttttgaggcatgcagaaaatacctgtaaataaatgcatatcatgctatagatgtatattagtaaactaaggctagagtcaaaagcctattcattttagcctttcaaattttaaaagaattatagaaatgaagttttatgtttactatccaggaataaagaaacagaaatagtttaaatgacttcagtaaagattattctttccttcagtagaaatgagattgatttactgtgtcctttcattactttacaaagatttaaaagagaccattcttctagaggcagtttctaaatgcatttggtttaaagcactcaatgatgaatgaaaaggaaaatcaaggggtacatgaaataaaggtaatcaatcatgttatattagctaggagaaattcaaaattagaaaggcagtgctttagtctgagagggttcttttaaacattccctatagcctttaatatacatgatcctttaagaataaatatcgtcaccaggtacattcttcagttcatggtggctgctttataaagatttatccttttaggttatgaaaagtactgatgtgtagttttgagtgttgtttttcttagaaaagaactttaatagagcctacataaattagagttaatgataaatttaaagtggtcatgtaattttgactattttataaataatctttccacaagatgatactacagtggagtttccaatctggtcattttctaatacataagcttactagcattatcaaattaagatgaaaagctttctaatgttaaaatgaaccctgtacttcacctgtaagagtaatacattcatagtgtcaaatctgaatactaaaagtatacactttcatatcatttacttggtacacagacaattgttattagtaattatacatctttgtgttcctttttataataattattgctgatggcattggttgctaactgcttgggaatactagtttattctgactggaagaaagttcacctatcactgaaaatatatctcatttgaatctaaaaaataaattcacatagtcctggagactatttcaaaaaggttcatgtaaaccagttgataatctgccattaaaaataatcctctctaatcagtcacaatagtcagcacataccagctgatcagtatttgactttagactttttctttatctcttaacacaatcttgaatacttttcaagtctagaactagtctgtctttgggattattggtttagttattgcattcgctattggcatgggggaaatcttaaaatcagaacttcagttggagcttcattcttctttaacttttctattggaagatggttttggtggcttgaagaactcatgggtcctgctttggcaaactgaactgattagtctctgctgagaagtgtctttttatggtttggaacattttcagaaatgtggaacacccccccgccccgacttaacttcatagaagttcagtaaaatgcagtatatccttttctctctcatactttataattcacgaacacattgtgcaaattcgttatgataggcaatgaaggaaccacgtttcccaaattttatctccctgagaaaatgggaactatcaatcagagtgttggatgttgcttaggaaatatagaaattattttataattcagtctaacaattttagcatggatgaataataagagacaacttacttgaattagcaccagtttcttatctggtctacctcatagtgagttgctaatttcaggcctctttcctttgctatcatagaaagtttggtagtattaatacaagagaatctggctaatttgattatcaccattacatttgagtctaaggtcataataagagcctaaattcttactattgtacatcaacatatatttaaaaatctcattgtaagttggaaataaaaagtttgcagctaagaagcttcttgtttagaaataaaagttcaccattcaaacaagccattgaagtacatattaacctttgatgtatatttgagatttcaactgaataaattaggagctcacttttgccttccctaagtgagacaataaagtcaagtaaagtctagtttataagaaatcggtcttattttcataatctcaaaattataatctcctgactatatatatattacctataataagagctaatgaatcagtggcctgatcaattcaggtctttgcattacttctcacagttgcatggattttattggtgcttgggcttcagcatgttacatctcttgcatgactatataatgctattatttgaatttcaattactggtctagtgtatatttaaattgtttcaacacttttcttataacacttttgtttttaaaactagaatttgaaagtacttctcattacactgaaaatttctgttacacaaaatggcctttttaagaaattacttctgtaggatttttttaaactaagatattagtttaaatcttcttataatatttgtcctggcaaatggcaaagccaaagcttggtactaccattggaaaggtagtcatttattagaggcaagcaattaaaaggacacaagtggactatgaacaaacttttcaatacagtcaggaagcaggctatcaacacttgggctgttcttattgtgtctgttatcataattgacagcttgacgtaaaacgctatcacatgacttctgggtaggtatgtaagtggataagaggtcacttttcatgtatgctggcttgaaaggaaacacatttaaaggaagtttcagtcgaaataatggctatgcaaatgtttagctctttggctagttcttaaattcaaaaaatccttccattgtctgtcttttgtcattccctggtttgttcacttacctttactgggaatcaaagactaatatccagataagctgttctaattaatgtaaaagtaaaattacattttatgtaacgttaactttaatcaacagaaacacaaggaaaaaattatcttcttttctgaaaatattaacttagatctcagttgaatcagggaggtagagggaattctgaaggttttatttacagatattttagcattaaatattcttgaactgcacataagggacagggtaggaaaggaacaatgacaggcaactggtgtagtgggtgagaaccagggattaggagtcagaaggtttgggttttagtgttgatgtgacagggcatttctaaccttggacaagtccttaaaccttggaaaggaaaatgaagaggttgaactacataagctccaaagtcccttgaaaccttaaaatttacaagttgtagtagcctctaatttaaaaacaaaatctttcattttctaatacttatcttatgatttatggttaataatgtttattctgctcatggactatgcatactcatttaagttaattctacttctgctaattaaattaaatatcaagaaacatgggtttcagaaattggcactagaagtgacttttaagatatgaggatgatcttgagtatcttttttttttgtttgtttgtttttttttgcatgtgttgtatgtgaaacatacaacacaattttattctgaccatttttcttgttcataccattccttcagaggttacatgctattcatccagagaccatttaatttgctccatgtaggtaattaatattagcaataaaataaaattctcctaatccaaagtatgaatattggagtgttaatccttttaagcatctgttttccaccgcaaaaagaaccttcaccccttaaaaatctgtttcattgagggtctggagaaatgaagaaacacaagaaaacataaaacatacctttcaagatgttctcctgagggccattgtaaacgtaaaaagaaaaaaaagtgagaaggtaaatttgcctgtgttgattgttctgttcacagtttaatggtttattggttcagttgagatttgttgtcatcgtaggaactgttagtacctcagcctgtttgctgagtctagcaaaatagaacattttgcttaccttctttcttttgttcccaaagctaattgctgtgtatttaacaaaagaccctgttaataacaaaggaggacccccatttgaataaacaaactattagtctgaagtcacaagcaatattaattctttatggctatctgctacttacatgattatttgagtgtagtttaggaaaggataatgatccaaatcttaggtgtttcccctttatgtagccatttgagaggaaccagatggcccctatcctttttctttttttctttgaagcaatctgatttgaactgggccaggaacaaggttctctttccagagaccacagaactccaccctaagaacatatgcagtgaaaacttcaccttcacatctttcttatttgtttaaactgttccaaccttccccctttactgatagcttttttggaagataatcttactttcttagttcaccttttatttggttttgaaattctgggcattttctagacaatagaatttcatattggtatgtgcatataaattaaaggattaaaatgatttatatgagtgtgcatttttgtaaggatatgcatatgatcagttctttttgagagtctatattgttacaaaaataagaattgttccccacctccacatgaaaacagacaattctaacagactgaatttctaaactgagtggcacttggtattttaaatttgattactattgggagaaaaaagcaatttcctatttcttaataaaaaatacttggaaaaattcttacagcattcttaaagctttgaacttagaaaaattctatataaatgaaaggcatgtatttatgtgccacttaaaattaaagttttaaaataaaaaaagagaatttacagctgaattacctaacactgattctgtcacaggacagaaactaaggaatcaccaccccaaactcaaaaaagattatcacctattatgttaaacttatttaaagcctaatgtaaaattattttttattaggaaaactgaattatgctaaaggcaagaatatgtaacatgaccccaaaagaagcttaaatacatgtagtattaaccttttaatatatagagtctgttcacaatttgcttggtcaggaatatcttggtcaaataagattagaaattgattttcttaggaattactatcatggaaatctttggtgaataagtgatttctattttaatgatttaattgcatcccccacccataccatcactttaaaatttcactttatcagggagttttgttagttccaagatgctttatgaccaagaaggtttattaattgaaaaaaaccaacatgaagagagaggctcttgctcaagtaacctggcttaagttatagcgtgtctcctcagaaagttcaagaaatgttgtaatggtagtgcacaatctaaacagataaattagtttcttatattttacatttttagtaactaaaaggaaattcaatgctaattaatatattgccaatttatttggcattaaattattgctaaatatatttgttgtttattttgaatgtacttaagcatatttttctgtttgggagaaaatatttctattgcatatatcttaaatagatgataatgaatagctgtagtcaggtttatccactttgggactacttttagaaaagaaaagtccaaaaatacgttcatttttatgtgtgcagcatatggtcaaagatagcccatttgacatttttgggggtcgtaaaacaaacaaacagacaaaatattagcaacattaacaacaaaaaaactaactcatttacaacacatccttctgaggagatgtggtcctacagttgtctgtgggacaataagcaatcagtgagtggtatttagattcccctggctttgtgaaagcatattatttttctgaaaacttctccaacctaagctgagagccccatagatactaatctgaagttaataattaacataattaatatgtactatgcctaaatatacatctcccctcttccaaatgtttgattcaaaactagcattttcaccagcctgggcaacatagcaagatcttatcgctacaatttttttttttttttaattagccaggcatggtggcacgaacctgtaattccagctactcaggagagtgaggtgggaggatcacttgatttctggaggttgaggctgcagtgaaccatgatcgtaccagtgaactccagcatgggccacagagggaaagcctgtctcaaaaaacaaacaaataaaaattaaacaaaacccttccattttcattgactagagtagaatcagtaagtgataaatcattaacattcttgttatacaaagccaagtttcttgaactgttttttgattgttttcattgtacttttaaaacttttacagtaaaaaaaactgtaaaaaaaaaacagaagacaatttgccccatcacactaaatttgattagacgacccattttgagaacttttaagaaatcttgccatattgcttcccgctagactgaacacatttacttctttgaaatattgaaagtatgtcatctgatttaaaacaaagcaaagtgtacttttttttccttcatgtgagtattttggtccattttaagagtatttatgaccaggcacccgtggctcacacctgtaatcccagcactttaggaggctgaggtgggcggatcactcaaggtcaggagttcgagaccagcctggccaacatggcaaaaccccatctctactaacaaaaattaactaggcatggtggcacactcctgtaatcccagctacttgggaagctgaggcaggagaattgcttgaacttgggaggtgaaggttgcagtgaactgagatggtgccactacattccagcctgggtgatgaagtgagactgtctcaaaaaaaaaaaaagaatatttatttttctttctaatttatttactgatttatgacttctttatgacatatatcctgagcagaatctacatgtctatcaatctgttgatctatctatgtatatgcagggaatttttttcagttctttaaatcataaaatcacttttacttgaaatcctgaaatatgcaaataactaaaacacgtggtttggaaattttagctagtatttttagagcctcatagatcgatagaaaaatgagcaaaaactatctttctaaaactcctgaatcactattacttagtgtgtgcagaagctcgagagtctaaaagggaaagtaaagattcttaatagcctatttctttggccacaacattatcagaaatgtttaaaatagtttatcataaattttaagtttatgataatttatggtactttggttccagtcatcatctggaaattctcactgaaaagcagcaaacaaggtttagtggattactgtgaagaagtcatcttttcaatgtaagatgctgttaatttacagtgtggccatctgaaggttaaaaacgatgattttctactgtgtttccccccccccaacccagataagtttactttcttaagaataaaaataagcaatatatcttttcaataaatctgctagcactgtagggcagctgttaaccaagcagagctggatagggttactcgaacaatctctgaagggcagagctgatgattcggagatctgggaagaatttgtttcagcttgtattcagtgcattcctcactttcttcagatgtagtaaagtattttaaatgccattactctgagtttaaaataaaactagaaatgcttatcaactctttctaaacaatgccagtttaagcaaaacaaaattagtaaaaggttaaaactgaagaccttgatgcttctaaacacaagttagggcgaatgtttgtaaggtgggccttttctcctctaaactgcatgtcttctatgttttgcaaactgcatgcttaaagttattgattattttattcagtgcagattatttggtgtgatgcatagaaaaaaagcatttttattttctttctaaaatatatctctctattgaacattaacgtttgctttcattccagctcaatttgtactctaataatggctaattgttatgttctaagcacttgtttctcttgtatgctttaattaatagagaagcatattgcaatagctttttctaaaaaagagtctaggaattttgcttttcaagaataagatttttttttgctttttttttttctttaagttgcctcttgggaaagtaaggttaatgccatgtacagtactagtttgcatgtgttcatttaaatactaaaaactgtagtactgctcgatccatatctgactgctaggtttcaattgacagctgaggatttgtgactggaccatgaatcaaaacggcaggcatttataccccagtaccagtgaggatacattgggaattacttggcaaaggtaacattttaattatttccaaccctacacttacacctaaaaattacatgagctatagtgtttgtttttaactagctttacagaaaatatatgttaaaaatttagttgttttggctatgccattcttctttccctgtcctcctcctttatttcttatgtaaatggaacgtcaaattaagttgggactatagtatatgcttactgatcattggaatttttaaatgctataaaatgttttctacaatttatactgtttttggtgggggagggggtggaatgtgacatttagattttaggacctgaaaagtgaaatcacagctttagtgaagatttttcagctacctgaggataaagcattggttttcacattgtaggtttttcttattttaactctttcctctactgctaattctaagccatttcactgttcatttttttcccctgttgtagggaaaaaaaatagcaaaaaattttggttagtcaatttaactgttattgacagcacccataaattttggagtaggaagattgttggaatcagtaactaaagaaggaatttgttaaagttttaatttctgtttgtatactgatgtgattcatggaagattgaccttatttggttggctgagaaaactattctaaaacttcattttcaaaaccagttctgatactgtttcatgcattgcctttagaaagtaagtatttcaaagtcagctgcgcttatgtattatttattttatttaagaacaaattgtgtcaaattgacaaattaaataattagattcatggtataatcataagtaataagaaataaaaattggcagaagagagtgaggtaatcccagaaggagttcaccagatagagttgacataattttccaaccctgctctgatgttaatcctccgtttacggaaagtgtctatagaaaggtacatactcagatagagttgtagatcgtctgcctatctccatattggttcacagaaactgctgaagagtagattttaaagaatcaaaataattaaatgtccactttaattcagataaaaattaaggaaataattcagattatgtttttaaaaacaatgactttttattaattcactaccatgtgacttttcttcttgaagattgatataacctccacttttaaaaggtatacatttttacatattgtgatttttttaacaagattgtattcatcctcccttttgaaaataatacaatatatgcttataaaaagaagataaactcaacgtaaccatcttatccaaatagccttaatgattaatagtcttaattaagtgaaagtatctcattaaaatattctgaattaatatacattttaaagtttatttaattgaatttaatgacctaatatttccatatgttatttaataaaaggtaattgaatttaataacctaatatttccatattttattgaataactctcttatatttcatgctctatcagttaacaaaatgactcatgtctgcgtacaagcttaccatatttataacaattgcaaaccagatgacgtgtactcatgtttgtaaatgcacctatagctatgcgaacttccaattctgtggaatattgattggcttactaaatctaaaaataggatagacctctaaagcatatttgtaagttgttagagatttaaaatgtaactttacctagttattagtaatgtttttgttttgagacggagtctcgctctgtcaaccaggctggagtgcagtggcgcaatctcggctcactgcaagctccgcctcccgggttcacgccattctcctgcctgcctcagccccctccgtagctgggactacaggcgcccgccaccacgcccggctaatttttttgtattttttagtagagacggggcttcactgtgttagccaggatggtctcgatctcctaacctcgtgatctgcccgcctcggcctcccaaagtgctgggattacaggcgtgagccaccgcgcccggccacagtaattttttaaataaaaacttgatagcccatggaaagagaagatgagtgggcaataaatctcagaacacatgtattggaggaaatgaatctgatgattaaactcagttcttagggcagtattgttgctgtcacaaatccccttcctggtgaaaaattgatgtggtaatcagtttcaggtcatagtaagtcagaaaaaaatacagaatttatttaggtaaaatgtttcttccctctcaaaaattgtaacttttcttttgattagtaggtaatggcatgtagaatggtcttaatgatcctaaaagctctttaaaaggtatcttggttttttttgtttttttgttttttattttttagacagtctcacttcctcacccaggctggagtgcagtggcacgatcttgtctcactgcaacctccgcttcccaggttcaagtgattcttaacgcctcagctaccagagtagctgggattacaggcgtgcactgccacgcccggctaacttttgtatttttagcacacactggatttcaccatgttggccaggctggtctggaactcctgacttaagtgatctgctcgccttggcctcccaaagtactgagattacaggcatgagccaccatgcccagccagtatcttggtttgtttcttctctttctatcctgattcagaaagcacataattgataatggcagccatcacatttctacattgaacagatattattgaatctttatggtgagctgtgctaaatgctgtggtgaatccaatgctgacagttcttaaaatctaggtgtgatgcagttcagaataaataaattcaaatgacataggttgctttgctttgttgtagttttcaaaaatggacacaacagagttcatatttgataatacaaatagcccttgtcggtggcatgatagctttatccatcttttttagtttatgacttgtggttatttttaaaacattgaaagaattttgaaaaaagtcataaatgtctgtaacactagcacttttaaggcagataatagacatctaaaatcttcagggcatggctatggctttagaatcatctgaataagttgaaaatatttaagaaatataggtctgttcatccaaagaattaaataatttgcctttgtcacgatggaataaataaaatatcacaggttatttttgttgtggtagatgccttttaacaaaaggcaatccctggagactgttgtagaaaaggacaaagcaaaacgggtgttttggttttgctttattttgattgattgttgtttgttgtcattactttctttgtacaatcacttttccatggtcaccctcttttctgctttatactaattgccctgttgaggtgtttccatgtcaaatgcagctcttgtcggaactgaaaatggcagtgccaagggagctgtgcaagtataatcaaagctggaagatttcctccatccacccgcaaccccaaggcttaagcattcccttaggaaccaaagctgactctttgggaaagttttcacagccttattaggttacaaccctgaagatgttttgttgttttgaccttaaaattttgtgaactgttttgtgaactgtgtgtgtgtgcacacacatgtgcaaaggagttgcttgcaccttgagagagtcaatttttctgcctaagtgaaaggtcaggaactgcagttaacccagagtaaaatattggttgggtgaagggctcacttctagtatagtcagaatgggctcaagatcttaggaggatgataggtgatgaactgcttaaggtaggtactgttgtgtttgtgctttgtctcatgtggacaaattaccttgttgcatatgtgagttatgtggacataaacatatacagcagttactccctgactggctggctttcttaaagtgatagtcagaatatagcctgtactgtcagatatgaaagatcaatataattgaatgaaaaagaaagctgaaggacaatccaagaataatacaaacataagctattttaaaacattagagggagtgctttatgcaaaagagaaactgaatttattgtttcattctctcttctctcccttcacccctttcaagaaaacgcaaagccacaagtgagtggttgtatgtgtctgatggcttatgtaaacatagaagaagtcttcagatggctaaaataaacatgcgcgtgttaccaaaggatatgtttacacaaaccatttgctcagcctctgaaataatgaataaatgaagattttactaaaataattgggaggatttttgtgtttctgcggatgccataattgaatggcaccaaagagacttttatcagctattttccgtgttacatgtgttagcagttcctttctgtgggttgaatacttcattctgtagttactttacacatgtttttctaagaaattgtcgtttattactgcaattctagagagttgcttgatttctcaagagaaatttagcagccagtaaaggttatttggatctggttggtcaggagagggagggcaaaaaaaaaaaaaaaaaaaaaaaaagaaaaaagaaagaaagaaaaaaaaagtgtgggggggtaatagctctcattttatccatgtaacttaatttgcataacactcacctcagccattttccttgctttgttcataacattttctttgtaaaatgtatgctctcaaaagaatgaatatttaaacaaaaaataactttcaataatgggttgcaaaccatatgtttgtattacatatatgtgtttgtgtgtgtatgcatctatatgtgtgtgtgtatgtagtgcgtgtgtatatctccacatatatgtggcatacgtatgataagggcagtatgtccttaggtaatataaagagttaacttttatttcaacattacacttagaacatccccgcgaattcactaggttagcatttcctgctctcagtttgttatcttgacacataactacagtacaacagctgggttgttcctggagttcctggggggagctttattctccgagtgctgaatttccttttcagctgtcagctctaaagtgtgttcaaatcctcaactttttatacaccattctgggcccctagcaccactctgggactatgatagaaatgctgatatggtagatgaatggaagaatctttggttcaaggtggagaattgcaaaaaccaaaatttcacatgatcattgtttggtaaaggggctgctaactacttttgtctttgtatatgaatattctttttaaaggaattactctattctcatcaaaattatttgcacctgttatgaaatcaaaaataaaaacattaccattcttaaaaatgatcttgatatggttttcacggacgcacaacatctgtggtctggcttttgaataatatgttgggatttgtcgtagttttgcctaactttctccatttataaagaaagatttgtacaacacgacatttcctttttatctaggcaaactcttcagaacacttcctaagaaattaattgtattccagccagacttgcatgctgccatcccacaggaaatgggtcagcaatccattaagatgccattagataatctaatttggaacttaatctctaaattaaccatgctccatacttgaagcgtacttgagagaaagaaaaaaagtttacgtttgaatcgataggggagccgaagcgtgaagaaggctgtttgttttttctgtagctgtggtcacgtctcaagccgtctggtaaccaggagaaaccagacatgatgtaattccagattgaacttgaacttcagggacttaggttgggggaacaatggaccataggaatcaataatgtccattttccacatgattatgtttggagctttaagttaacctttatgggagaagcagcaggatctgcagtgtgaccaaaatgagatgatcctgagacaagatgttagaggaaagaaaacaacttttttccgtgatattttctgagcaggactgcagattccagcaggattagaaaagttcccgctctgcagtaaaccggtggcctgttcagagcactctttgttcgcttaggtaggacaaacttaatcttacgtttcctgtcgatgatttttggcagcgctactggagagggaggagcgtgattctgaaaattcccaaatgtaaaccttgctgattaaccctttgtagtgaaaggaagtatattaaacccctactttatttgaatatgttttatgtaaagtgccatatttacagatgtagttcgtccgtaagaaatcagttccctcgacagccagtgcaccatttattagcttacctttttggttctcatttttgctagtgctgttagtagggatatgatgatttttttagtcatatttacttaaataacaaagactatgaatgaataaatatcataataaacataataaatgataaaagaaatggcaaaatcttaaggtcaagtaattgaagaacacgaattttgaatattctgaaattgcagaaagttacaattattctctcttgctcactttgtttcacacacaggaagatcttttgcccatgtaagatcttttgcccttgtgaacagagtagcaagcatgatattaaaatgtgttcagttctttaatcatttgtaattttatgcttcagcattctgatacaagtaagtttcacctttaagaggtaaaattgtgcaaataatgctgatttttgcttttaactgaaaatcatttataaaagaatctctttttgctttgtataaaacttatatttctatttgatttagtatgccttgggtgattttctctagtgaaaggcactattttgaagcaccatttttgtagagaattttatctgctgttaaagcatcacatatgcaaataagaggagcagtaccacttttaacaatagcattgaaaagaagcccagggtagagaggaatacagacagaaagaggctggaaatcaacatgtgggcttctccactgtgctgtggtctgtgggaggagataaaataattgctctgagcctgataattgtataatttttaattggctaaaacctcccacagctacctgagttcttatatatgtatgcatgtgtgtactgtaatttatttataattagtcatcttcataataatttttcatctttcattttcagttctaaaatttgaaaaagatcaaacaatttttttataagtccttaatttggccaattgaggaagagcttttttcttatttatgtttaaaccgaacattttaaggaagtttttatttaagtgtaggttgctatatcgaagtcttcaagtattatgtaagagttttttactaaacgagtgcagtaattataaggaacacatttaatatttagtggcagtgctcccatatggagtggctttttcttgccctgtgctctttattagataaaatatttcaatggtagatgctattattttacttagaaagtgctagcactcacgcatggtaaagttaacattcaatccactgtgccctaagaacaaaaaacttctgaatcaattgaatataaattaatgaggtttgatgggctaccattttgatatgctattttcaaaaccgttggtccccaaggagtagcaataaagaaggctatttacctacttagttaagaaacaaatatgtttctctttcattactgtgaagtcctattgcttgcagttagaataattccatgagccacctgcagtttatgatatttggtgtttcccagagagcccacaagagtactttgcagttcaggtaagagctagccagggagctttctgatacagattattacaaatagtaataatcattaggaatcatcttgcatgcaaagaggatcattccgacggcaataatgatccctaaaaacggtgaaaataaatcgaagaaacccaagacctgtataaaacactttgtgtatttcacttccaggctagcctcatctgaagtggaactcaacaaacaaattattgacatacagccacatctgcacatatgtaagacaaaagcaaatactgcattcagctgaaaagcaactggaattggaggaataaagcacagttatttgtgctgaattttgggctcaagaattatacttccacaggaatttcattgtgatatgaacctcaattcacaaagtctcttgcataattcagtgataatataacttctagtccagtgagaaaagtaaactatgcttcacaggaaggggagatgagaaaagtttagtgggtagaaatacagatcctagaatgacattgctcgaattcaaatcctgccttctacaatttaatagcaatacgagttgggcaagacacttaacttcctcgcttcagtttcctcatctgtaaaatcaggataataatggtctttctcatagatttgttatgaggattaaaagttttaaggtaggtcaagcatgtagaacagtacctggcaaataatacacattatataagtgctagcaactggtatatttatcaagtactattttctttgttctaatacataaatagattcaacttaagtgtttgttccttctactggtctgagcgagcatttttttcacaagacgtaatctgcagcctttgtgttatattgaagtaagcaaccagtccgaatgcacccatgtacaacccagggcagcacagttttcccaacaggttttcagcaattaataaggagaactgtttattgtgcattttacaagaaatgctaatacttgtgtgttaatattttgccaataaaattagagtgtttagccaaggaagtaaaaacctttccatcttggggagatcaggaaatgttgcaaaggaactaaaggcaaatgcttcttttaaattaaaatacttattttatttattccccatgctttctgggccattgctcatttttattgccatctgtaaataatgtggctactgttacagttgaggtatgtattaatatgtacaactctttgtgcttttttcctgtaatattttttaagcttcttgaaagagtatttactatcttttaagtaaatatggtattttctcatgattaaaccagtatataaattctaaatggacaatactattgttcccctgaaaaatattcgtatactggatacttagacatttcataaactgtttaactagtgtgttatctcatccattatcaaatacacacaggctagtaataaatgatttttgccattcttaaaatagctcttattgtttcatcacctccaaataaataataggtgatgtaaagtctttgactttgtttggtttctggctcaatgtaatggcttcatacatgtttaatgtggcaccctgtggttcctaggtgttagtgagctaaaaggtaagggcccaattctttttggcctagaagacacactcccataatgcataattttaaaaaaacataaccagaaaatgttggtatggctgccgagagcaatttctgcctttctttcactgaaaggtatagctctttactctttgtaggtagatgcgaagatgaactattttgcccagtttatccaggataagacatatagaaatagtgcatctttttaaaaggaagaagtgggtatcttcttccgccttaatcctcacgctgtagaactcaccctagtagaacttcaactagatttgtttcagaggagatgaatacatagaatttcagatcatttgaccacttagaccagctacatattctgtgcactagtctctttcgcaacattagctaggttataatccagcttgtatggtgcatgaaaagttcactgtctcctgaagccaattaattttgccttcagaccactctgttcaaaagttctttcttatgttaagtcatctgacttcctgtgtaggcaatataatatagtgaaatggccagggaaatcagacagatctgagtcataactgagggctaagtgggagactttgggcaaggaacttaacttgcctcagtttcctcatatgtgaaacagagatactgatggccatctcatgagctcactgagaaaattaagtggtgtagcatatgtaaaacaccaaagatggtaccatgcttatagttaagtcctcagcatggctatcgtctggaagttttgcctttgtgctgttgctacaacctgaagcatgcttaagcggtctacattcctttccacatcaactgctatatcttccctgtctacccttagctgttctgcaatgacataatttggtgagtttttcaataagtaaatgccataaagttaggttttcttccacagtgctacctagaagaaatacagtacttcagaggtagtcttaccaataacaaaatgaagcaggaccatcaccagtaatgcatcttaagctctaaataattcatttgcttcttcccttttggggggagccatgtcatacatttggtcaaaatagcaagaaaatagtatccatgatatcaaacattttatttttggaattttgatttagctcttatgtattcattttataatgaactatctcattatatgcatagtaatagtcattaggatgagctgtactttgtgttaaggtactatcaaattcttttgtgtttttttctgcttgatttttttgcaaagtaattatatcttttcttttttaaatggttatatctactttatattttctaaagatgtgctttcaactttcagctatgctcatcttctctttgcctaaacaaatgtgatttggtaatgaaaaatttgattaaaacaaaggaaatgcacacttataaagatatattgctgaagtagctgaatttgagcttgaatattttgaaatcctttcagttatattctcatttcttttattggaatgcagatagttggaatgaacataagattatccatatagtaattctcactatgaattaaaactattaagcattttacatgtaactaatttgtttttgtgtgtttattttatccatacatgtgattattgatttttatatagagttagatgtataaaaagcactattacatttttacctgagtaagtatgcaattttagacattgcatttttgaaattaaataatctgtattactttaattaaatatatttatttacattgttatctcagtcattgaattagttttatcaagtttttttttttaacaggactaccaaaaatagctctaaaaaatgtctgtgccttatagttctgaacttaaattggcaataagagacttgtaaaactcatatatggggtctgcatagtgttaatgtttgagatttatttccccccaaaggttcataaacagtattgacaaatatattgcactctgcaattttgatatggtcataatgtaggatgggcggtttgaaagatttaaataaacatttaaattaaatttggtaggcattctgcagcaagagtcctgttagttactagcatcaatttatttttattgaacattttccaaagaataatgacatatgtctcttctaaagaactgagtaagagagctattgcaaaataaaccctgagttttctgccattagttggtagacttgtccatgtaaggagccacatctattttcaatcattaaaatatactttatatccctaaagcatgcaatctccaaatgactttcttgagctcacttaatttggcactcttgttaattttgcaaagcaatttgctgcttgttgacattgtattttactgtcaaggattatctgctttacctagtccttttgcttttggtacatgcttcttacttcaagttaaaaataatgtataaccatttttgtaatttattttatttgttaagaaatagcaccagctatgctcagactctataaagatagatgtgactaggtcgttttctctgtgaagttcacctttcagttagtaagataatcccagatagagatatttatgaagtaataaatgctgtaacaggaccatgtacaaagtgcagtggaaacacagttgagggtaaaataagtttcatgattcattatgtaacattgttcccaatcaatggtgcaaagcacaaaaataattgttgaagatgtgtgtgggaagagaaatatgtgaaaacagttaagctgcttagtaaaagtttcaataacaagtattcttaagagttacgatttttcatcagattttgaggacgtgtctttttagtttgaatgtgattattcctgcttaatcaatttttgttaatgctaagtagatctaattttaaattcagagatacctattttctttttataggggatcaaatcacaacatattcatgagtatatgtaatcttgggtgacagcttttgaaaatatatagctgggtgtgatttgaaacaattaattgatttgtttgtctaaaaaggtattgagcatcttccatgtgctaggtactttactagagacggactttgctgtcattgagtttgtagtctaattataaaatcccttgagcacaaatggtcgttgtgatattgttttgaaatgttaactcagaaatatgtatgtgtagcaacaagcaacattttgtatcgaggtatcaccagagtaaaaacagtatgtatcaagttttaaaaaaaattcagaattgttcctttaggttgatattctgtaaaggtttttgtacttttggaattcaaatatgaacaaatgagcatatctagattgatagctacaacaatagtgctatctcacttcatggtttcaaaagtaaagcaaaggatgttcagtgaaatttaaaacctcgaaagtatgtttccatgctaggccatgactaatatgagtactgaattgtcagtttgatgttttcttggttcatgattatttatgcagctgttacttaactgacattcattcggatttgagtgttggaacaggcaatacattagattaagtgtacccaaaatgtgtgctgtagagttgtttcatgatatgtagatctgattttttttatcctccatatgatactttttaaagggagattatgctagtagcaattagagaattgttttccagtcttttttttttttttttaacagcctgtaattcagcataggcgaaagttgaactgatgagagtaaggctggaatcttatcatttactgcctccaacacccccaacccccaacccgccatctatcactccaaactcctcacgtgcagagcagctcaaatgtggtatcattactgatggggaggagcaggaaatgctcaggcttctgttgcaagccaatgtagggaaccatgaattggaaggaaaagctgtggctctctctaaaagtaagttaaagagggttagaataagaaaactgctggagagctatagaactaatcagtgcaagcagagacctttgtggcctcctgtaaatgtttttcctcacgatgggtattctgtagagaacaaaaaaagctgtgttccattttggttctatgattcttatttgttcggtctttactaaaaaactctgattaaggtatgtttgataattgggcatttcaaattgtatgttatgcatgggcctaccttaaacatgtagttttttttcctgttgtaaggagaaaagaaatatctttcaccgtacttttcaattgtattcaacccaataggcaggtaagaaattgaaacccatctgaccactgaattgcttgtgaattaaaggtaaaataagattagaatgtaactggcaaagtatattggtaccaacagattgctgcttttctttttcttttttttcctgtacaaaaaagaatgatattgcatttatattgaataatgtaaaatattttagaatatcctcaatcggttagaattcaataattgtttatatatcttactctggatttttctgcctcactttagtcttaattttcatttaaaaaatagactatagagtttagataggtgtaacatgtataatttggcacatttatctcatattagactgtaattttgaaaatagggatagcaataatttgatgcatctggaatttatatttctcatattgttgtagattttaacattgtatttttttcttttttcttccctccctgctgcctctctcctctcaacagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagagatgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgccttgaaatctaaaaaacaaaaaacaaaaaaaaaaaaacaaaaaaatacaacaaagtgacatcactacacttgttttgctgcatttattatcattttaaatctttaccatttttatgacaaaatattttgtactccagacgaagaaaaatgtgtgacatcatggattttttagacagttatacctttatctcacatttataaagcatatcatggctgtgtatagttgccgcttaaaaattgtaatcgaccagcaatattttcagtattttggtgtttttttctattaacctttcatgtttttcatcttccaattaatatttgggggggaggggtttcaaatttatacgaattatgcaataccaagttttgcctatgtaggtagtgcttttagctgtattggttattataggtaagtacacagatttaaaaaaaaaataatgtatgcttttttgtttgtttgtttgttttaattgaccaaagtgggtactgctatttttgcagtgtgatgaggtccttttgtgtactgagagatggacaggggattttttttaatatacatatatatatattctggggtgggtgggaggatttttaacactttgcagtgtagctgtgaagcagtgcaccctgagatgggcctgggctgcaaagcgactgttctgcctactgtgacaaacttcaacttacacaggttcccctctctaacttcccacctgggttgcaagctgaactcattactggttttcataacaacacaatagtaagaacaagcaaacacaacaaattctcctggaggcagacttggcttaaaaaggcagacttggcttggtgatagtttttcttgaaagttccagatccacagtggagagtgagcctgtctcatatttggcaaaaatatttgttgaaatgtccacataggggatgttggatgtttaacacttttgagagtttaacacatgaatattctttctcctagaaaacacattagacctgttggagggagtctcccgtattccttttctgccacttttcgtccccatttcatttcattaatgataggatatgatttacctgtgacttactacttcaaatggatggcagtgcacttggatttttttttaatatccagaagattgaacagagggttgctattgttgaatgtatttggactgatagattaaaatcaaagttcaatttttaaggaacaaaaaagtaaatcctgttttcattttacctccccttttaaaactgagaaccagagcagaagggaaatatagaattttaagcaattaatcttcctgtggatgaattaaacccattagatgctgatgggatttttttaaggaatggtaccttaactatatatttgatttcgtttcccctgagggctagaggctgaatggaggctggttttattttgcctttccctcaccgcccagtcccattgagtgtattcattactagaaggaaaatctttcagaattggtgacacatggtaggctgtcttaaggagtcccctggcccccttcccctaggccatggcctaataaaataaactgtcaattgttctcacagcatatcatttaataatgaatactttagaacaatgcttatgggctggagaattgtatttgattagcccattcagtttgatagcccaaatgctgaacagcacagcgggatcctagcagtgcaagttcaaaagtaagtccaatcatttctgtgatactcgccctggtagcaaacagatcatctcagccaagctcttcatgtatctttgacctattaggtgaacaaatgaacctcacaggacacacagtattttttaaaggcagactcgctctcttttttgccagtgagcagttctagctaaccaagttacacactgtgggtattcctgcctgcctcttgaatacaaaggcctagttcaagtgttgctttttttatttcaaatcaattttttcttctttcctttttgagataaaactattaaaagtactactatatatataaaatctcaaatcaacttttcggcctcctcctcgtgtaccaggaagtatattctgacgaagggccccacttttgcaggtcttgcacgcccctcccttacccagaactgcagagcttcaggatggcgaaggtcacccaagggcatgagtagggagtggtgtctccaaccatcagttccgtggcactgttcagcctttgtgtgctgccctgccacccaccactcacagtgcctctgaagcgtgttacccctggagtgacgtgagcatttgaggcttgtctaaggaaaaaaataaaaggcagtgaaggagactgtacataaagacatggcaaaaatcttaattatagcaatatagttatcgggtaatgttcgggtgggcagctccattaaaaaatatgtgaatgaatctgtgaagctgcaagtagcgagaagagcgaaaggtcttcttaatgaaccgcctaccttgtagacagtaatttgtacactgtatagttttgttaagaattttttttaaattaaaattcccatgtttgtaaagctaactttttaacaattataatggaactatatgttgtttccatttttaaagtaaacaagaatattccttgtttagagactggacttgagttaaaactctccagtctcttaagttatgtattaaaaagaaaatctgtccatgttaggagttatttcacagattcctgtgcttgaaaagcataggatactaatcctttaaaaaagtgtaaatggagaaaagttatattttatgaaggttattttgttgtatttagtattggaaaagttggtttccagagcatttcagaatgtcgaagcaccactgtctttttattagtatatacggcctttagcaaaagtttttgtgattgttacgtgatggtatttaaggttaagtttcacagagcattcaggataggcagaaaactaaaacagtgctatgtctcacataacgtgtcctcagggagcagaatcttggatttgtgacttgtagcttcataaggactcaacgaaagagattgcacagggacatcttcagcggtgtgacagcaggacatgttctttacctagattcaaattctatgtactgtgtgaaatgatgaaggctgcagaaagttatcccatattcagtgtacagtattcatttttaatgaaacaactctacaatattgctggcagataggccccaagcatgacattcaatatagtttacatgttcctgtcaaggtcttttgttaacattaaccagctgcatgctttctggactttaagaaattgggtttctatagaaaacttttttttttttttttttttttaatgtgcaggctattcaagttcaatagtaaaagctcaaaaatgaatgttctactccatgctgaaggagctgaaagctgccttcttcatattttgcactttctggtagttcccctgttttttctaattccctaaaattgtgtgggtggagtggagccctgcagttggggggtaacatggaccactgattttgccctttgaccctgcacaatgacctttgcatcagccaaactcattgccatgacaactctttgtactgtgtccgtgccacagatctgttggtcacattgttaatagtaaaggggacaagttggagacggtcaatttttacattttttgttgcaattttttcttcaatggttgtaagtagttttttttttttttaataataaaagggttcactagttaatactctagaaatatctgtgtgttgcaattcaaatgtatgttgagattgtgaaaagcgcttcagtgccactagcttaccggtacactagactaagcccttgatgacttattgcatgatacagtaccaggaacaacaggtggcctaaatacatgaaaagcagtgtaagctagtgacactaaagccagtcttgtattactgtatttttgacagaatggttttgaaaactgtgctacagggactgatgtggcaaatatatctctttatgcagaaggaagtctttttttttcttttttttttttttaagaagtatggctttttatgcatccttcatcgagggcattgaagttgcatggactgataaaagttgatgcaaaacaagaaagaaacaaacaaaaaaaaaaaaaccagcaaaatgtttaccaaaaaactcaaacaaatgagcagtgcctgttcaatttcacagtctctgttgagttcagttgtaaatatgtttcaaatgacattttcttgggaaaaaaaatctctacaacattgtagaatgtgaggggtaactacatcccaggcataggtttctcaaagctgcagtagattatgtcttcatcaagctgttaatttgtgcttatatcatatagaacttttagcatcctgggaagagctgcccccacctcaatgatatttctctgagaacaacttttgtaggactgtgtgtttctttagatacatttagtacaactgtaggtgacgagtagtcagttattgcttgctagctacacaccagggttgatccattttaaaacttttggcattttgtcctcatgggccataaatacagaaccttgtattttaattaaatttttttacaaaaggaggcacatgcacaatctccatgtaacaaacctttagcagtaggatgtattatacgacagttacttaatttctagagttcaggcctctgggatcaaccccagactgggccagaatgttagtgaaggttttattgtgcccggttggaggataacgttctttgggtactttttgtgggttgcaaatgaactcaattgccacaagttttaaactggtgtaaatcaagcttgacttaatgtgattgttactgttatatccagcctatactgctagcagctgctcatactgcagtcaattactggaagcggatatatttcctatgcaaaaactgtttaaacaataaaatgagctatgctacagactctggcctcatgttttatttttctcctcatcgtctccttgctgttctgcctacattaatgttgggtcagtagtgtcccagaaattgatcttggcccttaactttgggggttttgtagcactgatttaattattagcatctgggatagttaatatttcagttcaatatttaaccgtatatctgtgtatatctatataatccttccttgcagttcctaataaatacagtcatcccaagctttctaaacaatgacagtaaaaaaaaaaaaaaaaagaaagtgcagttatagaatcgcagacctcactctctgagaaaggcctttgagcaatacgttgaagacgatgtgtgccatgatgactggactgtggtctctgtgagagaaaaaccacagggcatcaaacactgaacagaaaaggtaagccccggggacaccctgtggctgtgggtttagtggttacatgaatactgcaggagagcaatttcttcctgcaaatgcctgaaaaggagcagcatcttgtgtttccaagaagcagtgctacttttcaacacaagcaggggtgatgttcccttttcacagggagacatacacaagggctaaaaccgaggaccgggtcccaaatccagcctcactgaaagcagcatttctgaatggagtcagctggagttcaataatagctaattgaaaaggaatgagcttaaatggttttgtgatccatctgagtgatgtgcataaatgaagcaaaaataatgcaagcttcattgaaaatagagataaaaatgcctggaatttgactatcccaaccaaagacttgctgagacagatctgactgcctgatccgaccaactctgatttgtggctgaggtttctttcatgtccccaaaccaccctggtttccaccactgtgtgtggagtcgtatggaaattgatggactataatatcctggaaaaaaaaaattggagaatcctggaagtatgagacagtaattggatttcttagaaaatgaagacatttcttaagaaatgtttgagaatattatcattgaaataaaacttttacctatagagagatttttgcctttttaaaaacgtttggctctattggcagagatcaagatttaggctgaggcggatggattgcttgagcccaggagttcaagaccagcctgggcaacatggtgacactcccatctctacaaaacatacaaaaattagccaggcatggtggtacatgtctgtttttccagctactcaggaggctgaggtgaaaggatcacctgagcctgggaggttgaggctgcagtgagccatgatcttgccgctgcactccagcgcctgggtgacagagcaagaccttgtctcaaaaaaaaaaaaaaaaaaaaaaaaagatatttagggatcaaagaaagatggcagttacaaaggaagaatacacaggaacaattgaaggcccatgccttaagttaaactgcctgatttcaaattctgaaaataccctgactagctgtgtagcaaataaataaactttacctcagttctctcatctgtaaaattagatattaatgacagtacctgtctcattagactattaagaggataaataagattgcacatgtaaagcctttatcacagtgtctggtacatgttattaggcaatgtgatacatatatgagtcaggaatgaatggattcattcgttttttttgggggtaagaacataaaggcatgaattatttttattggccatttttgttttgttttgttttactgtgattaaaaaataattgaatggctactgttcagagatcatgacttcctttcccttttagctttaactctgtgtcagccagcagaattttcctgacaggtattccagcagacttcttccaagacaccgtttctgaaactgcatgcccatacgtggtcttactttcccttctttcccttcagatgttgtcagtatttttctttgtgaagagagaaaagcattgatttctcaagtgtattaattctccaagtagttttattttataggagacacttaggatttgcaaggaatagacgtgtattcaaatggagaaagtcatgggtattaaaccgaagcagctggggaagaggaattgcaaggcaagagggcagtggctcacctcccttcccttccctgacactccattctcccctccaaggtgaggactggataaggatgtggaatctacaatggactgggagagactggataagctgagatatgaactttccaaacttcacaccaaggagccccaccgagtctttacaggacacaccagctgttcccaccgagaaaggaaacaaaactttttttgtttgtttgtttctttcaggatacctccctctgtggaatcccctcttctgcattgtctttcactcctctttcatcaggtcacaaatgccactattccatccttagtcctttgtccaaaattgccattttcactctgagttggcatctacgatgatgctcacactatctcttgttccgaagtggtcctttcctccacatcaacaaaatgtccactctggggtacctgtactggtggattttgattggattgaaatcactcacactagggtctgaataatagacttaagggcatagtggtggtggggaaccttgcatgaagttattgccactatcatttttttaagacagatgattcctctgtgtacgtatgaagaagacttcttggtgcttgcttgtttttttgttgttgtttttgtttgctgtaggggttagaaacacaattggatacagacgaggtggggcacgccacataactgggttaaacaggcagcgttaacaatgggagggtagaggctgtgatgacctggaaagggacatttatgttaaacaagaacagctggagctgtaggcagctcatgagctgcctttacatacgaggcttgttattttacagaacgccctcactgccgctcgtacatgtgactgttgaggaaaatgcatgggatctgcattgttttatggcccatggctctattggatccatccccaccacctctaccagtgtcctgtacctgcaccccacaaggtacagagggaaaagagattctttccagaaagagacagaattttaagggaatccaccatgtacttatcacacatgtttctcccaattactctttctcagatttttatccaatattgcagaatcaaaattttctatgttagtgcaaaacttataagcctttacacctattcagagaaataacagaaatgacaggcctggagcagtggctcatgcctgcagtcccagcactttgggaggccaaggcaggtggatcacttcagcccaggatttcaagaccagcctgggcaatatggggaaaccccatctctacaaaaaatgcaaaacttagctggttgtggtgacatgtgcctgtagtcccagctactcaggaggctgtggtgggagatgagctttgggaagttgagactgcagtgagccaagatttcactaccactgcactccagcctgggtgacagagtaagaccctgtctcaaaaaaaaaaaaaaaaaaaaaaaaaaagaatgacgatgttggaactttggcataataaattcaaattaaaacatttgaaaataaaatttcagcacaatatccatttctacctcacttctttgtcttatttgtaaaaatcacataaacaacctggtgtttccagtaccttaccaaattatccagtagatttaaatatccccatttcttaactgccttgtaattattgcttgatttattaaacagaagactgactgaatcgagaatcgttgatttttctatgccaaaaaatgttgacttctattaaagcatattctaggcaagacaatgtaaactggatttcaagaaagtgcagaagtgggagtatatgggtttattgtggacttttatttgtgaaactgctgagattgtttcataacccagcaaagtaatcagttccaaattagtgttcagattagataatgataacttaaacatatctcgccctatttgtaaacataagcactcttttccattccagagttttcagaaaaacgcacatattaagaagtgtagggttaaacctaattttaattgtactttctatcctattgacatcataggcagggtaaatgaagggaaaggaagtaatagtcgcctttgctttcttcttttggaagaaacatatacaaactagaaggtaatcaaccccctttaatgaacccaaatattaatattctaatgtgtgcaacaaaacctggaaaaagcaagaatcatattaaaattaggggggaaaacccaaaagataaaaaaagatgtaaataacattcttgggtagtaggaaataattaagaccacaaatttttttataaacctatcaattttacattttagttgtagctccacaatcatcacagaattatagctagctcttaactaattgaataactgattagacagaatacagtagagatgaaacaattcttaaatgttcttgactttttttctgatacatttgtgtccttcccaaatacaacatatacgtatatcttcagttttcctgagaagttccaattatatctactcttatctgtaaaattaacttaattaaacttgtaagcacatttaattttatgtccttataaaaatttagcatagaagattattatttaagcagaaaaatacccaaatatgttttgaggtttggaataaaaggtataccaccaaatccagaaagttctggaatctcacctgtgaagacacaaacccattggtctggtagagatcacattaatattcacattgatctcttgcctgggtagcctgaaatcaaactaggttctagcttatgtcctttctgggaatactgatcaaatcgtgagcgtgttacctgagccagtgccatccatgtgggccgccctggctttggtgcgtctccccttcttgctctctgttgatgcagtgccattcccacaggctgcccctctggtgagaagcctcagtgcacattctctgttgagtttaaaggaaggttgtgaggagaaataagtcaaattaatagcacatgttagaaatcaccaagccgccaatgtcaagattttcctattaacagtaacgaaggtccatcacagaggatgctagagggcaggaaacagttcaaataagagggaaacagttttgttggcagcaatgtaagagtaaatggagttgccatttgttgaattattactgagtcatgccctgggctaagtctttcacttgtattatcttatttaatcctcataagactgataaaagagaagtatactgataatactcttattttacagatgagaaaactgaggcacagagagacgaagtgatttgtcccaacaaatagcaggaaataataggtttaaatagcatctgactagcagacctaaactgcttaacgtttgtcttaaaatttggtccaatgaagtacgtgcttttttttttttaatattatagaacttgaagatttcggaatactcgtaatcccacattttgattacaaaccaaagcaaacattgatctctgttttctgggatttgcgtgatgtgtaatagtttggtcaccaatttcaatttcaaaattatacaccttccgtacattttggtgaaggctggacattcaaaacttaatatattgtcagttattctaccaccatatttttaaacttaattcatcattgggcttttagtgaaacagcagagtaatagctataatttattaaggactcattactgtgggttaggacctgtgcttaatattttacagccagtattttaaattaaattctcaaaaataagcataatcatttccattttacagatgaaaaaagagagattcagagatgaagcaatttactccaaattcatgcattatgaatatggtggccccaagattcaaacccagatgtacctgaatatgaaagccatgaactgcagtgtgggatgctatcttgtggctctggttaagacctggttcaggtaggtgaccaggtctcttactcatggtgttctcacagatctgaggattgtgagaatgcctaagattgctctgtgcccttgtgaaaactaaagcatccagaagtcacaggacagaattatagcatgtgcagtgctctgcattcttcaagcctaacattcttcagaggcaagaggagcacagagccaacactaactctgccttgccccatggctttgcaggtacccaagatttggaagtagcttcatgtgttcaccaagagacgttggtggttaactgttggcccagaagcctaattatgatgaaagtgggcttccaggcctcaacaagttttctttcacagtaggtgccctgaggagaaaggaggggtttggggtatggacttattgtttgagcctgccgtgcaggtgcaggtgcctgctgcaaaacaatgaactccattgatggcaatgcctggccctgcacatgccaaagccaacgcatattgctctaggcaggtatggaagtcaacagtgaggcgtacccaggtgggggttcaggatctcaaatggcctcctcctcagagctgacagaattaatcatggccacgctggagagcagactacctacaatatattgaaaaactgatctgtgagttcggacagatacaccagctcaaagctctggcattggggcagatgcatctattttcagaagtctctccacaaatggagaactgtttgtcttaaaggtggaaaattacatgtattttactattttaaagagggtatatctgaattgcctttcctgcaaaagaggaaaaggaatcccatgaacatctttggatttcttcctttctttctttcttttttgagatggagtctcactctgttgcccaggctggacggcagtggtgccatcttggctcacttcaacctccgccttgcagttcaagtgattgtcctgcctcagctttctgagtagctgggactacaggcacacaccaccacgcccaggtaatttttgtatttgtagtagaggcggggtttcaccatgttggccaggatgttctccatctcttgacctcatgatctgcccgcttcaacctcccaaagtgctgggattacaggcgtgagccaccacactcagcctatttctttcttttttgttttctgaggaaataaatatagataagagggtaaaatgtatctttgaaaaaaacatttctgtgatttttcaatgaggaattgttaagtgccttatttcacatggctaagcttcatcttcagacttgacacttttgcaaatcaaaagcttataagcagaggccacagacatggaaatacatccagccaactagaaaggggcagggtataggagtgtagtccagtcttgctttgaaacactcttgagagaaagatcgtttatgaaacacttacgaatctcatataatctggcactacacagtgtcttggacatcagtttttcaggcttcttgaattccaacttagggaagatagttcacttttaagcaggagccaagatggaccattttcattttctgataaaatcttattaacaacaactatgccagcaccaggatttgcactggggacacaagagtaagcaaaatcggcccaagctttctttttccttggctcagggcagggcttctaatgagtgtttcctggttaagtagaatctgagagcaatacgagttcaatagaaataaatgaggcaagtgatgacaaatgccccaaggagtgccaacatttgtgggtgaattactaaaactctcgagacctcagtatcttcatctatgaaaaggaaacaataagacccaccttaaagtttgttgtggggaattaaatgagatcatatattatgcctggtacagtcggacatggtggctcacgcttgtaatcccagcactttgggaggccaaggtgggcggatcacctgaggtcgggagtttgagaccagcctgaccaacatggagaaaccccatctctactaaaaataaaaaattagctgggcatggtggcgcatgcctgtaatcccagctactcgagaggctgaggcaggagaatcacttgaacctgggaggcggaggttgtggtgagccaagatcaggccattgcactccagcctgggcaattagagcaaaacttggtctcaaaaaaaaaaaaataaataaataaaagaaagaaaaaaattatgcctggtacgtagtagaccagaaaggatgctagacattgtcgtgatcagttttggatctctctcctcttgacctttttatagatgaatttatgggcagctccatagactgaggccacacttagtgcccctaaggttctaacttccaaggggataaaaacagacatcagcttcttaaaattctcacactcctctctgattagcaccatattccagccttccttcctccagtgcaccttcatcaggcatcacctccacatcacactgcattagttttctctttctttgcgcaacagggatagagggatagaggacagggagggtttccccttttctgattcccaagatcaccgtcattctcagtccctgctgagggaggaggcttgtcatttggggagatttgaaaatcaaccctagggcttggcttgccagcctggatgtgtgggcagcggccaatctgagaaacaatctggatatcacattgcccgagaaaaggggatgtccctctgggaaataagcctggctctgtttgtattggctttcagagaactcttctgacctgacatggtgctaacttggtattgtgggaaagtccgtctgaccactggcttcctgcagttgccttttgattatgccaaaggagggacctaagaagcagtgtgcagatatggtctccagggagagatgaaatcccaacttctgtcagcacgagcacccacctccccttgtttgcatgagagaagaggagaccagggaagaatttaacccaatcttgggaatgttgcacgctcgaactaaaagttaggtttttcacttcttggcttaacctaaaatgtaggcgctggccctccagttggctgccatgggacaaaggttgtttttctggctagggccaaaaagagtggaatctcagcacagagtaaaatttaactttggattttttgtttgtttgtttgtttttcctcttattacacctttgaccccaaaccacactcctccttccctctctgcctctttttctcaccaacttcctgatcagtcttctcaagttgcagccatgaaactagaaatctattccctgcctttgacttattggcattcccatgattattggttaatcttacaagaattaaatgagttttccttggcaggaacagagaggaggagcaggttttaggagggaaaaagcaaagtttatagtgttaaattaccttggccttatctgatcgctttgaacactcactcccctcttcactctcctctccccttccctccctagtgcttgataggatgcaaattctggttctccagagtatcccagctgatctctccctctgcctggttcctcactcactgaggttaacacattgaagtatgaatgacactagtcactaatctcttggccccatcctttccactgtccccgaggtgttttcttgggctgacttcatttaatttcaggatcagataatgacactctgtagaaggtaagagttaaggactggcaatatggcatagaaagacatgagttacagagccagatagatttgggctcgttctagccttttgggcaagttaaccactctgagcgctgatatccccattaatagagataatatacctttgcaaaaatatatataaagcatctagcttggtgccacatagcggatacttagatacttaattatcaatgtgatcattattactgggctgctctgtctcctcctgagtgcagttttgggtgggagatgattgttaaggaaggctacaatattgggaggtattattaccacagctgccttgacctccccattcgttttgtgtcctgaggctccctctgaggaaatccggcagcccaagaagttgatgagggagaagccagcagagggaatgtgctgcttggcttggagccaccaccaggtggtgactggcttggtcacccagggacatatgggttttattcacccgaggaggccagaggcacagtggtccgaggctcttggataatgagcaaaattagctactctctgctgatgttggggactctctttctgaggggttcccagcttctctggtgacccccacttccacaggccgccattttctttctatgccagtgattctcaatactggcttcgcattagaatctcataaaggagtgggcctggctaatggtaacagctccccaggtgaatcaaatgtgcagagttgagaatcactgtttgagacccagcctgagctttttggagcttctcctgcagaggcaaacttaggtttttggttgtgctgttctcccccggatggatcccaaatgattactgaagcttaatgtaagtatttatgttgcttaacttgtggcatcctttaaaaccacgtattgatttacttttaaaggtagacactccttattccaacaagcacagcctaatatggtatggtcatattgctcaggtagtatatttcttgcttccaatttaagaaaaaggaagaagaaagtcattaagttcttttctggaaaaacagcagagaataatctagagtattaaatatatcttgatgaggggaagttgaggaaaccttcctagatgactcttctatttctctgaactggtcagttagccccgacacaaagccttacacatgattgtctcccgtgaggcctccattgtctaagctgctctttgtgaaaaagcagatgctctccaatccacacacctgtgaccagaagcctgaacactaatggttgaccaagttcctactctcgttgcaaagatgaagctgtgacatcccccaatttttgggaagctctattttactctgaagaactaatgtgaaagttactgtaggcacaataagtataaagaaaaactgaactcgataacactgttgatagcttgataacactgttgaagcttacctggaaggattgggtcatccattagtgtaaaatactgaatttctatcacatggaagactgatgtaacttaggctcaaggaaacacaagttggactaagggttagaagttacagtaagacacatttccaccgagtattcaggagacccttttgctggctgaagttggaatgaatgagatcacaccatagcatctgttcagcaatcagtgctcgaaggtcagaatggtgagtgccaaaaggggagcacctggattactggttatacccgagacattcacctggccaatcaaaagttagtttgattgagtgttctacgtgtatgcttatttccaaacatcatcacattgggcgtgcatggtggcttacacctgtaacctcagcactttgggaggctaaggagggcagatcacttgatcccaggggttcgagaccagcctggccaacatagcaaaactctctctctactaaaaatacaaaaattagtcgggcatggtggcacatgcctgtaatcccagctacttgggaggctgaggcatgagaatcgattgaacccaggaggcagaggttgcagtgagctgagatcacgccattgcactccatcctgggcaacagagcaagactctgtttaaaaaaaaatcatattgtactcaataaatatatataatttttatatattacaaaaatttattcaagcattctatcttcatggttcaatatatatcagaaacttgcaaagttttagagattcatatatgaataaattatggtacttagctcacagacacacttaagcgaaagaagtagcaatacagtatcaaatagagacctaaaaaaagtgaaaaggggaaagggcaatacattctcttggggcaattcagtttgggcaatgcggaggtaaagtagggcatcaggcctgaaggaagcttctagaaggagttggcatttgagctaggcctttaagaacagataatattttgccatgtggggacaaggaagggcattttagttggtggtaaaaagtgatgcacagcattggagtgtggaagcgtccttatgttcagagaagaatgtgttgtgtgttgacttctctagtaaacacaagaggtacatgaaggcagtcgggggagggggaagatatctagcaagctttaaactccaaccaaggtatataaatgcatcttattggattttttctacataagtatttttatttttaatgtccagaatgtgtaatataagggccagaacttcctcctggactcaactttataaattctcgattggttggtgaggccaatagggatactttctcttgtctcatttggtttctgggaaagcttcattcaggtcctcagtggtcgtctgatcaaatggaattaagttcctcatcttctccagctgtttctcatattgtccaatcctggcctttgagagagacatccactcagcacaagttttcacatcttctttttcttcagcatccacttgggcagtgtatttatcctctggtacaggaaacttcagggcattaaacttcttctcaaagtcatccaccaagcctgccttggccacactggccttgtagtaagtccagtcaatagatggtttattctcaggtaaaatagccagtctggaggtaagaatctcattccaggatgtcagggaattagcaatggccttttggtttcgggatatgctctcccaagaagttacccagtcaatgatttttagagcaagtttttgcccagccatcttgggatccttcaccgaccccagcggcccatagtccacagcagcacctagcggctcttactggattttttagggcagctgtggctatgtattaaaatttggactttatgcttcaggaatggggaacaatcacaggttttggagagtagaggaagccataatctagaaaaataatggaattgcttggtatagggcaccaccaaagcttaactgtctctgtgatagtgatttctccctctgcacttttccccatagtgaatttccccaggcccattgttttccaacttagagtctttagattccttgcagattcatgaagatggaaataagggattcatgaagtattttcaacattgcaataagctgaaataaattatgcacttgaatatcactatcacagagatagttaagctttggtggtgccctatatgaagcaattccattatttttctagattatggcttcctctactttccctgtgcttattccccattcctgaagcacaaagttcaaattttaatatatggccacaactgccctaaaaaaccccattaagatgcatgtatttactttggttggagtttaaagctttgcaggctgtcttccaacccactgttcgcatatacctcatgcatccactggagaagtcaacacacaacacatgttcttctcagaacacaaggacgtttccacactccaatgctgtgcatcactttttaccaccacttaaaaggttagcaccaaccttttcatcgaagcaaaaggaccctttctttagttacaactcttcagtaagggcccctagccactaactttgggaaggtcttcctcttagagagcttacatggtataggatttattggtatgggctttagaggcagacaggcttgagtttgaatattggctgccacttatgagctatatgatgttggacaacttatttaatctctgtaagcctcactttctgtggttaactcacaggatatattgtatatctgttgtgtctgtcagtatagtcttaactcatagaatatattgtatatctgtcaattacacactttataatctgtcttattatgtaagtatagagtgttgcctgcctatagaaattaaaaatgccgctaggtaaatcacaatcttttatgtgtccatcagcatcattggccactattggtccttcctatttggggtctccactgaaggtctttgaggcaggctgcttctggcatttagatgaccacactcttggctctccagtttgctgctgtgtctgctgataactgtatctgagtgcctctgagctccccagtgatcttcccagtgccttgctgagcagatatcctgagggtggctgcttgcctccgtcttgcagaggccagagggaaacattcgcaatgccattttctacccagctcattagtcaacttcaggacttcaaaaggcatgctctgtttgactctgctgttctctatacctgacacgtatacaaatgtgttcaatgcacacttcctatgcttcgtcatggctttggaagccctacttgagactcagtggttttatgctttttagtctacattgcctaagagaactgatacagaggctaagcaaaggggtggtaaatatggatgtcatttaatactacagtcatacggcaagtctgaaaatggtcttgtcaaagttagtggtgtggcctaaatggccacataagtctgtcttgaaaacgatttgaattttctctttcttttattcagttgagtcctaggaatatagacacatggacaacacgtatccagcactgttcattgtatggtgctgggtaaacatacaatgattctctttggatagctgcccatgtactttactgttcatgtgcactttccaacatttcagtgctggaaaaacataaaaaagtcaggaagtctcacctgaacaagctttcttgggcagatttttggcaggtaatgcttcctgttacataggaaatgcttttaagcttagcttcatttatagtacttcggtttgcctacgaagctatgaattctgtttggttgctagtaacaaatcttagaaagcaaaacaaacaacagccacaatgacaaaatggtggcttgaagacattaggggtttatttttgtctcatgtaaaacacatttggagatgggcactcaggctgaggccgtgaaagacttaaggcctttctagctttgtgctcctccatttgtacaacttttttttttttcgtgacagggtcttgcgctgttgttcaagctggagtgcagtggcacaatcagatctccctggctcaagttcaagtgaccctcccacctcagcctcccaagtagctgggactacaggcttgtgccaccataccccactaatttttgcctttcttttagagacagggtttcatcatgttgcctaggctggtcttgaactcctgggttcaagtgatccacctgccttgtcctcccaaagtgctgggattacaggtgtgagccaccacgcccagccctagggcataactcctatcctcctgctctcaaggtgactgctggtatgccagcaatcatgtccatgttcacacaggaaaaactgggtgagtaaaaggcaaaaataaatgtgccaatttttgttttaagagatatttcgggagtccttctctcatttatactcctatcacattactcataatacggtcacgtgacatcccccaactgcaagggaggttggatacatatttggataagcccatttcctcctttagtaaaactgatgtttgttcacaaggagagaatggccattgggtaagcaagtagcagcccctggcacatctacctttaatcctagctagacattttacttatcttggttaaaaagtcttaaggggaaccttaagacttaaccttctaaccataagcagatttgaaatacttttctaataatgaagagctaattaattatttccaaatctacaacactatatttgagaagacttcccttatttggttttcactatctcctaagcacttggaatcttaaacctatggggtctcttgtattaatttgttctcttgtacatgttcagtgaaagcttcgtgatgttttgatcttattttaggcaagaaggacatttggatggaagataacatggaaactctaggctccaagcaccatgcgtacaattgttttattgctttcttataatggttgcaatgagttaggtagtaggaaggaaacaaataatacaacctgtgacaaaaactccagggtggtatagtgcagggtttttcaattctctttagtggtaaaattgtgtcttcaaatgaaattatactgaggacatttaactatacaaaagagataaaaagctgactttctctagttgaagtaagactggagggacccctccactcttttcacccactccctatctccttcatgatccttggggtgcaagaccacagagagaaaatctgaaaatcatcatttcattaggtatttgtcttagctctgccattagctggctttgtgaccgtggacaaattacttgccttctctggcccccaggtttgtgatgtaaaatacagaagggttgagtcagttgatcctgaaaagtccatctagcccatgtttctaggattttcctggctaccagtgtgtatatagtcagcttctagtgatgagtgttatctgtgcttttctcatcaaattggctggaggcaaaagaaaaaaaatccatccattagtattgactagcaagaaaaatgggaaataaggatgcttttctcttaaatattttcctgctcataggaaaaaaaaaaaaaaactgaaggaaagttggagtgaaattcaaatcccactgcagcatttatcacaatgatctagatctatagaaagaagccaaggctagtgaaaaccgtcgatttcagaacatctattatgtgcaaaatacaataatagttctttcatattttattttatttcatttaaattacacaagactaatcagaggtgatactatttcttttattatacaggaacctggaccagatttattctggattagaacttatatcttctttcattaatgtttccattgaatgagttgcacctgggcctagctactattctaagctcagaatcccaaacctaataaggctgcgggtctgtcctaaggagctttagtaacttctgccctttaagtccagtgtgttttccttgatactgtagatctcaatctttgtctcaacttttgttatacgttgaaattaatgggggggttgattaaaattccagtgtttctgtccccctcccactctacactacttcatttcggcaggatctggagtggattccaggcatctgcagtttaaactcaccgctcatagctctgtcacctggcaaagttaggaaactacagctttatactgatcagggttattgatgtgaacttctgccttcatagccagatggtgggccctcattggttgagcactgggcctcttttattttttgtatacttggcgtattgtaggcactttcaaaaatattgcagactagaagaaaaagaagaggaggaggaggagagaagaaaacttgtatagcactgaattcacccacaccactgaaaaatagactctgtaacaggacacacaaaaagagaggggttatgggcatttcagggttttgatgagatggccaagacgcagctcctgtctcctcccacccccattcattcttcttatgctgatttattttgtctaagaatttaacacctgcttgttctgtcctgctcaccaaatccactactactagtataagctgctctagagccagaatctggtctactgttcacttttgtactcccagtacatacaacagtctggcacataatgaagggaacgaaaaaagaattatgtgatggcctgaaccacagcaggaaggagtgagattggaagggatacaggctagtcttgagtattgcaggactcatgaggcaaaatgctaagttactccaacacttaattagctatttttattaagtgtccaagcctccttcatttaatgggtgttttactgcttttatctcaagaaagatggcagaagtttgtgtcttttggctttgatcacattatttctgggttttgttacttaataaggcagaagtttaaattaacatcattctccattgcctgtttttgggttagctatacagtatagagtgctggcaatttttcaatggaggaaagaaaaggaaacctctgtttgggagctttagggggaaaggagggaaagccatttacctgagcccctggggctacatctgcttctcagaaaagatctgccatcaaatcaagccaccggacccctgtaggggctacagctcagggacaggttgaaggaggactgggccagctatagccttcaattgtcaaggcggcaaagaaggttggaaggtgaattcacagtcatttctgtgttcaggggtacactttaatagctgaggtaaaaaagtgttgtcagaatgaacaaaagccacctctgcaagtcccctcttaaaacgtgaaattgcctgggctatgatctgaggtttatgccaactgaatgtgcatttatttcttttttccctcttcaatcactcactgcagggttagcttgatggtttacagaacatggtaacacttgctgcactttggatcacttcagccaaaggtttgttgctgtattaattggcttcagagaaaacattgccttcacttaaacggtttgaatacctcttgttgaatcataggcctgagtcaagtgttattaattcaagaatcttttgtccatatcagataaacgttgccatagcaaatgtagcgtaaacagatctgttcaagtcacaacaacctatagaagcccacagacaaagcaggaccagttttgtcttcacagaaggcctagtgctgcattaaatgctatccagttggcctggtgtatagccacatgaatcacgcgctgatgaatggaacctgggatccacagatcccaggcagaagcctttgtcatcgggttttatcaaatgtgaacagtcagtggaacatctggctttaatactgatagaaactgtaggattttggctgttctctggccttgcatattttccatcttctctatcagcacttgtcagtgatttgatgaagttaaatcgactgcatctgattcttcgagcccacgaaaaattgcagaatgcttgctcctatctctcactcttactcactcagagtaagtttgcagtgagttggtttgggtcatgagcctgagaatttaaggaggaaaggggtgaacagagaaccttccaaagcctcgtctcagacgaacactccttttgctcaacaatcaaagacagcatacttaaactgcaagggtgattccactgaaccagtaccagcctttgctggtttgattgcagccaaggagaaaaatatggcaagagagaggcccatgactgaaatgagtttgcagggccttttgctctcagctttccccggaggacctcgtcaatctcaccaaccctctgccggtccagttgatgttgtctggcacaactggcaatcacagcgcagaaaatgataggacccaagtgaggatggagattgaattcacacctcatcacatcccataaagggcaatttttcaaggtcagtgtttaggtgaattaaaggaacagggtttggcagagggccctctgctcagccctccgcagaccatccatccagctgctgcttttttgtgtgcctgaactcgtgagagcactcagacgcatgcgcagaccccatcggttctagtgagtgcatctgaacacgtccaagcaggctggcgggtttgggtgcaacttgtttttgttaaaagatgcccccatgatgtctcaaaatggaaaattgaaacagtgactacaaatacgtcaccgacaggaaaataggcttgagaaggaccaaattattttcatctgggagcgggagatttttttcctctgtaaggtacacagatttctgtaatttacctaaatgctaatgggggacctgtgcaccaagtattctcccctgggctgctggctgtttcctggggagcagcagcctctgatgcgcaggactgactgcccaactgcctctgggaagaaaatgttcaggtgttttaattatctgagagtcctgtagtgtcagagcccaagatcacctagccctaccccttcatcttgaggataaaccagagaggtccagagaggtggagtgagtttcccagtgccaagcagctagtgagaagccgaggcagggctgaaacctcactttgctaattctcagtcctgtgctccttagtcctcacactgcctccaagataaggataagcagcatcccttgccatttccattagggtgggtgggggagatctgcctggccatttgaaattccctggttatattctattaaagtcagcgaaaccatcatttgttaaatatctaaatgttcctggtactattccatgtcttgaggaacggggaagtacagtccagcatgggagactgtaaggtacacagatttctcattatgccatggtactattgttcttctcatgttatggaaaatgaaaccgacgcacagagaggtagctaaaaatgttatgtgagccctaaaggggagagggctaggaaaggcttttgggagagatgtttaagttgtttcttaagggatgtgggagaggattttggtggaaagaggtggaagaagacagcatggcatgtcaagaaacagcatgagaaatagcatggattctaggacctcttgttaatattgtctttttaagtgagaagtcaaaatccattctctctcccagtatttctgcaagatctaacctaaaaaagttgaaatttgtaatcctggaagtttcttcttgttctagttctctgctttggaggagaaacaaagaaaaaaatattagttaaaaaagggctttgtgagtgtatttatgaataaatgatgcagtaagaaagagtggaacaatgggttttaggcagtttaattttgaagtgtttataacttttgttgaggtgaagccttagaagagcaacagagaagagagtcttggagactcctatcccacgtaacccccaccccaacacacagcacacatgtacacaaatgcatgcatgcacattgtcacctgaagatgaggcatgcaacactcttagctcccagattagagtgtgcagataagcggtgtgtgttgaggattgattttccagtgttacagccataagtatgtttattgccgtcctccaaactacattgaacacactaaccaccaccacccatcacatacacacacacatctgtcctctataatttttgaaccatgattagtactgcttccatgattcattttctatatattttggcaaaaaatcgatagtgtaaaaagagtgaacaaatttatttaaaaaaaatttgagtgccctgttccatgatacaatttaggatattcctagattgtaatataggaatatcctaaatttaggatattgtatcgaagttcaaaaatgaaacatagtctaatgtttcttgaacctcaattctgcagttggaaagtttaaacaccttgttatgaactgaatgtgtcctcccaaacttcatattttaaagccctaacccccagtgtgatggtattgggaggtaaggccctcaggaggtgattgggttcatatgagatcgtgagggttgggcccataatgggactggtgtccttataagaagaggaagagagaccagaacttcctctctctgccatgtgagaacacagccagaaggtgggcatctgcaatccaaggccctcaccagagccctcaatccagggccctcaccagaatccagggccctcaccagaatccagccatgctgacaaccctgatcttgggcttccagactccagaactgtgagaaataaatgtttgttgtttagccaccagatttatggtattttgttatggcaggccaagctaagacataccccaaagtgttttactccctttgagcttataatttacattaaagaaaaaagactcgtagctttaatgaggcctgcttaagcttccttattccaccccttaaaactcattttaagctgtgtgggcatgatggctcaaatctgtaatcccagcactttgagaggttgacatgggaggatcacttgaggccaggagttagagaccagtctgggcaacatagcaagaccgtatctctacaaaaaattaaaacaaaaaaattagctgggtgcagtgacacacagctgttgtctcagctactcaggaggcttaggaaggaggggcatttcttaaagcccttcagatccttcagttccaccctttaaaaactcattttaagctgtgtgggcatgatggctcacacctgtaatcccagcactttgagaggttgatgtgggaggatcaattgaggcaggaagcacttgcctctgcctcagtgttttcatctgaaagttgtgaatttgctcttagtactttgtaaagaaattcaggaaatagcatgtcttttatccattggtggaagagaagctctattatacccagaggcatctaattttcttaaatttggtgtggagaggtagatatttatatgtaaccattgaaatgatcatttgatactcttcgggaaaaagaaactagttgactgttgcttggtgtctttatgaaaatgaaatacctgggttataactttgtctatttattttttaatcagtaagccagaggaaagggagatggaactttaattgctgaaattcccaattaaattcttaatggcacaaacatctcagaatgtttcaaagtttcatttggcacaaagacaagtcactcagacactttttcaaacattgggtcaagatgttggtctggacacctcagagaataaacttatgaagactcaaacatggagaaaaggtgttccctgtagaattctgatacaggcatttcctatgggaactgagatttgtgaaaaaagataatttagcaagtttgggtgattttgtcaccaaaatgagtagactaaaatgaagctacttttttttttttaaagagaagttttatgtgtgggtatagttcctaggtcggtccatgttttaacaaatgctggaaggaagagaaatctttctgatttctgtgcctccgtagggtaccataatttaatgtagttggtggcaccagacgctggtaaccgcagccagccattatgggcaggggtttcaaacatatggcctgtgcattacacccccatccccttccctccatcaattatttttatattggatgccaacttaggaaatgcctggctcttgatgcacactgccagcctgttaccagccagcccccctccttctcctcctctgccatatcctggaactcttcaccctcctaggccagaatcgcatgctgagcccttgtggtgaaccaagcgaggtgacacatgagaagatgtgggcttggtggcaccaagggcctgccctttctgtctccaactcaacccctgctcagcgtgcatgccctggacctggccagccattgtgctcggtttctccagcacagctctctgctgggctgctgttagagtcgcacagtgacctgcagatctaagggaaaaaacagatgtcccaataaatttttgtcaaaacgtaattacctcgggattagaaaaccacatgggggtggggagggaaaggaacagatgtatttccttcaaatatgcaatcattattctgcagaagtttaaataatcaagaggtttaaatgatggcagttgagtgtcttctctcctccccctgcctccacccccgttctggttcctcctttaccttcagctctgggcagtttgggaagcccctcctattcgctttgcatggatggagctctgagcaggagggggacatcttgcacaacagtatcatcctgaatgctttttcatacataaatctcagcaaatatgacaggctatctttcccgcaggaacctggccaagtcttttcttcctctccagccgacagaatatgataaactatgataaattttcccagtaaccataaaagattcttattttcatgatttgaactgttaggtacaggtcaaggcagtatatcaaacaggaattcttgaggggaaaaccttttttctgttttgcgctttcacattttgtcaagtgggaggggttggtgggtgctgattgaagagtcattcggttatttgttcactggttgtcataggcctcttaaggtgagatactgatctcttttaagtattcgcccataggcctaagtgaggaagttgattgagtgggaaacgtgtgaagccccacgaggtccaaggtttgaggaatttctgttgctgtagctcattggatggtgtctttattgggcagaggttgggtgaggtatctgttttcaagcctgtcttcaaaacaactgtagctggagcctgggctgagagacccattgcactcttggattataaaattctagttacaattttaaggcttttactgttataaaaaattgtttttgccttggaacatataagttgatattaagaatagttgccaattgttaagggcatgcttattgccaaggtctgtgctaagtgcattatgtataaactttctgatcctcctagaggcttcagaaggaagacattgttaccccaatttagagatgtggtaaccgaggctcaaaaatattaaataattgccatattcacaaacctagtaagtgagagaactcaaatttgaatccacatataaatgtctataaagacttcttctatccattggtttgttatgacctgggaaacttttatcttgcatgtaacataactgaataagctttgaaaatggaaattataaaccaacaagaataactcatgccatgctgttctggtcatgatatatacatcttctgtatgaagcaagagcaatggagcctcccttggctgacagtagacttactgtaggctaggttcttgctagctcacaatttggcccattatatttggtgcagagctaacatccttggacaggaaagagttaaaaaggaaatgttcagcaaggcagtgagtagagaagggttagttccagctgcttctggagatatctgatagagggagtcagtcaggaaaagtctctggggaaaggaattcagagtaatgggggtgtcttcctgtaagccgtcagcctgaaagtagtcttttcccacctaagtcctgagagatttacaaaactccttacttcacagcagcatgggaagggtcattttgcagagagaactaacaaaacacttttagcctggaagaagtgacaactttggagcatcctgcataatgtggctttataaactagcaaatagagtgttgaggaagctgtagtggctgcagtgggatgactgagaactctgcagttagttgatagctccgatttcaagaaaggatgagtccaatatgagatgctgatgcggacaaggtcattcacagggcaatcctgcctctcaagatgacaaaaggagatagcctaggacagaaccagagcagagactttctactactctagactcagcagatctagtgaggtggtttgtcctttttaaatttttaaatgaaaaaaactaacactacagtgacagtgtgcatatatttatacagaaaatcctcatcacataagaatttattaattagcttcctgaaattagaagttgtatagggaaatggaaagggaaagcaacaaacagacaacaaggacaaaataaacagttgcaatcctcaacacatgtaaaatctgcctctatctgaacatcatttgacacaagcgtatttcacattgatctcttgattggtcagtctcttacagcatccagcaataaaatgcaaaatataataacaatttctggcaaagttaaaaaccttgcaaatggtatgaaatttcataaaagtggtgttggagaactactctaatcacaacacttgagcatcaagcagtcctagagccttagatctcttctgtttatcacagagaaatatattaacaatgaatatctcttgttattgactgaatatttgtgtctcctgcaaattcatatgttgaaaccccagcccccaatgtgatggtccttggaagtgccgcctttgggaggtgattaggtttagatgaagtaatgggggtggggcccccataatgggattaatgcccttaaaagaagaagaacaaactggagctcactctttctgtgccatatgagggtacaacaagaaggtggccatctgtagttcaaagagagagccctcaccatccacccaccctgccagcactttgaccttggacttcaggtctccagaagtatgagaaataaattcctgttgtctaagtcaccaaacctatagcaatttgtgatggcagcgcaaactaacacacttgtggagaacaagaatttaatgagatggtctgtagttcctttggtttttatatttcactaaatatgtttggaataatgttaacagataatccaattcctcttttactgaaaaccactatcaagagtctgaagacattaaaaaatactctaggtctctgtctgttgagaggaatattacaggtcactgtttaacactagtttctttaactaccccaaacaaatgtccagttatggaagagtcagtgaaaactagaatgttgcttgcctgctgtttttctctacatttcattaacagacatcaaatgaagtcaagagtttaggcattggatccaaagaaggggaaatttgatctataaattatgctgctgtttcttttacttataagtcattgagtaaaacccatcagctatctgtgagactctctaaaaacactgttaatgccttttccaaaaataacattaatgttaattttttcttagaggtaacaaagttgaccgtaaaaggatacatgtttgaataaatactttagtctagattgccagagaagttttaaaatttgggcagtaaaggcaattctctttttttttttaaaaaaaaaatgtccagttttcccttccaaaaccttttttataaagcacactttaatttcttacccctcccaaaacatatactctcctttgatttaatttgccagaatctgattttcagtgttcttgtaaatttgtactatgaaagcaagccaaaaaacaaacaacacatacatacatacatacacgcacagccacacacaaaccccccaaaaccttctatgcttccctagctatgtctctcttgggaggacccttcattcaaaggagctttgacaacccttttaactagattaaagattctaacaatcctgtcttacaaaactacactttcaagctcctgattaagttaacttgggtaaaagtttctttgattagcaggaaaagtagcaacagtaaatagctgtagtcttgctagttcctaaaatggcaacagatgaatacgcctaggtggatgctgactgttgagcactttctatcaccatttcttcctaagaaacaagagttcattggtttctttgttcactcacaagagcacagaaagatcaaagcctcaacctgccttaagctcttggagtgttgcctcaggagggaacaagaagaaaaagtttccagagtgttcagaatgcaaataacattgacacctatttcagagtaagccctggaggagagaaaacttatcagacaaagcttttcttgcctaatgcttaaaggtgctggcatatttcccgctaaagtttaattcattttgaaatttcaaggactaagttcgatggtgtgaaatgggcatcgttctataagggcttctatgcgctttgttttgctgtttctggataccaacatcttggttataatgccagtccagggatctggcaatataggtgttatctaaatatcaagatatttagatcaacatctagatagtttttttatttggactttatgaaaccaacaaaaaggatatttagagaatgacagaaacaatattctgcagtgttccttcagtagaatttattgaagatgtacaagtatcacaaaataagaattacagaagaactcttactcttttttcttactcttttttctttttctttttctcctcttttttcttactcttgtaggaataaatgattgccagtgtcttctgtaatttagataaccatctttaacatctgtgtgtcccttgatgttctctctccatgttttgtgttggaatgtgtgctcacgttgtggccctttttaaataagtggcccttttaaaataggatgttgtagttttatttctgtagctgctcaaagtttacacttcccaccccgccccgagacagagttttgctctgttgcccaggctggagtacagcgacgtgatcttggctcactgcagcctccgcctcccaggttcaaacaattctcctgtctcagcctcccaagtagctgggattaccggcgtgagccaccatgctcagcgttttgtttgtttgtttgtttttgtatttttagaagagatggggtttcatcatgttggccaggccggtctcaaactcctgaccttgtgattcgcccacctcagctttccaaagtgctgggattacaggcaaagtttgcagtttatgtatagagtgtttcaattattttctacagaaggtgagcttctctggcaaaggcttaaggagactcaccagtatgtggtgggattatacttcgctgcctactccctcacagtcacgtggggcaatgtgactaattctagccagtgaggcatgagtagaaaaatcatgtgtcacttaaatgccagagcatagcattgcattgccattgttgaacccttctacttgctcttcttttgctacaatgaccatgggagcatgtgttgatgtggagggactgaaggattgaagctgaatggtaggctgaaacaacacagaggacacctgacttggagaggttccctgatcggcggcaaactttgcctaaacaagaaataaatatatgttttaagacactgagatttttgtgggctgtttgttatcacagaataacctttcctgttctgacctgactgatacagcttttctcaattgtgttctgcaaatatttgactgtttcgtctgttagctaaaattctctaacttgagagccactgctttctttcagttgtatttgctttcactttaggtacctgggtatggggcagatgaagacctttggtgaaaaggaggtaattgctcttcagagattctgctttaaacacagattttcccttaatcaccatggcactgcttgtgtaacactgtttggcattccgtagatgtgtattgacttgagtattatttttaaaccctcttgtgcttgatgtcatgtgagctccaaaggttgatttcttttgagtgtaacaggatcattctagatgaatactaatttatgaactctcagcccccttccacatctttttaaaacctaattccagatattcaatttctccttgggcattctgaatgcttaaatgattgtatatgcttgacgtgtattctatggcatggatgtggccattgccttatgctgttctctttctctgccctgctgtgttcagaaatgaagattttattaacaataatgagagaatgttaataagtactatggcgttaaagcagctactttgtagttacaagatgagaagctgctgttaacaacaacagcagcaatacaacaaacccacaacagtctacttattgttcaatagctcgtttatatgcattaccttgtttgacctaaagaaagagctagacttttactatcaccattaaaaactgggagttagaagtagtttgctttttagcaaagtagaactgcaaaatatgcctttagattgagtttttcctatatttgcttttcatattaatacttaacaatttacttctttagatgtaacaatgaaatagtagaatttttcagatgtaatctatatttcacagcctgagtgaggatcagttggcaatttatatctgaatcgaaatgaattataatcctgtatattgaggttttgtcttcttttccttcttccccacaacccccagctcacatccttgtctatcccaccataatgtagactccagcatggtttttcataaaatgtgaaacatgccttctaagctgtatgaggaaattctgactagactctagtacttctgggagggaagaaaaagaaatggctgtttgtaaagttgtcattctagatgagtcagactgaagaaacatccccaatgttccaaaataaacaaaagttgaactgatatatcttattaacattttaaaaagataagacaaattaatctaatttgaaatatgaatgatacactggttcaagtggtattttagtttttgtaagaaaactgtatgacttgtgcaggcaatctgtctttctaggtctcagtttcttcctctgtaaaaggagaaaattcaactagattaccagtatgggttctctagcactgatattttgttccttcagcattcaaagaatctaatggcacatctggaattgattcacaaaagaaagtgtaatcataccatttgcccccatccctatagcctcaaactactataccttttcatagtcacagaatatcccttctcagatgatagcataaattcagaagattacactgggcttctctgtaactttgctctaataggctaaaggaaattactccagttgaatttgcatgcttgcaaacaacgaatctgtgaaatcagtgaacttcacccaatatctttgtctttaaaaaatgtttcttgaagggcccatagtctacttacggccctggcataatttcattaatttatatggcaaaggaaaattgtttcttccttttgtctatgcagagaatactctaaatttaaagcaaatgtaatctagatgcattgttcaaaatgttatcctattatgtttcgaagggtacattttgactaaaactgtgacagttctgaaagatgctgtttcttttgataatttttggaagatgtatttttttcaatgttgaaataactatatattcactggaagttgccaaggaatgcacagagagacacaaactttcccatgtgttttccataggctatttgttggccacaatataagagcagacatgaatacatacaagaactaggaacattaaaaacataacatgatatacatttaattgtgctaactgaaaaacaagtgacagcattaaacctctgaacatagtagatgaaaaccatcttaagaataaattattgtgactgggtgctgtggcttacacctgtaattccagcagttggggaggccgaggcaggtggatcacttgatgtcaggagtttgagaccagccatgatgaaaccccatctctactaaaaataaaagcattagccagacatggtggcacacatctgtaatcctacctactcaggaggctggctgaggcacgagaattgcatgaaaccgggacgcggagtttgcaatgagctgagatcgcgccactgtactccagcctgggcaacaagtgagactctgtctcaaaaataataacaacaacaataataataatagattgttaaaagataactaacaaatatggaagaatctgagtacatggggatttaaaaatgttagaatgaaaatgagtaaaacagagtcatgtgctctgggaattcaaaacttaaaatacatcctgaggctattgtaaagaaacttaaaaaaaccccacattattaaaaagacacaaaaaaagaatcaggaaatgttacttttaaaattattccataaaccacaactatcctcaaaaagtcggataaagctgcgtcatattgttaacagcaatttcctctggattatggtacttgagtaagtctaatttcctatgtttcaatttctgtaatactccaattttattaaaaaagcaaacattttctattgttatcaagcaaaaaagaatctagcaaagaattatataaattatctacttcattggctttgtaacttggataaaggacaattcactctgccttctccagtgttgacaccttgcataactatagtacaatgccaaaaccagtcgattccattggtacaatccacagagctttttcagatttcactccttatacatagactcacttgtgtctgtgttcaatgtaatcataccataagtagcttcatgaaaatgtgttttaaaaataaagctataaagaaatttgtattgggggcatgtacaaaacatcaatagtgtttttctctaacattagcttcttcaacagaagttctgcttctgataatgattgaacatctcagttgatcagacttggaaagtagatcaactttgcagtgataataactaaagaagatatttgtaattgggaataaaaaactgttttaaaccacaaagttctaccaagacagccagtatttgtgggtttaagatactgttaaaaaaaaaaaaaaaggaaaaattgagataaacctggtattctaggcaactttttctccttgatatatgcacttatatataagggggatggggagaaatgctgagacgccaagcataaagcatctgtttaggccgggcgtggtggctcatgcctataatcccagcactttgggggccagggtaggcagatctcttcagctcaagagttcaagacctgtctgggcaacatggcaaaatcccatttctacaaaacgtacaaaaatcatccaggcatgatggtgcacacctgtggtcctgtgtacttgggaggctgaggcgggagtattgtttgatcccaggaggttgaggctatagtgagccctgatcatgccactgcactgatacagtgagaccctgttttttcctaaaaaaaaaaaaaaaatgttgaaagacccattgtttggaatgggagaaaatactaatttatactagattcctaatttatactagattacacatagtgtgatctttttttttttgttaaaaatgctcattgttgcaatcagaggtttctcttttttttaaatttatttttatatattttttattttttattatactttaagtttcagggtacatatgcacaatgtgcaggtttgttacatatgtatacatgtgccatgttggtgtgctgcacccattaactcatcatttaacattaggtatatctcctaatgctatccctccccactccccccaacccacaacagtccccggtgtgtgatgttccccttcctgtgtccatgtgttctcattgttcaattcccacctatgagtgagaacatgcggtgtttgattttttgtccttgcgatagtttgctgagaatgatggtttccagcttcatccatgtccctacaaaggacatgaactcatcatttttttatgactgcatagtattccatggtgtatatgtgccacattttctttttttttttttgtattttctttttttttaaattattactgtactttaagttttagggtacatgtgcacaatgtgcagggtagttagatatgtatacatgtgccatgctgctgtgctgcacccattaactcgtcatttagcattaggtatatctcctaatgctatccctccccgctccccccacccgacaacagtccccagagtgtgatgttccccttcctgtgtccatgtgttctcattgttcaattcccatccatgagtgagaacatgggttgtttggttttttgtccttgtgatagtttactgagaatgatgatttccaatttcatccatgtccctacaaaggacatgaactcatcattttttatggctgcatagtattccatggtgtatatgtgccacattttcttaatccagtctatcattgttggacacatagtgtaatcttttaaccactttaaaaagggtaaactaacaaagcttattaataagggggaaaataaaataataaaatgttaattaattaaaaagaaagccagaaagtaatgaaaaataaacataaaataggtagaaaaaagaaaagtattagatgacagattcaaactcaaataaatgaactaatctccaattataaaatagagattgtgaccaatttcatctcaatagttctgcttttttatccttcttttgtagtttttcaaatttggatttttcccttcttccagatttttaagagagtatcctctcctctcttagcttgtcccggaattcctttgcttggtgaaatctaatctatgagacagaacaggaaaatgggaggagaacagcattttgcatctatctacgacactttggcagtgaacatggaaaaaacatctctttacctccttaggcttctattccttcatgtaaaagataaatccaccagaatgaattttctccaagcctttttcaggcctaggatccctttaagcctgggctctgtacctatgccatggggctaaagtttatcataatctcttatattttgaatgcttttaagaggaagtgccaagaaacttaaacttcaaatttcatccatctctggtcacatattctgtacgcacaatacctcaaatacaaaaaataaagatgaactgtgtggcaggattgtggtaagaaggtaagacatactgtggtggagggattactggccctgggttcaggagaactaggttctaagctcgattctgctcttaattagccatgtgatattgggcaagtcatgtgagttcttagctttgccagagaataagaaaagtatattggaaaacattttatatgttatataaaaaaagaacaagaacaataaaaattaaacgttttattacaaatgagttcaaattaaaatacatgtaacagattagaaaacgatttgcaacatatctaaaggacgaaggataaagttctaaaaaatatacagagatattacaaatcaataaaaaacaggcaaataaaccaatagaatatcaatagaggatgtgaacaggcattttgttgctaatttcagactttgggacaatgttacgtgtagaaatgtccaataggaatgttgttgttcatcaataaccatattcctgctgtcagatataagttcaactcatagaatatataagtctattaactacagtattttgattcaaggaacttcactctggtgttgtatgaaagcaatggaagtaggaacaagaggcaaggatgaagactatacttgctctgcaattttagacattccactgagtcttatctccttccctagaaaactgtgtgtataataatatttgctcaattttcctgatcaaagacaaaaataaataagaaattgctttgtattttacagatacaaagcgttattattattgaaatattttataaagtaaactctaaagaagtctacaaatgtgattggtgccagttacaaggaaccagaggcgagaatgggatgattgttttctgttcaccagttactgtgttccaatatcctaactctgccaatgagatatgtgacatgtcaaaaagtggctgtggctgggcgtggtggctcacgcctgtaatcccagcactttgggaggctgaggagggtggatcacaaggtcaagagatcaaggccaacatggtgaaaccccgtctctactaaaaacacaaaaattaactgggtgtggtggcgcgacctgtagtcccagctactcgggaggctgaggcaggagaatcgcttgaactcgggaggcagaggttgcagtgacccgagatcacgccactgcactccagcctgatgacagagcaagactccgtctaaaaaaaggaaaaaaaaggtggctgtgatgcattttttcttttaatgttcgtatatacttgttctgctttatattcccctgcatgttcaagaacttaaaagttataccagtaatccaaatatatattcttcaaataaacaaactaaactaggcagaataaaaagcaaatgtttccttcatcctttctcatccagcttccccctccttggagaaacatttggaatgcatctttctacatcttttttcatgtgtttatataagtatttaggtgtttttttcccacaaaagtaatcatactgtacttgtgttctgcaacttgccttattttgctggttaacttaagaacatgctttacagatcatttaagagtagtaaatacaacatatttgattattcttaattgttgcatattattccataaaatagatatactattaaggttattaaagatgtttcaactaatagatgcacagttaggttgtttaaggtttgtgtaattatgtgagagtatttttgaaggagagatttctaagaatgtaattgatcaagcaaatatttattacatgtaattagataaatattgccaaattatctcccaaaggcagagtttaggttttccaaattgcactcccatcaacgaaacatgaaatgccttttctcccacaccatcacaacaatgcacattctcaaaatttaattttggctcatttgatgagagaaaataactcactggttaatagtgaagtgaaacaaaattttacacatactttctatatatccttgcgtttcttcttctgtgaattgcctgttcatatccttcacctgttttctgttggatgatttgtctgcttcttactgatttgttaaaatctctttacagtttttgagtctttattttttgtcccttatatatgttgcaaatattttttcaacttattacatgtgttttaatttattaatgataccacttgtcataaaagtttaaattttcattttttgttctttttttgtgacttctatgttttccagtgtgcttttctaatatttttattgttttgttttgtatattaaggaatttttttagtaatctggagtttatttggggatatgataggaattataagtttaactttttttcccaaattgatagcaaattatttcaacatggttataaaaattaatttagtcctttctatggttgttgagtatagcattttgtatattaaatttcaatgacacatgattctatctctgaagctctctattctatttaattaatctaattgtgtaagcttgcattataatagttttaattatgtgtcttttcttcttgaaactttgaaaatttatctttttcttaaataattttgccatcttttagatcaccgaacaatttttctcctttaatctattaattttgtagaattatagtaatggagtccctgatgttgaactatccttacacctctatgaaaagcctgtttggttgttgttttcatgcaatgctggattagattttcttacaccaaagatttttttattcatgtaccaaatgagattggcctcagagaaagattcctccaaatctttctctacacgtttgcataaatggctttatattttaaaataaagattattatactagatttttggattgagctgggaagttttccatctttttctatgctttggaaacaattatacaatatagcaatgatctgtcctttgaaagttagatatatatacccatgatgttgcctgggctaactctagttttagagatagattttaattttgatagtaattattacattttaggtggctatatttaaatataattgcttggttttgaatgtttttatgttttgtatataaatgctgcttaaggtttgctggtttcattgctttactagccagtacatctcctgtaaatactgtactgtgatcttaccacttctccatcaattgtgtcacacaaagtaactcaatataggactcatactctggagtaaaacaagccttaaaccttttagtcttcattttctcagtatcagctttattatcattatttagtttactactactgttttcagaaaaaaatggatcttttcttgactctccttcccccaaaatgtcactgaagatcaccttaactttagtatattaaggataaaaatataaatattacttccccaatttagctaataatgatgaaccataaacttaaaaataagcttgattaaaaatgaaagtggttacaaaagaacaaattataaaagtaaatacatgctttgttccacaaatttttatatgcttttggcattcagttaatgaactaacaaaatgccaagtgttgtcacatgtcataccacatgtgattcatcatgcaatttcaacaacccagctagtttgtacactgttcaaggagatttattgcctgatcatggtcttggatgttgcagcaaagtcaaattgtttctaaatacttacttttactttctgtatttgttgtggtccagtagtaatgcatttgtagactggcaccagaatgggggccaatgttgtgcagtactgttgtaggtcgcccctttaagtggtagaatcaagattccaaccaaggagtgtgcactgttctcttgctttctcagtggggtgcttttggactccttggaatcctactctgccatgattagctattttgtttccagctccttccatgtacacaggcttggaaccaaccagaccctctgtaaaaagttcagccctgttatgtccttttccctggaggtcatcagatccccttaggtgaacatctggggacttaacttgtttcctagaccattattagctggtggcaaatactcatttccctttctctgaatttaaagccaaagacaatctccatctactacttgctcaaacggggttctagtccttcaactcaccatggaggagatatcagggattccaacagagagagaaagcattactagtgatgcttaactgtgcctcttgttatcaattttcttttcgagatagagtcttgctctgctgctcaggctggagtgcagtggcgcaatcatagctcattgcagcctcgacctcctgggctcaagtgatcctcctacctcagcctcttgagtagctaggactacaggcatgcaccgctgtgcttgggtaattttaaacatattttggagagacaggatcttagtatgttgcccagactggtcttggactcctggtctcaagtgatcctcctgcctcagtctcccaaagtgctgggaatacagacatgagccaccgtgcctgacctgttatcaatttcttagtaatagaactatgaaaatgattagatgttcgtctctttattcagcacccatttatagctgcttagtcccaccctcccgtgattcttcccttagaaactatgacctttttgcaatcttttctttagaagcagattcactgcaaataattaaaaactcaaaattttgattagacttcatgtttggtaggaactgtttatttatttttcctctcacaatatctaataaatatttatttttatctaataaaactccaaagatatatttaggatagagaatgaaatgctgctgaccaaattagagtccttcagattatttaattcaggctagcttatttcaaagcagtggccatcaggaggaagaggctgtagataaatactgaatttcttaaaaagtaattgtgtgcctcatccttccctttttaaatcacagaagtaatgaatattcttgagaaagtacaatatattttactaagaagtaaaagggaagtaagtttaatcatcctaaagctaccacccagaggagataatttactatataacctgccagaaagtttgtgcaagtttacctataaatatactgaaaagtgtccatttcctctgtgtgtgtatttgtatcctgaatttttcactcacgtatcagtaaatacaagtctgcttcataatggtgacgtgccattccattgtgtgagcgattacaatttatatagccatactcctgttattggatgttacattgtttctaatttttcactactttaaacgcactgtaacagaaacaattgaagcattttgttttaaatatttggtgctaattatataatgcatctctgggaaaggaggatccactcaagctattaagaactcctgctctattggcgggattcgatgacaacatgtctcacaggaagttctctgctcccagacaggggtccctgagcttcctgcctgggaggcatggcagcaggcatcatgggaaggtgaagagcttctccaagcttgacccttcccagtcagtccacttcatggtatttctggtttacaaggctggcatgacctacattgtgtgggaagtctgtaggccaggatccaaggtgaacaagagggaagtagaagctgggccattgtgaaaatgccacccatggtggttgtaggaattgtgggctatgtggaaactccttgaggcttccagaccttcaagaccacctttgctgagcacatccaggattagtacaagaggtgcttctataagaactggcataaatctgagaagaaggcctttaccgagtactgcaagaaatggcaggatgaggatggtgaaaagcagctggagaagaacttcaacagcatgaaaaagtactgccaagtcatctgcatcattgctcacacccagatgtgcctgcttcctctatgccggaaggcacctgatggagatgcagatgaatggaagcactgtgaccgagaaatgagagtagtcccagaagagtctagagcagcaagtacctgtgaaccaagtgtttgggcagtatgcaatgatcaatgtcactggggtgaccaagggcaaaggctacaaagtggtcaccagtcattggcacaccaacaaactgtcctggaagacccactaagggctgcacaaggttgcctgtgctggggcatgacatcctgtccatgtcgttttctctgtgatatgcaccgggcagaaaggctgctaccactgcactgagatcagcaagaatatggcaaactgattaagaacaatgcatccactgattatgatctgtctgacaagagcatcaatcctctggatggctttgtctatggtgaagtgaccaatgagtttgtcatgccgaaaggctgtgtggtgggaaccaagaagtgagtgctcagcctctgcaagtctttgctggtacagagcagtgtcctctggagaacactaacaccacctccaagttggccatggcggcttccagaccctggaggagaggaaagcattcatgggaccactcatgaaagatggaacagcagaggaagaaggagcttaatgtcaggagcagatggcgcagccagtggggtatcaatagaaattatttttttctactgaaaaacagaacaaaaactctgaatcataaggttggttgatgtcattcattttactttgtgctttataacttccatttataaaacaaaacaaaaaacaaataaaaatactccaaaattataacaaaccactccctatatctagaactgcaatatgagtttgaaggtgggcaaacctgttccccagctactcccacccataattctccaccccacattctcttacgctatctagaatcatgtggccttaatttttaatcatttttttctccttaaaaacgaagagataagaaaattcaaagcagagatttgatatacaggtaccttgttttattgcacttcactttattatattttacagatattgcattttttacaaattgaagtttgtggcaaccccgtgtcaagaaagtctactgtgtaccattttgccaacagcttgagctcacttcatgtctctgtgtcatatttggataaaccttgcagtatttcaaatttattattattatatctgttatggtgatctctgatgttactattgtaattcttttggggtaccacaaatcacacctatataagatggtgagtttaattgataaatatgtctgtcctgactgctccactgactggcagctctccatctttctccctctccctggattttcatattccctacaacataaaatattgaaattaggccaattaataacacaacaatggcctctaagtgttcaagtgaaaggaagactcacatctctctcactttaaaccaaagctaaaaatgtttaagcttagtgaggacagcatgttgaaagctgagacaggcagaaagctagggtttttgtgtcaaaaagttagccaaacggtgaatgccaaggaaaaattcttgaaggaaattaaaaatgctactctagtgaacacatggatgataagaaagcaaaacagccttattgctgttatggggagagttgtagtggcctggatagaagatcaaaccagccacagcactcccttaaaccaaagcctaatccggagtaaggccctaactctcctcaattctatgaaggccaagagaggtaaggaagctgcagaagaaaagtttgaagctaacagaaattggtgcaggaggtttaaggaaagataccatccccataatatgaaagtacaaagtgaaacagcaagtgttgatgtagaaactgcagcaagttatctagaagatccagctgagatcaccaataaaggtgtctacactaaacaacagattttcaatgtagatgaagcagccttctcttgcaggatgatgccatctaagactttcataactagagaggagaagtcaatgcttaccttcaagggacaggctaactttctttttaggggctcagtgcaactggtgacattaaattgaagccaatgctcatttactattctaaaaatcataaggcccttaattattatgctaaatctactctgcctgtgctctataagtggaacaacaaagcttagatgacagcgtatgtttacagtgtggtttactgcatagtttaagcccactgttgagatctactgcctaaagaaaatattccttttaaaatattactgcttatttgacaatgcaccgggttcagccaagaactctgatggagatgtacaaagagatgaatggtttcacgcctgctaacacaacattcgttctgcagcccatgaatcaaggaataatttcaactttcaagccttataatttaagaaatatgatttttaaggctacagctgccctggatagttgttctgtgatggatctgggcaaactaaatggataaccttctggagagacttcaccattctggatactattaagaacaatggtgattcatgggaagaggccaaatatcaacactaacaggagtttggaagaagtttatgtcagtcttcatggatgactttgaggggctcacaaatttagtagaggaagtaactgcagatgtggtggaaagagcaagataactagaattataagtgaagcctgaagatgttactaaatttctataatctcatgataaaatctgaacagatgaggggttgcttatggataagcaaaaaagtggtttcttgacatgaaatctccttgtgaaggtgctgtgaacgttattgaaatgatagcaaagaatttaggatagaaataaacttcgttgataaagtagtggcagggtttgagaagattgactccacttttgaaagaagttctattgtgggtaaaatactcttaaacacagcagctacagagaatctttcacgaaaagaagagtcaattgatgtagcaaacttcagtgatgtcttagtttaagaaattgacgcagccatcccaaccttcagcaaccaccacactgatcagtcagcagccatcaacatagaggtaagaccctccaccgtcagcaagattataacttgctgaaggctcatatgatcattagcattatttatcaatgaagtatttttaagttaagctatgtgcattacttttttgggcttaatgtcattgcatacttaatatatagtacagtgtaaacataacttttctatgcagtgggaaaccgaaacgtttgtgtgacttgctgtattgtgatatttgcttcgtcacagtggtctgaaaccaaacctgaaaaatctccaacgtatgcctgtactcagagcaatttaacaaataaataattgggtgctcatcttgtgaggatgctaagatgaataatgggacaagaagctaatatttattgtttcctctgtgtcagcttttaaatattcatattttactcagtcttcacaatacctcttcaaagctggtgtcccagatgaggaaactgagttctggggaaatcatgtgatttaaccaagatcaaatctagtaagtgacagagagaaattggaacccagggcttcgtggcttcactattacctctttcctatggataagcacagcacttaacctcaagagttcactaaatggtggcataatgaagaagttatggctgactataattcatttgcctacatgcttgtaacttgtctgtttacttttctctaatgtgaggggaaacccaggtagttccttactatgaggaaatgctattctcaagcaggattgaaacggaaatgattataatgaaaatatgtttgtggagacaatactggcatggcgtagcaaatgatgtatccatgggagacagggactttcaagaattataaaagcaatcttaaaaattagtcaaatatatgtggtcaccacttattcaatgatgagaataataataataataataatttttaaatccgccactaccaccagtaagaataatttgctcaccatcttctaaagttggaaaggagtagggatcagatgaagtttggaagtaatcagcaagcctcggatggtttaaaagggtcagttcactttaataagttgggaaacacctttagtacatgatggtatttttttttcttttcttttctctgttttttttttttttttttttttgagatggagtctcactctgttgcccaggctggagtgcagtggcgtgatatgggctcactgcatcctccacctcctgggttcaagtgattctcgtgccttagcctcctgagtagctggggttacaggcaccatgccaccatgcctaccatgtctgccaccatgcctgcccccatgcccagctattttttgtatttttagtagagacggggtttcaccatgttggtcaggctggtctcgaactcttcacctcaagtgatctgcccaccttggcctctcaaagtgctgggattacaggtgtgagccactgtgcatggcccatgatggtattttcatttcagcaacca

SEQ ID NO: 12511 - DNA, 100463 bp, Human
  misc_feature (1)...(100463): n = A,T,C or G
cccaagatgcatcctgttactatagccattttacagatgaggaaaccgaggttccaagaggggcagtctctgctctctaaacttcaccttccaaaggattctaagctgctgaatgaaggctgcaggcagggtggtctgtacaggggagggagggtggaaggcacggggtctggaagtctaggaggagtgtctgaagtcaactgcaacttttaaatatctgtgaattttagatttcaccctgtatgtgtccctagcgtgttttaataaaataaattgcttcacgttatattggtatgtggatttccagatacacttctcaccatttaattcaaatgctccccacagctgcacagtgggtttaaaatacacagacacacacatttatggaccgttcgtgatgtactaagcactgtttgaataatgtcaccgtcatgcagaggggagcctgtggggggcctagggaacctacgctgcaggaattctgctccctcctagtttacctgtcagaccctgggcaagtggcttccgttctctgggcctcagtttcctctcctgtaatgcctgaggataatgggtgctggtatcttctgcgcccctgggcctggggcacctgccccagcttggtgagagggtatcatttgtccttgggaagctcagagagatgaggtgaaatggccaagctttctaagaatgtgtctttagtgaacatttgacccaaggtcaaggctctgctaaggtcattgtccttatccccagcaatcccacaggatgggcatctttaagccactttataggggagaacccttgggatgggaatgagagacacagcagcctctgagctagcctgggaggatccagggagtgaaccgggggagggttggggccctgtcatcagatgccctgggggctcagacggaggcaggccaggtctctgccctgttacgtctagaaggagaacagaatgtgggctccaggtccagatggcctggctccaagccacacttgccatacctcagtcttgagatctgtgaaaagggcacacccctgaggcaggtggaaattattggatacccagggggaggctgcaagggtttatctggccagctggagatcccgcctggacaccgtcctcctggggtgctggagagacacacaggcgaggccacccctcccctgccccttgggtgctgggtgaagagagcaaattctggagcctcccgtgttagcctgggcccttctggccaaggaagggacagctgcacacaagcccctctagctggggacccgcagcccctgcctggctctggggggagaagggagccagggtgctgtgggaccagctcaccgtgcacccagggtcgtacatctttaaggggaaagaggcgcgctggccggcctctgcgcacgtcacttcttcattccttccctcccccctggctctttcctccaacttcccggccagctcgggggtgatgggggggtggggagggggggccttaaaaatccacccctggcccctcaatgtccagaaacaaccctgtcccccctctccgcttgatccgaattggggtcgccctgcagtcctggggtcctggtctagtgccctggggcattgcgtaaatacgggaggagcgggggggtcctgagacgtcgggggaggctctcctttctcgctcgcgcccttttttccctcgtttctttgaaagttgggtgttgagaagtgggaggttcggggtgggagggggagggtgtcagagggtagagagagagacagagagacagagacgggggagagaggaagagagagacggagggagagagggacagagagcgaggcgggcggcgcgagagagggagagcaggagggaggaggagggagaccgagggaggaggcggcgaggagagcgcgccggccgcggggcgggggggggggttggggggggcgggggggtggtttggaaaaatgactcagtaagttcagcgcgcccgctccggccggccctgcgcctcccgccgcgcccgggatgtattcgtccccgctctgcctcacccaggtacggtcctcgcccggccccccgccggcgcccccgcgccccccgcatcccagccccggagttttgaagcaggaggaggcgggacgaaaaaggcgcgcgtccctcccgccatccctgcccgtgatgccccccgcgccgagggctggggtccggtggggggatgggtcaggctggggtaccccccccacacccttacctaccgcggaccccctacgcgggactcccgcccagcacccccaaccccgactctcgggacctctcccggatgtggggcttggtctgcagatttgcgtcccccccccacacaccgacgcactccgcacccccgccccgacactcggaaaggtcggggtgggggctggcccccctccagcaagggctctgcgggaagccccccgcctgcctctgagaggaatctagggggtcgtgattggaccctgggtctccccagctggagagaaagggacctctcatgtgttttccccgtgtccccccaccaaggttgtgcgggccgccctggccctcggtcgcctttccctcgttattggcccacgtgtgcatggagggggagggggcaggagaagttggaggcccaggagggggaagggtgctccggcggcccggctgggtcccccctcctttgcaagccccccagcaccgtcccggtattttcgctgcatcgattctggattctggattctggattctggagccgccgccgggaggagcgggaggcccggcgctccgggtctggcccgggcactgcggcgctgcggacgccctcgccagcccggcacctgccccgtcccctccccctccccctccccctcccgtagcctctcacccctggccgcactcccagactgccccggggccgagccttgtgcaatggccgagggggtgtgtggggagggggcggctccccccggggactccttccagcccaggctcccggggaccccgaggtctgcaagttccgttttctagaccgctgctttcctccttacgcagtgtgtctttaggctggagaggttctggcctcagtttcccctgaagtgaggtgcggctaaggccggttctagagaggggacagtatggcgggcaaactgtaaagtcccggcacgtggggggtgcgattccagcgagggccaggcccgtcttaagaagcactgtgtggggagtatatgagtccccggcttccgctccagggcatggtgcagtgagggaccccccacgccaggcatgctccttggtagggtctttctcaccggccccctgcagccgacagggaatgtgggagctggtgctgagggggtctgaggtctgtcctacctgtgatcccctgagtgaccttgggtaagtccctgtcccagcctcagtttccctttctgagcagctttggggggggggttcccgaagaaggcatctctttgaagttctccaagaacaactagggttcgagtgggcacgctgtgtgacctcgggcagcctttgaagtctctgggcttgtggggtgactgaggtgtccccgctctgtcctcaccagctggaaggagccatttgggagggctgagcggaggggaggctgttccaggctggggaggttggaaggctgcctgtgcaccctggaattcccccatcagggctggttgggagacatcctggttgctggggtgggttgggggttagtaagaaccccagtccaggctttgcctcagagaattgctaactcggcctcagtttctccaggaacagggcaaggaccagccaggagggctgtctgtggaaaccaaaaaacggagaggctaaaaactaaaaactatccaggggtgctgcgtgcaagagacacagatgagaagacagagacaggcagagagacagaggcagagagctcccaggccagagtggggacagcgagtcccaagtgcagggggctccctcctcccctgcgattctcctctctgccccgccctccaccccagccctgtagtggagctggggaccccctttccagtttgtcttcagcctgaatgtaatccccactgttcccccaaggcccagcctggtctggggtagccagtggggtgggctgggggactcagaaggaccctgagtgccccatgcaggagcctcccacccaagtcctggctgcctgactcagtttcccgaatcacgtcccctccgtttctctcatcttggtctctttttgtctgtctttctctctttctctctgtcttgctctgactctgtgtgtgtgtgtgtgtgtgtgtgtgtgtgtctgtttctccctgtctctccatctctgtctctccccgcctctgtttcactcccagtcactgttggtctctttgtgtctctctttctcatcctctgtctctctgatgtctcagtctctcccactgtctctgtctcttcatgtctatctcaccatccctttctcctctttgtctctgcatgtctctttgatgtgtctctgtctctctgtctctccctccctttgccttctttgtgtgtctgtccgatgtgtctctgtctgtttctctgtctctgtctctctgcccccttcctctctgtctctgtttctctccaatatgtctgtctgtctcttcatctctgtctcaccttccctttctcctctgtctctgcgtgtctccccttgccccctctctccctgtctctctctatctctgcatgtgtctccttactcctctctctctgtctctctctgtctctgggcctccctctcccccttttcccagctaattttacaacctgagcccaaccgaaaatagctcccttttagctgatccgacccggatccttctcgggagccgaggctggcggggggtggggggcatctcggtgccagcccgctctgtgccacccgggcccggcccgccgaggggggagtgggtgctggcggccctggggcattctgggagccccgggccgggctcagcggtgactcaagcgctttttcacttttactcttaagaggaactgtgtggagcccatggctcccataaatcctgccggcgggaaggccggcctccccgcgcctgctctgggcctccctccctgcctccctcccgctggcgccaccgccacgttagttattccgggtttggggccaagtccctcttggccgcagcgtggcggattccccgagccacctccatcccgccaccgggtccctgtctcattcgttcattgtttccttcattccttcgtcccatgccctctcggagcacaatgtgctttgctgccatttctccagcagggtaaccgaggctgggagaggctgtcctcccaccccagacccccgacctttgttggattttctagatcttccttaagcatctcctgggccctggggataggtgggggtgggggaggcagcagggcccaggcccagtgtaggttcttagagggagcttggggggtgcctaccaggagcagggggcctgcagcccctcagtgccgggagaggggctaagagtcagagagggccagggcctgcccgaggtggcacagtggggctggcagagctggggttcaggccattttccatctggcggcttgggcaggtgggcgctctctccccgtgtgccccccacccggggcctggtggcctctgattcactctctacaaggctccaccactctcccgctgtatctccctctgggtctctctgtgcatctctctctgtttctccccctcccctctctgcggcggaggtgcctctgcgcgccagggccaagcgccctgtaaatcaccaaagctgggattctggcagagtcagcgttctcctctctctctctctctctctctgtctccctccctttctccccccatctcgctctctcctcctctctccctctctccttctctgtctccctttccgtctttccctcttcctttctctctctctccccgtctcccttctctccctctctccttctctcttctctctctctttctccctccctacctccctctctgttcctcttctttctctctgtctgtctctctctttctttctccctcccttcctctctctctgttcctcctcttctttctctctctctgtctctctgagctggcctccctccctgtctcacaccaaatggatgggaaatgctgcctgggcctcctgccccggacacggcccgccccccactctcctgcctgtgtccacgccgacctcacctgggtgcccatctgccctgagcacacagcgtgcgggcacccaagtcctgaccagttcacatccatgagcacacgctgggcgcacacgcgtgcacactccctgacacccatacggacgaggacacagctctgcctgcctcggatctgccttgatgggggtcaccaacacacagacctagagtgcccctcacatctgcctgaaaatcttgctcaggaggtgccaaacccaatatagtacctggtatagagaaggtgccaaataactgctatagagtggtgccaaataagtgttgctgtgcttgtgattgttgctaaactaattctcctctttcctgactctggtgggtgacctgcccccacccccggaccgtttcttgccctgaaatgaagtcagcagaaacccccacttcctcagggctgctgcagattcagggaggcagcacaacttttttttttttttttttttgaggtagagtctcgctctgtcgcccaggctggagtgcagcggtgcgatcttggctcactgcagcctccggggaggcaggacatttctgaggtccacagtgcagggcttggtactcagtaggtgcccaataaatacctgttgcatgaatgaatgaatgaatgaatgaatgaatgtttttggttgagaggcgggactttggtcttcccgagcctccatttctccgccaacataaaataaaaaacataatggcactttcctcagagacatcgatgtaccttagtccgacacctggtatacagtaggtgccaaataagtgctgctgtgcttatggttgttgctaaactagtaattgcattgaacaccccagaggcattttccagtttccctcccttccctctgtgtgtatttgcgcagcgtaagcccagctttgggctgggtgacaaggacagtggtgacctggaaaggcccaggctcagacccctctctactgtggcatttctgttagtttttcttttctttcttttttctttctctctccttccttccttccttccttccttccttccttccttccttccttccttccttccttccctccctccctccctccttccttctttccttctctttctctctctctccctctctctccctctctctctctctctctctctctctctctctctctctctctctcggagtcttgcactgtcgcccaggctggagtgcagtggcgtgatctcagctcactgcaacctccgcctcctgggttcacgcgattctcctacctcagcctcccaagtagctggaattacaggcacgtgccaccacgcctggctaacttttgtatttttagtagagacggggtttcaccatgttggccaggctggtctcaaactcctgacctcaggtgatccacctgcctcggcctcccaaagtgctgggattacaggcatgagccaccgtgcccggcctctgttagtcttttctccctgcccagccctgtccagggtctccctgagtttgaccagccctgtgtgggtaccagccttccttacacatgggggtgcatggataaggggggtcccagaggcagaagatgggagcattgcttcagtggtctggatgctggagatgctaacagatcaaagctgtgcccttgtgggaccaacagtctaggccgggtcggggacgggcaggaaacgaggtgaccaggactccttgaggatgtggtgtgcgaccgacctcggggatcaaacaaggggaagggaaccacgtgggactcggagagtgtgcacggtgcagaccaggtgtcactggacgctctggcccgagactgtttgctcaaggggcccaggagtggggggggggggtgccaggaggcccagggaccagtcccagctcagttcctccctgactgtgtgactttggtggaagatttcatgcctcagtctcctcctcgaggtagtgggtgcaatgatagtccccactttcatagtagactttttttttttttgaaacagagtctcgctctgtcgcccagactagagtgcagtagcacaatctgggctcactgcaacctccgcctcccgggttcaagcgattttcccgcctcagcttcccaagtagatgggattgcaggtgtgtgtcaccgcacctggctaattttggtgtttttagtagagatggggtttcaccatgttggccaggctggtcttgaactcctgacctcaggtgatccgcccgcctcggcctcccaaagtgctgggattacaggtgtgagccacctcgcccggcccctatttcgtagtagacgtgatagctcagcaaacgctcagcctgtaagaggcacagcctcgctccctgcctctctcctccacctcctggcccctctggctcagccctcattgtcctcccagaacatcaaggcacagagggaagtaggggacccagggttcattttgctgactcactgccttggcagagagtttgaaccctgtggactcagtttacccaaattcctcactgtggcccacaaggccctgcccagcctgtccttgtcccctcctcaaccctcccctcctctctctttcccccttgctcattctgctccagccacatgggcctcctcgctgttcctctaacacgccaggtgcggtcctgccccagggcctttgcatgacccgtttctccatcagaaagctcctggcctggagtgccatctctcaagactttgttcaggtgtctcctcctgcaagagaccttcctggaccccccccccaagctaaaaaacaccccccaccccagagattctctggtccctcaaactcttaaatttcttcagagcactttgcccaacttgacgttttattacatattttgctgattttaaccatccgtccctgccccagatctggatccaggtgagggccgagcccaggtccctgccaagtccttggcaccctacctgggacccgcatgcagcaggcactcactaaatgtttgctgagcaacagaatgaatcttccctctctgggagccgttcacatgtccacaggctgtgattttctgagccaggggaaggagcggcccaaggttagagcctgacgctggtgccggatgggcctggggttgtccgtgggaccatggacaagtcatccgacccggagaagaaggcattagaactaaggctttgaaggatgcgtaggaatttgggataagtgctaagtaggtaatgagctagattctcatgaaggattgttgagtcacttttacttggaaacttttggtttggaaattggagtttcttgtcctggtttgctggcctggactttcagggtgggaggagcacagggaggtgagtgagggcatcacccagtgcatggcgtggtcgttcagcaaggtcttgggtccagatgtctctcccagctgctgctgctctctttggccaggaagtcccagtgggctaagctggggtttccaggaaagacctagccttgttccccttctccccatcaccttgcaaggaacaaggtcaccaggcaagctcccctgtctccagcaggctgcaatattcctttctgcccattgtacagaatgagagactgaggcttatctgaggtgatctgttccccagccattcagatggtgaaaatagaccttactgtcacccagccaccttctccgacagtgggtgcctcaactctgggcctcaggattggagagggagaggtgatagaactggatggtcctggctagatctgggaaaccctgggttgaggaggaaaggctgcttgaaggaggggacactagagatagggcgttgagggatgtgtaggagtttgggaggattttcagcatctagcttgtcttggttatctcttttgccggttgggcctctgagggcagtaggaggtccctggggaagaggccctggttattgcaggtcatgtgggagaaacagagtgacaaccggccaaccaggccctgcctctcacctggtctgatcccctggggaggacaagggaggatggggcagcaggtccatgacccagttacaagctgtttgtcttcctgcctctgtaactagccggggtcaccactgacgtgggcccccacccctgcccgcctccctggcacctgtccccggaaagggcacagagaaggggaggaacatagagaagggagggacagttagggaggaggaagggaactcagatctacgaggggccagatgagaaaaggaattaagaggagaggggaagtggggagggggaattcagagagagaggggggttggggagagaaggagttggggggacagtgatccctgcccccatcatggatgcctcccctgtcccttccagcagcctcttatcacagccccagtaagcgccagagcttgggtggcagccacggccccagctggacaacattgtccgggcctcctgcccgcctggcatctcctccacaggcaggtcctgcgcctctatgggtcctctctgccgcgtcccactgtgccccccaccacccccactgcccggcttccctggccagaccatctgggctctggtcccagctctgctgaccggctgtgtgaccctggacaaaccactccccatctctgggtctcatccagtcaggggcagggacgagattggacagggcctgggccgggccccctccacctcccctttgccttagcaggttggctggggaagcgggggcagcggaaaagggccctgaggtccggtccccgccgcagctgttacggtgactcacgctttgggggacattggggtgggggagcttcgctggtacaagctgactctggtctcactgggtggggaggctattttcagagcctcagtaataggtgaaatctgatgtcctgcccctccccccgaagcaccccacggccggaggtggcccaaggggacgtggagcacagagcagggagggtgatctggcagcagctgctctgcccatcccggcctggaaatgggaccgagtccagccacatccgctggcacacacagtgggagtccagggtcaacgtctccctaccttcctgagaccccaatcttacagagaacaggctgttctgagaaagggacccgtggccttccagggggtcagggccctgattcttatcctcacaccggccctgagaccctgtgggacctcagccaggtctccgcccctctctgagccttagtttccatgccacagaacacggagcggggcctcaggctgttccctgcttcctggaagattgtctgcaatcaaaatgatcatcgcagcaatcgcgtccatagtaatgaaaataccccagcatcttagaggggccgaggcgggaggatcgcttgagcccaggaattcgagaccagcctgggcaacatagcaagacccccatctctactaaaagtacaaaaattagctgggcatggtggcgcacctggaatcccagctactcgggaggctgagacatgagaatcgcctgaacccaggaggcggaggttgcagtgagctgagatcatgccaccgccctccagcctgggcaacagtgtgagacactgtctcaaaaaaaaaaaaaaaaaaaaaaaaaaaaaaaggaaagaaaatagaaaatatcccagtgccttaggaggccgaggtgggaggatcacttgagcccaggagtttgagaccggccaaggcaacacagtgagtgagactccatctctgcaaaaataaaaattagccagacatggtggtttgcacctgtagtcccagctactcaggaagctgacgtgggagaatcgcttgagtctgggagttcagggcccaagtgacctaagatcgtgccactgcactccagtgagacgcctgtcttttttatttatttatttatttattttgagacggagtctcgctcttgttgcccaggctggagtgcaatggcgcgaccttggctcactgcaacctctgcctcccgggttcaagtgattctcctgccttagcctcccgagtagctgggattacaggcgcctgtcaccatacctggctaattttttgtgtttttagtagagatggggtttcgccatgttggccaggctgatctcaaactcctgacctcagatgatccacccacctcggcctcccaaagtgctgggattacaggcgtgagccaccacaccaggctgagacccccatctcttaaaaaaaaaagtaataaaaatcacagtagccccagcactttgggaggccgaggcaggcggatcacgaggtcaggacattgagaccatcctggctaacacagtgaacccccgtctctactaaaaaaaaaaatacaaaaaattagttgggcatggtggcgggtgcctgtagtcccagctattcaggaggctgaggcaggagaatggcgtgaacccgggaggtagagtttgcagtgagctgagatcgcatcactgcactctagcctgggtgacagagcgagactctgtctcaaaaaaaaaaaaaaaaaaaaaaaatccaatagcaatataagttgtaatgataacaatcatcgcatcattaataacaatgtagtcctttgagagctggggggaggaaaacagctttctgtgctaggaagggatcacccctgtccgaaatgcccagcccagcctggtcaaggcagggagatggaaaggcagttttgcttctctttctcttcttgttccttgtatttattccaccttgaggctgagaaactaggtcccagatgtttttaatttgttttattttattttttatttttttagagacagggtcttactctatcccccaggctggagtgcagtggcacaatcacagctcactgcagcctcgacctctgaggctcaagtgatcctcccacctcagcctcctaagtagctaggactacaggtgtgcgccacagcaactatgcccaactaattatttttgtaatttttagtagagacggggtttcgacatgttggtcaggctgctctcaaacacttgggctcaagtgatctctccacctcggcctcccaagtagctgggactacagacgcgcaccacaaaaattatgcccagctaatttttgtaattttcgtaaagatagggttttgcctgccggccacagtggctcacacctgtaatcccagcactttgggaggcagaggcaggtggaccacctgaggtcaggagttcaagaccagcctggccaacatggtgaaaccccatctctactaaaaatacaaaaattagctgggcatgatagtgtgtggctgtaatagtgtgtgcctgtaatcccagctactcgggaggctgaggcaggagaatctcttgaacctgggaggcggaggttgcagtgagccgagattgtgccactgcactccagcctgggtgacaagagtgaaactctgtctcaaaaaaaaaaaaaaaaaaaaggagatggggtttcgccatgttgcccaggctgggattgaactgggctcaagtgatccacccacctcagcctcccaaagttctgggattacaggcgttagccatagtccccagctgagatcccaaatgctatgcagactcagtttcccttgctggaaaatgggaagaatgggaggggcctccccacacccagacagggagctgggggcctcccactgccccacatttctcttcaaggggctgctgttattttcgtggggaagtcagatgagtgcaggttccagtccacctctgtcccccatggccgggttccccctcaaggcctcagtttcctcatctgtagcatgggtgttgtgactgccctcagacaccaatttgtcatgatttgggagtaggttgaagtcccagctctggcccagtctcagcgccttcccagccctcggattttccatctccagggtgggtctgcagggaacggggtggcccctctccccagttctgaacctttgtggctgagcgtctgcttctctggtctgtttctgtatcagcacagtgggttcatggaaaggggaaaggagggagaggactccacccgggatttctcctccctctgattaatcctggtgcacttgaatctcttatcttttgatgcagaaatccccccacccttccagcagccctcaacctccaggcgggcctagtgtctgcctgtggatctcagccaggcctgtctgtacatatgctctgtaggaacaagctttcgtagtcgttttttgtttttttgttttttgttttcccaagatggagtctcgccctgtcacccaggctggagtacagtggagtgatcttggctcactgcaacctccacctcccaggttcaagcaattctcctgcctcagcctcccaagtagctgggattacagtcatgcgccaccacgcctggctaatttttgtatttttagtagagacagagtttcaccatgttagccaggctggtcttgaactcctgacttcttgatctgcccgcctcggtctcccaaagtgctaggattacaggcatgaaccaccgcgcccagccgggttttttttttttgagacggagtctcactctgtcgcccaggctggaatgtagtggcgagctctcggctcactgcaacctctgcctcctgggttctcctgcctcagcctcctgagtagccgggactacaggcgtgtgccaccatgcccagctaatttttgtatttttagtaaagatggggtttcactatgttggccaggctggtgtcaagctcttgacctcaagcgatccacctgcctcagcctcccaaagtgctgggattacaggcgtgagccactgcgcccagcctcatttttcatttttttttatttctttctttttttttttttttttttttttgagtcaggagtcaggggtctcactacgttgtcacccgggctggagatcaatggcgcaaccttggctcactgcagccttgacctcctgggctcaattgatcttcccacctcagcctcccaagtagttgggactgcaggtatgcatcacctagctaagttttgattttgtagaaacggggcctcgctatgtcatccaggctggtcttgaactcctgggctcaagcagtccacccactgtggcctcccaaagtgctgggattacaggtgtgagccaccatgcttggccgccgaccctagtttttttttgttttgttttgttttttgagatggagtcttgctctgtcgcccaggctggagtgcagtggcgcaatctcggctcactgcaagctccgcctcccgggttcatgccaatctcctgcctcagcctcctgagtagctgggactacaggcgcccgacaccacgcccggctaatttttttgtttttttttcagtagagacggggtttcactgtgttagccaggatggtctcaatctcctgacctcgtgatctgcccgccttggcctcccaaagtgctgggattacaagcgtgagccaccgtgcccagccttgttctttttttttttttttttttttttttgagacagtgtttcactcttggcacccaggctcccaggctggagtgcagtggcacaatctgagctcactgcaacctctgcctcccaggttcaagcgattctcctgtctcagcctcctgagtagctgggattacaggtgtgctccaatatgcctggctacatttttttgtatttttagtagggacggggttttgccatgttggccgggctggtctcaagctcctaacctcaggtgatccacctgcttcggtctcccaaagtgctgggattacaggtgtgagccactgcgcccaggctttttttttttttttttttttttgtgacagtcttgctctgtcgcccaggctggagtgcagtggcaccatcacagctcactgcagcattaaactcctgggctcaaatgatcctcccaccccagcctcccaactagctgggactacagttgcaaaccaccatacctggctaatttttgtttttttgattttgtttgttcatttgttttgtagcgatggggttttaccatatggctcagactggtctcaaacttctgggctcaagcagtcctccctcctcggcctcccgaagcgctgggattacaagtgtgagccattacacccagcccaaccctagctgcaataggcagagaataggtccctgacatctttgttctcccaacctcagttttacccgtctgtacaatgggttgtccatgagcctccacctggcccccttagcttgctccatctgcatgctggggttcaacataggtcctccacggctgggcatggtggctcacacctgtcatcccagcacttggggaggccgagagccgaggcgggcggatcagaggtcaggagatcgagaccatcctggccaacatggtgaaaccccatctttcctaaaaatacaaaaattagctgggcgtggtggtgggcatctgtaatcctagctactcgggaggctgaggcaggagaatcgcttgaacccgggaggtggaggttgcagtgggccgagattgcgccactgcactccagccttagcgttaagagcaagactccgtctcaaaaaaaaaaaaaaaaaaaatgatcctccacaaacttccgccttgatttgtgcctctcacatagtccaagtctgtttgctcatctgggcgatgggttcttgcaggtccctgataaacttctcctgggtcccccgggccttttgcgtgcctccggcggcgtgcacgggtccgcagcgaccccctgcccacctctgcccagcccctcccactctgcgggtctgttcagggcccctccgacctcagccttcggggccgggcagtgggtccgccctctgcgtccctggcgctcctgacctctcgcctctccggcctgcaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgaggtgaggtgtggtggcctgagcggagcggccagcggggagggtgtctgatggtggtgacacggggccaggagggcctgagggaggaggccagtgcgtgtgggtatgatgtggtggtctgagaggggaagtgggccttggagagtgcccaatggggcgacacggggcacggagcatctgagggaggaggctggtgggtatagatgtgatgtggtggtctgagaggggaggcgagtctaggagaatatgtaaagtaggtgatatggcacaaggagagtctgagagaggaggccagtgcatatagatgtgatgtggtggtccaggcagggcagcaggcctgggagagcatctgatgggggtgacatggtgcaaggagggtctgagggaggaggctggtgcgtgtagatgtgatgtggtggtccaagcggggaggcgggcctgggagagcgtctgacgccgggtgacacggggcaaggagggtctgagggaagaagccagcatgtgtagatgtgatgtggtggtctgaggggggaggcaggcctaggagagcgtctaatgcaagtgatatggtgcaaggagcgtctgagggaggaggccagtgcatgcagggcccagggtggctgctgatgggatgtggaggtcagatggaggaggcaggcctagcagaggtctcaagtgagagatggtacaaggaggtttttttgacagaggaggcaggtgggctgtggcgctccaatggtagaggcaggatctcaccctcacgtctgagggaggaggcaggaaggcccttgaggtctcagggggatgagaatgtcctagatggtcttgggcacaacggacggccttgctgggagcaggggtgaggagaggagagggacaggccatcccagccctccgagggagagagccaagagagtcctggcaccgctttctgtgaatgcttgttggttgattgactctcagaccatgccagcagaggcctgatgagcctggccctgccagaggggtgtttgccggtggtcaaatgcctgatgttgagaccagctagctctgtggggttgaggaaatccaaggcggcttcccagaggaggaggtgcagctgagctcagctctgcaggatggccaggccacagtgaacaaggagatgccccagggggcctggcaggagcgtggagatgagaggcctgatgcctgtgcctctggtcccggtgctaagagcagggttggtcctgcagcttcttggctgcgtggccctcttggacttcagtttctcttgcctgccaaatggtggagatgatcagtctgtagctggatggggctatgggaggttccagaagatcatgcgtgtagccacgtgcgaggtgtcagctgcatcccaagacctgagtgggtgcacagcacacccctgccatgcccatccaggccgtgtctggagcacgcgtgaacccccacacacccaggggctgccagagcatgtgggatgggtgtacgccagacgcagacccacacaggtcaccagcccagccccagcccaggcagcactctatagaaacaggcagttgcacagcctgagagggaggggcatttgcccgaacaggaggaccctggggccagactgcccatgctccagacacagcccttcttttccccagctgtatggacacatcccttttctgtgcctcagtttcctccttggtgcaatgggagtaacagccatgccaccttctagagctggtgcaagggtgagacagggtcacgggctcccaggctctagggtgtgtggaaagacagcagggcagagttacccagtgtttttttttttttttttttcctggagacagggtctcgctctgtcacccacgctggagtgcagtggtgcaatctcggctcactgtagcctcgacctcccaggctcaagcaatcctcctgcctcaccctcccaagtagctgggactataggcgcacaccaccacacccagctaatattttatatatatatatatttttttgtagagacagggtcttgctatgttgcccaggttggcctcaaactcctgggctcaagccatcctcccaccttggcctcccaaagtgttagaagtacagcaggcaagagccactgcaccacaccagttacccagtcttttttttttttctttctttttttggagatggagtttcgccctgttccccgggctggagtccagtgacgcaatctcggctcactgcaatctccacctcccaggttcaagcgattctcctgcctttgcctccccagtagctgggcttacaggtgactgccaccacgcctggctaatttttgtatttttagtagagacggggtttcaccatgttggccaggctggtcttgaactcctgaactcaaacgatccactggcctcagcctccccaagtgcggggattacaggcgtgagccaccgcgcccggcagttacccagtcttgatcttgattctttgaccttgaccttagcatctttctcctcccccacccccactgatgagcaacaaacctgctggggttggctgtgagggggcactggggacggtgggggcagagaggtgggccgggtgactgcctgttgggagcaggggccaccgtggggacggaggttctcatcgtcacacagggccagacctctctgccaccacacatcttcctcgcccggggccccgcccccacctcctccgtgctgagctgatacaattttgaagcgagcttttctgctgcagtcagcacaacctctgggcgcctccccacccccaccctgcccctcccgcctctgctcagcaggcaggcctgtgccccaggtcaggttggcctctctgagtgaaggctgcaccctcccttgcccccagcctgcccccttcatccccaagggaatccctgcttcaattggccccagcaggccacaccctcccccaattggccccagcagggcacacccccccccaaccctcccacctgcccactgcgggtgctccagctcctcatgggggtaagagctgggcctggactccaaccccagctcagctgcccactggctgggtgatgtggggccagtcactcaccctctctgtgcttcatttccttgtctataaactggggggctcaaaactggttgccttgtgggaaatgtcaagtgcccagggtgagagctcagtaaaccacccacaaggcatcgtgaagaccaggcactaggcagggggctagggcccttggtggttatcgttactaacattatcctcttcgggattggtttgtttgtttgttattattggtttgggttttttgggggtttttttggttgttgttgtttttttttttttttttgagacagactcttgctctgtctcccaggctggagtgcaatgacgcaatcttggctcactgcaacctctgcctcccgggttcaagcaattctcctgcctcagtctcccgagtagctgggactacacatgcccaccaccacacccggctaatttttgtatttttaatacggacggggttttgcatgttggccaggctggtctccagctcctaacttcaggtgatccacccgcctcggcctcccaaagtgctgggattacaggcgtgagccactgcaactggccttgttttttgttttttgcagagatggggtatcactatgttgcccaggctactctcgaactcctgggctcaagtgatcctcccgccttggcctcccaaagtgccaggattacaggcgtgaccccctgcgcccggcccatcctcctcattctgattataatctcccactgccagacctttccttatgcattccctggacatagaatgtctttcccatatggaaaaccccaactccggctgggtgtggtggctcatgcctgtaatcccagcactttgggaggccaaggcaggtgactctcctgagctcaggcattcgagaccagcctgggcaaaatggcaaaaccccatctctaccaaatatacaaaaaattagccacctgcctggctgaaaattctttcccattctcacagctgccctgtgaggcaaggatcattgctgtatgccttttttttttttttttttttttttttgagatagggtctcactctgtcacccaggctggagtgcagtggcgcgatcttggcttactgcaacctctacttcctgggttcaagcgattctcatgcctcagcctcccgagtagctgagattacaggcgagcgccaccacacctggccaatttttgtatttttagtagagacgggctttcaccatgttggccagggtggtctggaactcatggcctcaagtgatccgccctcctcggcctcccaaagtgctgggatgacaggcgtgagccaccgcgcccggcctgttgtacgcattttacagaggaggaaacagaggctcagaggagggatttgacctgccgtggtcacacagccgagactgggccaggtgggatttggacccacaagcagcttctgcctctgccctgtccttgacacctgcctcatcctccattattgtcagaaggggatgggcggaagttgtggtgcgtgagggggcagtctgctggcacggtgtggtcaccttctggcagggttgtgtgagggccccacaggctgaggtcttatgtagggtccccaggctgtggctggcctccaggcctcagcgctgatcccagtggttgtcaccctgacagcaggaagactggccaccggcttccttttccgaaccgagagtccccttggctgtggagcgtcctggcccagccagagtgcagtgtctggctttcatcagccctgctgggcagctgaggccctgggatagagggagagggagggacgggcatcaggcatagggccttggctggcctcttggaggggtgcagggtggatggcggtggaggggcacctgccatggggctgaaaggagccaccacttgcaacgtcacaagtgagagaggaggccgggcacagtggctcatacctgcaatcccagcacttcgggaggccgaggcaggcggatcacctgaggtcaggagtttgaggccagcctggccaacatggtgaaaccccatctctactaaaaatacaaaaattagccgggcgtggtggcgggcgtctgtagtaccagctactcgggaggctgaggcaggagaatcgctggaacccgggaggttgcagtgagccaagatcgcgacactgcactccagcctgagcgacagagtgagactctgtctcaaaaaataaaaattaaaattaataagaagagggtgtcagggaactgcaggaaaataaagcagggagggacatggaggggggctgggggccactctggatggggagggcttctctgaggaggcgtctttgaggtgaggcttgaagggggtgagggagtctggagaggctgggtggagggagcagtgagggggttatagccagtgcgaaggcctggagcccaggagcagcacatggagctggctgggatgttcagggggtagtgagtggcgagggccgtcctgtggccttccagtgagggtgaccagccgggggtggggcgggagagggtgacccgggtgctctccgacctgccacgtgctggggaaggagcctgcaggaaccagggcccagagagggaagctgtctgcccgcccagggcctaaacccagccaggcctccccgccccctctggcagcccaagaaatctgaggcgcgggcgggcaccgtgccagggctgggcgggggaggggctgccaggcccgcccgtcccagcagctgccagcccgccccgagccgccagcccagatggtgcccatctgctgacgccgccatgggccagcctcctgttcccgccttgcgtcgtgccaagctcctgcagtccagcgccgggaatggcgcggtgggcagagcccggcccgggaagctcatagcacgccagagaggctgccccgggtgccctggagagggtggcaggagaaacatgggagggggagttccccagcgcttcctggatggaattggggagcaaggaccccaacagcgataatgatggcggcaaacacacatggcgtgccctctgtgtgccaggctccgaggccaccgctcaccctaactggtttaattctctcccccatccaagcaggaagggactttggccttctctcgtgttctagtggaggaagcagagacccagaggtttggacaagagtcacttgtccaaggtcacaaagctcctcaggggcagagccggaatgagaatccagaacccctttgaaaaagggattgaggccaggcgaggtggctcctgcctgtaatcccaacactttgggaggctgaggcaggaggatcacttgaggccaggagttcgagaccagcctgggcaacatagcacgaccatgcccccccccaacaaaatttttaaaaatgagccaggtgtggtggtgtgtacctgtagtcccagctactcgggaggctgaggcaggaggatggcttgagcccaggagttggaggttgcagtgagctgtgatcccaccactgcactccagcctgggtgacaaggcaagaccttatctctaaaaaccgtttttttttaaggggtgattgaggccaggtgtggtggctcacacatgtaatcccagctacacaggaggctgaggcaggagagtcgcttgaacctaggaggcggaggttgcagcgagctgagctcatgccactgcactccagcctgggcgacagagtgagaccctgtctccaataaaagggaggtggtattgaaaccccttaaacctcttttcaaaaacaaactaaaagtgccctttgaggttatctagtggaagccacaccctctgagtcatacagatcatacagtgcaggccgtgcacactcagggagtaaatgaatgaatgaatgaatgaatgaggtgaaccctatggaaggggaccaagcctggggccagggtgtccataaagctcaccctgagcttgatggcaggagaaagggtctcaacctgggagtgagggacctgggtcagccacagtgctgccctggcttgctgtgtggctttgagaaaagtcctgccctctctggtctggggttgaggggagtggagggtgggaaggggcggccttgtgggccacagacaggagcaaggcgggtcttcactgaaagcctcccgtcctcttctgcctttattgatcttcatcccggttgtgggtgctgcactggggagacaggccatgagctcgggtgacggtgcctgtttatttgtatggtggacagaatttgtgttcctgtgtgctccaggcagtgtggggcgcattcttctctttgagccttagtttttgcctctgtagaatggggagaatcagagctgtgcccattgcattaaagattggagtcagtggtctctgagaagcatacaggaggcactcaataaatgctcacttccggccgggcgcagtggctcacacctgtaatcccagcactctgggaggcccaggcgggtggatcacctgaggtcgggagttcgagaccagcctgaccaacatggagaaaccccatctctactaaaaataccaaaaattagccaggcgtggtggtgcatgcctgtaatcccagctagtcaggaggctaaggcaggagaattgcttgagcccgggagaaggaggttgcggtgaaccgagattgcgccattgcgctccagcctgggcaacaagagtgaaactctgtcccaaaaacaaaacaaacaaacaaaaagaatgctcatttcctccctggattctctccccaaccccaggagggaaggagggaggtcccagtgccgccgtgaaaccctacacctccttttcccaacccagtgagccagtgggggcaccgtgacccaggagtggctgtcaccagaagctggaccaagtcaccctttccaggtgtctggacagcagaggggtgaggggttcctggcagcagcagcctgttatcccccagggctgggcagccaggtgtgccagccgtctgtctgtgcagagaaggtggctgccgggcgtgagtcgcagacgccagctgatggtgtatttatagcaacggcaggagtccgcggggcatacgtcagtggtaaagagggacgggcaggtgggggtccagctcccacagcagacaagagcccaccaggactggccagggagctgaacagagtgtcagggagaatgaggggcatgttgtgcagccgggaggcccaggatcacacccctctgctctggaactgcgtgatgtttgacaagtgacattgcagctgtgggcctcagtttcctcccccatcaaatggggatgataataatcctgcccacctaatagggctgcataggatccaattagtgcatgaaaagcatgaggacagggcctggtatacagtaagcactcaaaagtgatttgttgcctaaaaaagggagggaatcccaacatgggccacaatgtggatgcatcttgaggatgtcacactcagtaaaataagccagacacagaaggacaaatcctgtgtgattccactcctaggaggtccatagagtcgccagattcacagagacagaaagtaggatggggggtgccaggggctggggagggggctggggagagaatgtttcatggggacggggtttcagtttgggaagatgagaaggttctggagaggatggtggtaatggttgtacaaccctatgaatacgcttaatgctgggttaatgccactgaacttagaaatggttaaaagagaggcaggaggattgcttaaggccaggagttcgagaccagcctgggcaacacagcgagacctcatctgtacaaaaaatttaaaaattatctgggtgtggttgcacgcacttgtgttcccatctactcaggaggctgaggcaggaggatcgcttgagcccaggagtttgaggctgcaatgagctatgatcacaccactgcactccagcctgggcgacagagcaagacttgtctcaaaaccagaaccacccccaccaaaaaatggtaaatttatgttatctagattttaccacaatctaaaaatgtagttctggttgtgaataatgataataacaagtaataatattatatctatggccggctgtggtggcttacgcctgtaatctcagcactttgggaggctgaggcgggaagatgacttgaggtcaagaattcgagaccagcccagccaacatggtaaaaccctgtctctaataaaaatacaaaaattagccagtcgtaggccaggcgcggtggctcacacctgtaatcccagcactttgggaggccgaggcaggcagaccacttgaggtcaagagtttgagaccagcctggccaatatggcaaaaccccgtctctactaaaaatacaaaaattagccaggcatggtggcgcgtgcctgtaatcccagctacttgggaggctgaggcaggagaatcacttgaacccgggaggcggaggttgcggtgagctgagattgcaccactgccctccagcctgggcaacagagtgagactccgtttcaaaaaaaaatgttatatatgtaacaatgtaataattagtaatatgtcatatataatcatggaacaataaataagaaaaatagtgtctgcggtgacagcacagtagttattattgtcgttatcatgatcgtcatcactgtggttctcgtccagctctgccctgcagacagctgtgtaaccctgggtgagtttcttgccagctctgtgctttactgcctcatctgtgaattgagcatagggggtgcctagcaatttaaatgagataatagctcttttttttttttttttttttttgagatggagtcttgctctgtctcccaggcaggagtgcagtggtgtgatcgtggctcactgcaacctccacctcccgggttcaagtgattctcctgcctcaacctcccgaatagctgggattacaagctcatgtcaccacacccggctaattgtggtatttttagtagagcgggggtttcactatgttggccaggctggtctcgaacttctgacctcaggtgatctacctgccttggcctcccaaagtgctgggactacaggcgtgagccaccgcacccggcctaaatgagataatatctatgaaaaaactaaccctttgcatgtgatgagtgctgggaactggtaggctctttgaggagtaggtcctcccaccaccccgcagacgcccctacccagcagaatgctggtttctgcatgaatgcatttgtgtggggactcccgagacagcccctgagggagccctcattcacccgggtggggcccggccctcccagagccagtgggagggggaggcgccttgttgcacctgtgatgccccccgttatggctgggctgcagttgtcaccctggccctgtgcctgggaagccaaggggaggctgagggcagctagggacagctctgtgcccacggccccctccagccagctgccaggccagccccctccctccagctgggcgagggcaggaagtcacagatggtcagggttggtgaggggtgaagcagagggcatttggggacaccggatgtctcgtccagatggggaaactgaggcccggagaggggcgaggcattgccccgagttgcccaggaagggccttggctcttgtcccttctaagtcccatctttatttttattttttattttttggagacggagttttgccctgtcgcccaggctggagtacagtggcgcgatctcggctcgctgcaacctccgcctcctgagttcaagcaattctcccgcctcagcctcccgagtagctgggattacaggtgcccgccaccacacccagctaatttttgtatttttagtagagatggagttttaccatgttggccaggctgacctcgtgatccacccacctcggcctcccgaattgctgggattacaggtgtgagccaccgcgcccagactaagtcccatctttaggtccgcttggctgttccacggccacctggaggggaggtagggccagcaaggagggaccctagggtctcagggcagaagatctgccggaggagagggagaagggggttctgaggggaggaagacgcgagaatctcaacgctgaagtggtttctagattctccagggcatgagtcctgaaatccccaaggcctgagttctagaatttcttccactggggccctgaccacacaggtgattctagaattctcctaggtgagttccagacccaggggtccaggagaaatagaatgttggctgggcgtggtggctcacacctgtaatcccagcactttgggagaccgaggagggcagatcacttgaggtcaggatttcaagaccagcctgaccaacatgatgaaacccggtctctactaaaaatacaaaaatgagccgggcgtggtggcgcgaacctgtaatcccagctactctcaggaggctgagacaggagaatcgcttaaacccaggaggcagaggctacagtgagctgggatcgtgccactgcactccagcctgggcaacagagtgagactctgtctcaaaaaaaaaaaaaaaaaaaaagagttccaaccacacatataatttaacatttttctggtcctcacacttaagaatgtaaatttaagtatactggggaaattaattttaacattattttaagtaatgttaattttttttttccttgagacagagtctctctctgtcgcccaggctggagtgcagcggtgcaatctcggctcactgcaacctccacctcctgggttcaagcagttctcctgcctcagcctcccgagtagctgcctcagcttcccgagtagtaacattaaaatgtttaattttaacattactttatttaacccagggcatctggaatgatactattgcaatccataaacaacaggaaaaattattggtctattggtcgggtgcagtggctcacgcctggaatcccagccctttgggaggctgaggtgggaggatcacttgaggtcaggagtttgagaccagcctggccaacatactaagaccttgtctctacaaaaaaattaaaaaattagccaggcgtggtggcgtgaacctgcggtcccagctactcaggaggctgaggtgggaagatcgcttgagcccaggaatgtggggctccagcgagctgtgattgtgtcactgcattccagcctgggtgacagagcaagacttcaactcaaaaaaaaagttatcgaggtattttatgatcttttccccaccccccccccccccccgcttacactaagtctgaaatttggacagaccacatttcaagcactggatgtcacacgtggccaggggctgctgtattgggcaggccgtgctaagacatctgagttccagagcaggggttcccgacccccgggccacagacgggttccgtgcctgggaggaacctggccactcagcaggagttgagcttagggcaagtgaccattctcacctgagctccacctcccgtcagatcagcgggcggctctgggtgcccctacgagcatgaaccccatggtgaactgaacataggagggatccaggttgcgtgctccttaggagaatctgactaatgtctaatgtctagtttcatcccagaaccatctccccactcaccccgtccctggaaaaattgtcttccatgaaatcggtccctggggccaagaaggttggaggctgctgttccagagaattcggaagcagatctccagtctcccaagttgggttctcgaaaacgtgagggcaggttctagaccttccaaactggttgcttgaaaatccaaggaggctgggcgcggtggctcacacctgtcatcccagcactttgggaagccgagacgggcggatctcccgaggtcaggagttcgagaccagcctggccaacgtggtgaaaccccatctctactaaaaatacaaaaatcagccaggtgtggtggtgcacacctgtaatcccagctactggggaggctgaggcaggagaatcacttcaatccgggaggcagaggctgcagtcagcagagatcgcaccactgtactccagcctgggcaacagagtgagaatctaactcttttgcccagactggagttcagtggtgcaatcacagctcactgcagccttcaactcccaggttcaagtgatcctcccaccttagcctcctaagtcgctggggctgggattacaggcgcataccaccatggttgattttttttttttttttttagtagagatgaggtctcactatgttgcccaggctggagtgctgtggtggactcatagctcactgcagcctcaatctctcaggctcaagggatcctcctgcttcagcctcccaggtagctggcagtataggcgtgcaccactacgcctggctgattttttatttttatttatttatttatttactttttgagacggagtcttgctttgtcacccaggctggagtgcagtggcgcaatcttggctcactgcaacctccacctcccgggttcaagcgattctcctgcctcagcctcccgagtacctgggattacaggcgcgtgccaccacaccggctaatttttgtatttttagtagagatgggatttctccatgttggccaggctggtcttgaactcctgacctcgggtcccaaagtgctgggatgacaggcatgaactaccatgcccggccttatttttatttttcgtagacaggaggtctcactatgtggcccatgctgggatttcaggctctttgagctttcttccatattggttagggctggagcaggactccactgtggcgggaggtatttgggcgcaaggagagcagttgtgaggactggtggtgacccccagttactgtctgttgtgctttggatgctgggcacgggaagcctggctgtaagtgtgtgtttccgggccgggcgcggcggctcacgcctataatcccagcactttgggaggctgaggtatgcggatcacgaggtgaggagatccagaccatcctggctaacgtggtgaaaccccgtctctactaaaaatatgaaaatattagccaggcgtggtggtgggcgcctgtagtcccagctactcgggaggctgagagaggagaatggtgtggacctgggaggcggagcttgcagtgagctgagatcgtgccactgcactccagccggggcaacagagtgagactccgtctcaaaaaaaaaaaaaaaaaaaagtgtgtgtttccaagaggctgttatggggcctcgggcacaccctcactgggtctggatcccagcctgtctaccaccaggcgtcccttctggtgaacagagctatgtgagaacttccaacagggacaccacggccgctcgtagcccagagcttgcagagctttgttcaaaggcaatggcccagggccgagcacggcggctcacacctgtaatcccagcacttgcagaggccaaggtgggtggatcacctgagatcaggagttcgagaccagtctggccaacatggcaaaaccctatctctactaaacctacaaaaattagctgggtgtggtggcacatgcttgtagtctcagctactcgggaggctgaggcaggagaatcgcttgaacccaggaggcagaggttgcggtgagctgagatcgcgccattgcactccagcctggtgacagagtgagactccatctcaaacaaacaaacaaacaaaaaagcagtggccatcatgatcggttgtgtcatctagtgggaggcaggggtgtgtctgcatgcgtgtctggggtgcattgtggggggattgcaggcgtattgagggcttaccaagtgcctggctcatctgagccctcaggaaaccacattgttggcagctacctcaccgtctcacaaccacccgctgaggttggaatgatcattaacagcatttaacagatggggaaactgaggcctagagaggcaaagtcactggcctaaggtcacatagctaaggagcacagtcaggatttaaatccaagcctgggagatcccaggacccacagtgggcaccacataaaggggctgtttggggtatggcagggactgccctggaacgttccggatcctgcctttgggcctacagggctttggtgccggtgagcaggccgcaggttcagctggctcaaggagcagcttcggggctgcagccaggctgggggctgggcaggtctcaaacccctggacctggggaatcagggaggtgtgagctgcatctgaggtcgggtgtctctgtgactctgtctctgtctctctacctctgattctccccaagctgccttgtctcagtccctgtctattcccaccccacctcgctctctctcccggccttgcgagtctcctcccagccccccatcccacccagtgggctgcccggaggtggcggcaacggggcagctgaatgggcctcttgttcctggccacacccgccccttggggtcaccctgggacatgcccaggcagcgtggctaccttaaagggccagtgctcagaaagaatgtgagcgggggaggctgcgtccactcccaaatcccacaccctccccaaggtggaccactcatgtgtctgacgggggtggggagctgtgtacctacacaccctcgtggcttgggggaggcctgtctggagcaggagatgtgatagggtttgggtttgaccttggataaatcccttcatctctctgtgcctcagtttccccatctagatcagggggctccttggtgccacccctgtgggttgctgggcagatggcatattatccaggattttgcacacagttgacactcttccggcgcccactgtgcattgatagagcacctgctgtttcagcccagcattcatccgccgtgcagacttggcaattccttcttcaccttgctccgtgcctcagtttccccaaatgcagaatgaggcgatggctgtcttagcttcacagagagctacgcaaggattgagtcggttcgtggaattagagggtattagggagaagggcctgaaacactgccaagtgtcacctccactggcgcacttattgagcgccagctgcataccaggccttgctgaggaagcctcactgcagaggttgcagtgagctgagagggaaaggccacccagcctggatctcactctggtgtcatcgcctcctccctctgctcagggttgtgcagcttcaggctgctcccctgccctctctgggcctcagtttcaccttcagagcaacgggaacagccccatcctttcacacactggaaaccatcaccttcttctgcctgggagggggttgtgctgtctctgggaatcccaggcatcccccaggcaggagtcaacccagaggccctcggacccgggctgtaccctgtgacagctccgggtggctacgacgctcccgtgctccaggccagccccacagacagcccgggacaggttgctgccggatggacaagcctgtgcctcgctgccttatgtaaccagtttatgcaagggcagccggcccgcttacataaggggaggccgggccagcgcccagctggggagggggaggctcttaaagggaccggcgtcccccgcggctccctccacgggcactggtgcgaattcataggcgagctgcggactccaccctcagcaaggccgccattaatgtcgttatgattatttttgtggatgttgtttatcatcactatattctttccccagggcgggggttcagctgagcggaggaccacgcccagtgcttgggcagaggcttgggctgtgacgctggctctgggtgtcacctggttaagtccctgtctctgagcctcagcctccccttctgcacagtggggcaatgcaggaagacgtgaggtcctggagggtcctggccctgctgcctgttcactgtgtggcctcaggcaggtggcatcccctctctgggcctcagtttccccatctataaaatagcgcctgctctgtggggttgctgagggagagtcaataagacatattaagagtttacatgcccgccaggcatggtggctcacacctgtaatcccagcgctttgagaggctgagacgggaggatcacttgaggccaggagttcaagaccagcctgggcaacatagtgagatgcccatctctacaaaaaataaaacttagccaggcatggtgatgtgtgcctgtagccccagccactcgagaggtcgcggcaggaggattgctcaagtctgggaggttgaggctgcagtgagctgtgattgggccactgcactccagcctgggtgacagagcaacaccctgtctcaaaaaataaaaataggccaggcatggtggctcatgcctataatcccagcactttgggaagccgaggaagacagatcacttgagatcaagagttccagaccagcctggccaacaaggggaaaccccgtctctactaaaaatacaaaaattagctgggcgtgtggtgggagcctgtaatcccagctactggggaggctgaggcagaagaatcacttgaacctgggaggcggagattgtagtgagccgagatcgtgccactgcactctagcctgggtgacagagcaagactccatctcaaaaaataaataagtaaataaaaataaaaataggctgggcacagtgactcacacctctaatcccagccctttgggaggctgaggcgggaggatcgcttgagcccaggagtttgagaccagcctgggcaacatagcaaatctctgtctcaaaaatttttgaaaacaaaagagtttaggacagcacggagcacagacactgtcagcactcatccagtggaaccactttgcagccaataaatatttagtaagctcctactgtatgccaggcactgctccaggcgctgggatactgcagtgaacaggacagataaaaattcggccctggccaggcacggtggctcacacctgtaatcccagcactttgggaggctgaggtgggcggatcatgaggtcaggagatcgagaccatcctggctaacatggtgaaaccccgtctctactaaaaatacaaaaaaaattagccaggcgtgatggcaggtgcctgttgtcccagatcctcaggaggctgaggcaggagaatggtgtgaacctgggaggcggagcttgcagtgagccgagatcacgccactgcactccagcctgggtgacagagtgagactctgtctcagaaaaaaaaaaattctgccctcgtggaactcacagtttggttcaggcgatgggcaaagaacaagaaataaatgtcagtttaggcttagtgcggtggctcacgcctgtcatcccagcactgtggggggccgaggcgggcagatcacctgaggtcaggagttcaagaccagcctggccaacatggtgaaaccccgttcctactaaaaatacaaaacattagccaggcatagcggtatgcgcctgtaatccagccactggcaggggctgaggcaggagaatcgcttgaacccggaaggcggaggttgcagtgagccgagattgtaccactacactccagctggggccacagagcgagactccgtctcaaaaaataataataataaaaataaaaagaaataaatgtcagtttagcgataaggactatcaagaaaaataaagaaggccaaaggaaaagaggctgatgggctgtgctggggaggtccctgaaaggctgtctgaggacctgacatttgagctgagacctgagaagtgaggaggaaccagttatatgaagaactgggggaaggcgttccaggcagagggcacagcccgtgcaaaggccctgcggcaggacacacctggcactttggaggaacagtgaggaggcctgtgtggctgcagcagagtgaggagaggaagagaaggaggaggggagggcagtttgtgcaaggcctggtgggcagtaggaaggacttgggctttgaccccaaggcaggtgggagccatagagggctatgggcagaggagggaccagccctgactcaggtgctcacaggcaccctctgcctgctgcagggaggacagactgtggggggtgagggcaggagctggggaccagggcagagtggaccgccctggtgcaagcaggcggtagcagggacagaggcagaggagggggcagaatccaggtcaactccgacggtgtgaggattcagttgctcacctgggtcgtttataccttatctgaggctggcccttgctctccttgccccgtctcctgcctgcaagccgcacctgcctgggcacatgcagggaagggagcggcgcagcactgggcacgcctgggagctctcctgcaatcaggactttgttagcgggcaagctgggatatgggtcctggtgcccgggaggcccgtggggctctgggctcctgccagggtcccagccctaacccaggtacgccacccacatggcagggttattctctttttttttttcttttttttagacagagtctcgctctgtcacccaggctggagtgcagtggtgcgatctcagctcactacaacctctgcctcacaggtttaagagattctcctgcctcagcctcctgagtagctgggactacaagtgtgcaccacctcacccagctaatttttgtgtttttagtagagacggagttgcaccatgttggccaggctggtctcaaactcctgaactcaattgatccaaccgcctcgacctcccaaagttctaggattacaggtgtgaaccaccgtacccagcctattctcatttattttctttcttatttttttttcttttttttgagacgaagtctcactctgtcacccaggctgaagtgcagtggcacgatctcagctgactgcaacctccgcctccagggttcaagcaattctcctgcctcagcctcccaagtagctgggactacaggcatgtgccactatagccagctaatttttgtatttttagtagagatggggctttgtcatgttgacgaccaggcaagtctcgaatgcctgacctcaggtgatccacccagcctcagcctcccacagtgctgggattacaggctggagccactgcgcccagacggtccttccttttcatgcctcctccttccactcccccatgtaccatgtctccttgtctctctttttctctctgctcatccctccctctcaactttctttctacaaatatttattgagcacctagtctgtatcaggccttattctagccactgagggcacaacagagatctagacagacaaagcctctgccctcaaggaggtgacattccactggggagatgagcaaacacccgtgcagtcactaagcaactaagcaaatccataggcaatcactaacttcctctgaaggaaagaaaacagaaggctgagattgagggtggccagaggctgcttgaggtgaaggggctcagcgtagacctctctgagaagggagcatttgagctgagaccaggagagatctcaagagagagcaagcagttagctgtttagacagagggaacagaatgtgcaaaggccctgaggcaggactgggccaggtgcattggaggaacagcgaggaggcccctgtggctggagcagagtgagtgagggggagagagggaagaggggagggcagaaagcggacaggacaggttgtgcagggcctgtggtcctagtcctccactttgactactcccccaaatctcttaatgttcctcacattcctttccctgacaagcatttattttgcacctgctgtataccagatcctatcaggagaatcccaaatattcatgcaacaagttcatattgggtgcctactgtgtgccaggctctgctggaataatcacactcatttggctgcaggcatttattgagtgccagctgtgtaaaagcatttatcgagcaccacctgtgtagcaggctctggggagagaggccacatgaaagcttgggaaggagaaagtttccttctaccccctttcaggtttgtgccctctggtttccagccccctcccacattcaaggcaacatttaaacctctgggttcaagttccgttgtccaactgcgtggccgtgagatctggggcaagccccttcctctctcggatcttccgtttccccctttgtaaagcagaacactccacaatctgatgtgtttacaacttgacatctactttttgcagcaagggaaactgaggcacagagcagggcggagatgtgtctacctctccctccccaagcaagactggcatggagtctattctcctgaccccacgccaaagccagggcgtttggtattttgttttttcttggaggcccagagaggggcagggcttgcctgaagccacacagcaccgggcaggcctcggaattgcggagagccctcccctgggcgcctgcccgggctcccgcgccttcctcctgcctcctttggctgggccgccagccttgcctcccgtcctccggactccccgcgggctgcccagttggagacgcgccccaagaaatatcagaaggaaggggaagccgggaggggcctccgcctcctcccgccaccccccgccgcgcccggctgcccccacccggtgcccgacattggcagagagtgtcctcgggcgcttccgactggccctgcctgcttcgtgtggccactgatcccttccggagcctctccatggggacgcccgtgtgtgcgctcagccagtggcacatgtggctcccggggctcccttctccacccccccagcccctggcctgcccctttccccccatcccttcccgaacctctccatggggacgcgtgcgtgtgcgttcagcccgtgggcacatgtggctcccagggctccccccgaggcctgcccttctcccccccacgtcacagccgccgagtcaggcctgccaggaaggtgttgggggtgggggtgtggggaggcctcagcttggctgctggagaagccaagaatttgctccaaatgtaaacagcgagttattttcagtccactcccccccaccccgggtggcgttgacacatttgacattggcgggaccgggagggggtgggggtgagggtgtgcgtgcgggtatttttaaccttgctcctcacatccctggagtggctggtgccgagtggcagataatggggagggggcgcggaggcgtggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgcgccgcccagacctacaaaatggccgccaaggccggagaaacatctggaacaggggaagggagaggcgagaaaatggccgccagagggatgatgtcatgggcggcgtggcctcccagagcgtccccagcacggggcgagtccctacgcgcaggcctccgagcaggggccctgtggcctccagggacctccagacccgctgcccaggccggacacccacaaagagtgacaccggggtccccaggggtccccagaggcgggcccgagacctgggggagggcgaggccagcactgggcctccagtcccaacagcccgatgctggggacggttccggggcggtggtggccgctgacctgacccgcaggacaccgaggcgtccaccagcgcccgggagggcccggagccaggccatggagccggcgggggccgggtggaaagaaaaaagaaacttttctttgaaagtgattccgaagcaggttggctccggcccaggcggcccggcggcaggggagagggagatggaaagtatgggccagacttaaggaacgcaggaaggacgaggccggggaggcccgggatggaggccagcgtcctggaggtcaccccgtccacgcctctgcctctcgggcccccccaggtcacatccagattttcctccctgtccctggggcgggcggggagtgcggagaacatctatgggcttgtgttttttcctcttttgatttgtccagacaggcgatggacaagggctgggcaggggttttaggtcatctgcactgccaggatgtggaggctcagagagggagagtgcttttagtgaggtcacacagcactggcaaaactgacagctgcttccctccttagagcatcttggggaggaggaagttctctatggaggatcagggtccgtactggaattcctttctatttttatttaatttaatttatttatttatttatttatttttgagatggagtttcactcttgttgcctaggctggagtgcaatggcacgatctcggctcactgcaacctccacctcctgagttcaagcgattctcctgtctcagcctcttgagtaactgggattacaggtgcctgccactacacccagctaatttttttgtatttttagtagagacaggggtctcaccatgttggccaggctggtctcgaactcctgacctcaggtgatctgcctgccttggcctcccaaagtgctgggattatacgtgtgagccaccgcgcccggcccctttttctttttctttcttcctttctttttttgaaacagagtcctcctgctctgtcacccaggctggagtgcagtgacttgatcatggcttactgtagcctcaaccttctgggctcaagcaatcctctcacttcagcctcctgagtagctgggaccacaggcatgtaccaccatgcccagctaaatttgggttttgtttgtttgtttgagacagagtctcactctgttgcccaggctggagtgcaatggcacgattttggctcactgcaacctccacctcccaggttcaagcgattctcctgcctcagccttccaagtagctgggattacaggcacccgccacgatgccctgctaattttttgtgtttttagtagagatggggttttgccatgttgcccaggctggtctcgaacttctgacctcaagtgatccgcctgccttggcctcccatagtgctgggattacaggcatgagccaccgtgccctgcctatttttttttttttgtagaaatagggtctcactatgttgctcaagctggtctcgaacttctgacctcaagtgatcctcttgccttggcttcccaaagtgttgggattacagcgtgagccactgtgtccagccaatgtctgtgtgtttttcactgctctgtccccagtacctaggacagggcatggtacacagtaggcgctcaagacgtgtgttggataaaagcatcacagttttctcctgaggctggggttggcacagatgctggcacaggaagggggcagaggctcaggaaatgcaaagtaggttgcaacgtaactggacacacacgggaaccctgtggtcacatttttcaggagggatgtgaggaggcgaaaactcaaacttccctcacttcaagtgcagattctgtgccgggagctgtggacgataaaccacatttgaacagaagcctgaataaagcgagagagtgagccaggcaggcatttgcagggacggtgttccaagcagtgtgcacagcccgtgcaaaggccctgaggcaggaccgtgcctggtgcattggtggaacagccaggaggcctgtgtggctggagcagagtgagcgagggggagagagggacgaggggaggaggggagggagggggcagaggcaggctgtgcagggccttgagcgccatggggagatggggagaacttggacttttagatatttggttttctgttttttgttttttgtttttgaggtggagtctcgctctgtcgcccaggctggagtgcagtggtgcgatctcggctcactgcaagctctgcctcccgggttcacgccattctcctgcctcagcctcccgagtagctgggactacaggcgcccgccaccacgcccggctatagttttgtatttttagtagagacggggtttcactgtgttagccaggatggtctcgatctcctgacctcgtgatccacccgcctcggcctcccaaagtgctgggattacaggcgtgagccaccgcgcccggcccaattgtttggttttgtttttgctttgttgttgttgtttttgagatggagtctcgctctgtcacccaggctggagtcactggtgcaatcttggttcaccgtgccctctgcctcccgggttcgagcaattctcctgcctcagcctcctgagcatctgggattacaggcatgcaccaccacgcctggctaatttttgtgtttttagcagagacgaggtttccgccatgttggtcaggctgagctggaactcctgaccttgtgatctgctcgccttggcctcccaaagtgctgggattacagacgtgagccaccgcgcccgggtgaactttcacatatttgtagacccagacacagtccagggtgctggggactagaacaaacgtttgcagaaagggctggggagggtgttccagagaaggagatgtcagagctgggctgcaaagtatggctggaggtttcctaggagggagaggggcagggaagacggcacagcaggagctcagaggactcaggcccaggtcactcgtatattccattgccttccaggacagagaaagttgaaccttcgccgggtaatgtttaaaaatggccggtgacacccagtagctgggaattccagggcctggctttggttctctctttagctggctgaggttgggaggcggacgtggcagccggcagagccagcaacatttggaagccggctaacgttggaaaatcaaccaggcgagctcacggtggcggccgatgctggaaacctgggctccgtgaggtccagcagatgccctgctggggcccaagtggacattctaggccttctgacagcccgccgggtttttaaataagtgtgattatggtttcagcaagtcctgtccttcctacagccaaaagatcaattcaatatggccactccgtgcaatgctgggccacccctgctgggccagggtgttgtgttgaagccaagattcccaacacctgagagtccagaagtttctttaaaaattgctttaactgtggtgagacacacatcacacactttttttttcttgagacagggtttcactctgtcacccaggctggagtgcagtggcactgtcatagctcatcgcagcctcaaactcccaggctcaagcaatcctcgcacctcagcctcctgagcatctgggaccacacatgcagcacgcaccaccacacccagctaatttttattttattttattttatttttgagacggagtctcactctgtcgcgccaactcggctcactacaacctccgcctcctgggttcaagcagttctcctgcctcagcctcccgagtagctgggactataggcgaccgccaccacacctggctaatttttgtatttttagtagagacaaggtttcaccatgttgaccaggttggtctcgaactcctgaccttgtgatcccaaagtgctgggattataggcgtgagccaccgcccctggctgacacccggctaatttttaaaaatattttgtagagatggggtcttgctatgtggtccaggctggtctcgaactccttgcctcaagtgatcctcccacttcagcctcccaaagtgctggaattacaggtgtgagccactgtgcccggcccagagacttttgaaagtctaaaatggattgtatcatagctcacatcactcctcttcccactgcaggataaaacccaggcctctcactgcaacacacaaggccccgaatggtcccgctcccctctccgttcgttcctctttctcttgcccaccacgctgcagcctggggtctgtctctgcctttcacacatccaacttcattcctgccccgtggaccttgcccttgtcaccgaacctttgtggaacgctttcaccccagctctccacatggctgggctccttctcccgctggagagccaccgtcacatcctcagagaggttctgcctgagtcctccctccaacgccgcccccaaagccattctgccttcggccagtttcattgcctccgtagaacctagaaccgtgtgaaatgatctgaggcttcctccgtgcactggttctgcccgtctccctccccacttccttctctgccatccccccaaggcctggcgagtagtaggtggtcagtaaacacctgttccgtgagtgccgggtgtgcgttgacctcccagtcaccaacggcggaagcttcagccagcggacgcagggagttgtcccttgcaaagggggtgggtgctcccgggcgggaagggtggggccagagcccacggcgatgcctttgtcatgagctaggatggactgaatttgggctcacagccacggacaggagagaacagtgtgtccgccccgtcagtgccatccagcgtgcgtggctgttgtgcatcatttgtttgcttgagcaaaggctacagggtccagtgacattcttggcagtccatgacacctcacagacctgggaagtcaagagacctggctcccggccagatgagggtatcatttgaaatacaatttgctggccggctgcggtggctcgcacctgtgtttcccctactttgggagacagaggtgggaggattgcttgagcccaggagtttgagtccagcctgggcaatatagcgagactgcgtctctacttttttttttcctgagacggagtctcgctcctttgcccaggctggagtgcagtggttcgatctcggctcactgcaagctccgcctcccgggttcacgccattctcctgcctcagcctcccgagtagctgggactacaggcgcctgccaccacgcccggctttttttttgtatttttaatagagacggggttttaccgtgttagctaggagaacaacaatttgctttccagaaccagagcctctcaacactagcatgtgtgtggtcatccatgctaaatggtgctgaaagaggcatttgtgtctctctgagaaggagctatttgaggaaagtcctgaatgaggggagagaatgagccatgtagatagctgagggaacagtgttccaggcagaggcgcagcccgtgcaaaggccctgaggcaggaccatgcctggtgtgttggaggaacagcgaggaggcccccgtggctagagcagagtgaggaaggggagacaggaaggaggggagggcagggaggggactgatcgggccatgcagggccttgtgggccacgggaagaaggtgggcttttccccgcaaagaaggtgggagctatggagggctgcgggcagaggaggggtaatgttcatttaactcctggagtttgacaaaatgctatcatcaaaacagactttatcacagaacctctagctatccccgtcccctccgtaagctcctctgagcatagcaacagaacgggaaggtaaggcagcgattggaaacgcccgcgttacagatgagcggagagccgctggaggttggaggctccgacagaggaggtgactggtccagagccacatggccaggttgtgctggggctggaactccatcgaacgcaggtttcagggtgcagcccttgtttccataagataccccaaaatcagacaagcctgggacttgccacctcttctttaaaaaccccagtgctgtttttgtttttgttttttttgagatagggtctccctctgttgcccaggctggagtgcagtggctcaatcatagctcacccactgcagcctcgacctcctgggctcaagcagtcctcctgcctcagcctcttgagtagctgatactacaggtgtgcatcaccacagccaggtaacttttttttttaaagtagagatggggtggggtatcctgtgttgcccaggcttgtctcaaactcctgagctcaagtaatcctccctccttgaccttccaaagtgcaggaattataggtgtgagccaccatgcccagccctccagtgcttttttttttttttttttgagacggagtcttgctctgttgcccaggctagagtgcagtggcacgatctcggttcactgcaacctctgtctcccgggttcaagcaattctccttcctcagcctaccgagtagctgggactacaggcacacaccaccatgcccggctaatttttgtatttttagtagagaccaggtttcaccgtgtcggtcaggctggtctcgaactcctgacctccagtgatctgccctccttggcctctggggattacaggtgtgagccaccactcccggccctccagtgcattttaaaggctctgaaaagtcctacgttgtcctgaaaactcctcagtgatgctgaacctttttgacctgtgaaccccaggtttgggtaaagtctgctcacatccggcggcacacccataggaaacccccagcccggctgtgaggagtgtgaactttgattcaccaggtccttggcccagctttagtttctcccgtgtccgtgtttgcttgtgcaatcatgaatatatattgaccagcaccaggtgccacattgaacagtttgtccgcgccgtcagtgccatccggcatgcacggctgttgtacatcatgtctttgcactggactgagctcagctgcagaaagcagcacatttcagagggtgtctaccgggccaggagaaaacacacaaaccgccaacattttaaagcttgtaatcgacatcgtatacaactggaaaagatgttcatttatatgttttgtttttgttttcttaagacagggtctcagtctgtcacccaggctggaatgcagtggtgcgatcatagctcactgcagcctggagctcctgggctcagacgatccacccacctcagcccccagagtagctgggactgcaggcacaggccaccacgctgggctaatttttatatttttgtagagatggggtcttgctctgttgcccaggctggagtgcagtggtgtgatcttagctcactgcagactcaaactcctggattcaagccatccccacctcagcctcccaagtagctgcgactacaggatgtgccaccatgcccagctaatttatttttatttttatttttgctagagagagtgtctccttatgttgaccaggctggtcttgaattcctgacctcaagcaatcctcctgccaaggcaatcctctcaaaatgcagggattacaggtgtgagccactgtgcccagcctgttcatacgttttaaagagaggtgcagacaaaactgggttggtgcatccacatccctctctgtgtgatgctgggtaatttgcttaccctctctgggtatcctggagattgtcagccccagccaaggatggttaaaaggcattaaacaatacctaggacagagcctgacatctggagctcattaaaccatccgtacatgcagatgtcgttataattattatcaatgctattctgtcactccacaccctgactcccacctcagtggccccaggtgggggtgctctgaaatttctctggcctggctgagcgggaggggccggggttctgctggaataaagaacagaggaggaagccttgaaggatttgttctgtcccagctgtccccagtatcacagttagccacacggatggcagaagggacctttgacagtggacacaggggctggaagggcccagcctggggctcactgcaatctccgccttccagattcaaatgatcctcctacctcagccttccgagtagctgggattacaggtgtgtgccaccacacccggctaatttttgtatttttagtagagatggggtttcaccgtgttagccaggctggtcttgaactcccgacctcaggtgatctactcacctcagcctcccaaagtgctggaattacaggcatgagtcaccgtgcctggccttggggctttatctgactggctagagaatgggattcaaacaccaggaatcatcccaaaccgccaatgagaaggagccctggagtgaggggaaccgagacccctcctaaaaggatttacagggtgtcacagaatcaaaattacagcaaaggctcaactgtgagatgccagggtggctgatcattgattctagacccatcactaccagctggtgttctgtgagtttgaagccattgctgtctagctttgtgcctcagtttccccagctggcgattaccgtcccccatatggggacggtaatcacgtgtctgctgcagaggagttacaaagatttgtgaggcaatggaggcaacatttgcagccgaacctagtcaaaggaattactcactgcgcattaatttgttgttttttgagatggagtctcgctctgtctcccaggctggagtacaatggcgcgatcttggctcactgcagccatcccccgggttcaagcaattctcccgtctcagcctccggagtagctgggattacaggcacgcaccaccacgccaggctagtttttgtatttttagtagagacagggtttcgctatgttggccaggctggtctcaaactccaggcctcaggtgatcctcccacctcagcctcccaacctccctagcatttcaacgacctgaagtgaccctcttgatttatttgctgacttgttcatttcctgtcacgttcccattagaacatcagtgcctcgagaggagggattcttgtctgtctctgtcgccgctgtgtcccttgggcgtctggcatccgggtggctctctgcaatctgtttgctgagtgatcaaaggaaagaactaatggcaacatagtgcagctccaatgtacagatgaagaaatccaggctcagagatgtggaagtacttgcccagggccacacagccggaagcccgccaactcttttagtaaagggccagtgacactgtaaacattttaggcttttaggcaggtcacatgcagtctctgttgcctattttttcttttgtttacgaccctttaaaaatggaaaagacaggccgggcgcggtggctcacgattgtaatcccagcactttgggagtccgaggcggacggatcacgaggtcaagagttcgagaccagcctgaccaacatggcaaaaccctgtctctactaaaaatacaaaaattagctgggcgtggtggcacgtgcctgtagtcccagctactctggaggctgaggcaggagaatcacttgaacccgggaggtggaggttgcagtgagccgagatcacgtcaccgcactccagtctgggagacggggcgagactgcatctaaaataaaataaaataaaataaaataaaataaaataaaataaaataaggaaaagaccatacttagctgactgtgcaagaataggcaaccccttctagtttgctcatctaatgtcagaacccacgaactgattccaaaaccctccacagagaatctaaaatgctgcaaaccccgactctgtgatgctggggatctaaagtgcttagtttgtttttttgtttttttgttttttgtttttttgtttttgtgttttttgagacagaggctcgctctgtggcccaggctggagtgcaatggcatgatctcggctcactgtaacctctgcctcctgggttcaagcgattctcctgcctcaacctcccaagtagctgggattacaggtgcctgccgccacacccggctaatttttgtatttttggtagagacggggtttctccatgttggccaggctggtctggaaatgctgatctcatgtgatccaaccgcctcaggctcccaaagtgctaggattacaggtgtgagccaccgtgccctgccaagtgcttggttctttagtctggagtgcagtggtacgatctcggctcactgcagcctccacctgccaggttcaaacaattctcctgcctcagcctcctgagtagctaggactatgggtgcatgccagcacacccagctaattttttttttttggtacttttagtagagatggggtttcaccatattgtccaggctggtcccaaacccctgacctcaagtaatcctcctgcctcggcctcccagagtgctaggattacaggtgtgagctctaccgtgcccggccaagtgcttggttctttctcgactcaatcctattttgttctacacaggtcaggtctgcctccactcccccaaccccatgccccatttcacccattggcctctgaagcccagagatgggcaggggtttgtctgagaccacacagcaagaggggcagcagaggaggacgggaacccagatctgcttccctcccaggctacacccctgtagccccccaacccctgcaaacttgttatttaagcctcctcattacaggggtttggagccgaggaagccctgctgccttttagtaaatgctctccctagacagcaatctttgatggaggctctgggagaagttgttcagtgatgtgcatttgtcgagcacctactgtatacctggtgccagtatagggttgggtggaagggtcttgtccactcaacacccctttttctgccctattattgccttccctggccaggcgaggtgactgacacctgtaatcccagcactttggatggctgaggcaggaggagcgcttcagccctggagtttgagttcagcctggccaacatagtgagacctcatctctacaaaaaaatgtttgttaaaaattagccagatgtagggccacaagcctgtagccccggctacttgggaaaagaaggcaagagaatcacttgagcccaggaggtcgagcctgcagtgagctatgatgacaccactgtcctccatcccgggccacagagtgaggccctgtctcaaaaaaaaaaaaaaaatcaagaccatgattgcccccccataaagagcccttttaaacattttttccctaatcactctcctgtgaaattttaatagcataggtatattttatatacctatatatattaaaaatgtacctgtgccatcaaatatatataatatatattatacataggtatataaagtataactatatgtcatatagataggtatataaaatgtacctatatggcctgtaggtatataaaatatgccatataggtatataaaatatacttacgccattaaatatatatttaatatacaaatatatttgtttttttctatactgtaacaacatatgtctgtacattattattattattattattatttttgagacagagtttcactcttgttgcccaggctagaatgcaatggcgtgatctcggctcactgcaacctccgcctcccgggttcaagaagcaattttcctgcgtcagcctcctgagtagctgggattacaggcatgtgccaccgtgcccggctaattttgtatttttagtagagacggggtttctccatgttggtcaggctgctctcgaactcctgacctcaggtgatccaccgcctcggcctcccaaagcactgggattacaggcgtgagccaccgtgcccatcctacatttttttaaaaacacaaaattctggccagacatggtggctcacgcctgtaatcccagtgctttttttttttttttgagatggagtctcgctccgtcgcccaggctggagtgcagtggcgcgatctcggctcactgcaagctccgcctgccgggttcacgccattctcctgcctcagcctccggagcagctgggactacaggcgcccgccaccaggcccagctaattttttttgtatttttagtagagatggggtttcaccatgttagccaggatggtctcgatctcctgacctcgtgatccgcccgccttggcctcccaaagtgctgggattacaggcgtgtgccaccacgcctggcctaatcccagtgcttttggaggcctaggcaggagggtcacttgagcccaggagttagagaccggcctgggcaatatagtgagacccccatctcaaagcagaacaacagcagaacttctgagctagacagacaactttgctttgaatctgacaccagctttgggaaatacgctgtgcgcactgggccttggttgaccaaccttacaaattgagcagatttaatcagatggggtcaggaagtgctaattcagcacagtaaaaactcagcagatggaagctgcccactggggtctggggaatcttggggctgtggaagttagccagccttcgacattatgcactttgtacacatctgctcagaccgaaagaaggtccattttaaggctgggtgtgtactaagtaggtggaggaggaggaattatctgtgcctctttttcttttctttttttttttttttttttgagatggagtctcgctctgtcgcccaggctggagtgcagtggcgcaatctcggctcactgcaacctctgcctcccgggttcacgccattctcctgcctcagcctcccgagtagctgggactacaggcgcccgtcaccacgcccggctaattttttttttttttttgtatttttttttagtagagatggggtttcaccatgttagccaggatggtctcgatctcctgacctcatgatccgcccgcctcggcctgtcagagtgctgggattacaggcgtgatccaccgtgcccggccacctctgtttcttttcttccagtttttcatggaagcagccagggccacacagtgcactagaatattcctcgctgatggcagaatattctgtgctgtccaacttggtcaccaccagccacgtgtggctctttggtgcttgaaatgtgatttgttcaactgagcaacttaaaatttaattttcttttctttttttttttttttttgagacatagtctcgctctgtcacccaagctggagtgcggtggctccatcataactcactgcaacctccacctcccaggcttaagcagtcctcccacctcagctccccgagtagctggaactacaggcatgccactacacccagctaacttttgtattttttgtagagacggggtctcgccatggtgcccagtctggtctggaactcctgggctcaagtgatcctcctgccttggctttccaaagtaccgagattataggcatgtgccaccacgccccgcctaattttatttcagcgtagctaacttaaatgtaaaaagtcatatgtggctgtgacccttgtactgatggctgtagaacgtgaggagttttcaggagccaaatgatggaagaatggtcagcaggtggttgagaactattcccaggttttagagatgatttaagatgagacggctggccgggcgtggtggctcacacctgtaatcccagcactttgggaggccgaggcaggaggatcacttgacgtcaggaattcaagaccggcctggctaacatggcaaaatcctgtctctactaaaaatgcaaaaattagccaggtgtggtggcaggagcctgtagtcccagctactcaggaggctgaggcagaagatttggttgaaaccaagagacggaagttgcagtgagccgagattgtgccactgcactccagcctgggcaacacggcaagattccatctaaataaataaatacataaatacataagatgaggcagccaaataaaaaggaaggagattctgaccaggctactcacatgggtgaaccttaaggacattaagctcaattgagaaaagccggacacagaaggacaaatactgcgagtccactcctaggaggtccctagagtcgtcagattcatagagacagaaagtaggttggcggggtcagggggtgtcggaggctggggaggggacggggagtgagtgtttcatggggacagagtttcagtttgggaagagtaggaagttctggagaggatggtggcgatggctgcatggccattggaatgtatttaatgtccctaaagctgtgcatggaaagttggttcaaatggtaaatattatgcgtattttaccacaataagaaattaaattaaaaattaaaatgagatggcatagatttatagcatattatttttaaaactaaactaattttgaccaggcatggtggtgctcaaccatggttccaattactcgacagtctgaggtggggggattgctggagcccaggaggtccaggctgcagtgagccatgattgtgccactgcactgcagcctgggtgacagagcaagaccctgtctcaaaaacaaaattaggccgagcacagtggctcacacctgtaatcccagcactttgggaggctgaggcacgcggatcacttgaggtcagaagtttgagaccagcctggccaacttggtgaaaccccatctctactaaaaatacaaaaattagctgggctaattaaaattagattagaaaattagattacaggtggcacacacctgtaatctcagctacttaggaggctcaggcaggagaatcacttgaacccgggaggcagaggctgcagcgagctgagatcgcaccattgcactccagcctgggcgacacagcgatactctgttccaaaaaaaaaaaaaaatttaatttaattaaaaaacacataaattcctaggactataggaaaagaagaaaacttccttaacccaagaaagggaactacaaaaccccacagctaaccccgtacttagtggtgagaggctggatgttttctcctgagatcaggaacaagacaaggacaccactttccccatttctattgaacattgtactggaagttctgccagaccaataaggcaagaaaagaggctggacgtggtagctcacacctgtaatcccagcactttgagagaccaaagagagtggatcgcttgagcccaggagttccagaccagctagggcagcatcgcgaaaacccgtatctacaaataatacaaaaattagccagatgtggtggcgtgtacctggggccccagctacttgggaagctcagataggaggatggcttgagctcaggagttcaagactgcagtgagccgtgattgtgccaccttactccagcctaggtgacagagcaagatcctgtctcaaaaacgaagaagagaaagagatcagcctggctatcatggtgaaaccctatctctactaaaaatacaacaaaaattagctgggcgtgtgggcgtggtggcacgtgcctgtaatcccagctacttgggaggctgggaattgcttgagcccgggaggcggagattgcaatgagctggatcgtgccaccgcactccagtcctggcaacaagagaacaagagcgagattccatctcaaaaaaataaataaataaataaataaataaataaaagatacaaaataacaccatcaaagacagtaccaatagcgatattaatcaaatagcaatagtagtgaagctgccctctgcctggtgaagcactcactatggcagccatggttctgggagttttattaataattcattcatcacctttttttttttgagatggagtcactctgtcgcccagactagagtgcaattggcccgatctgggctcactgcaaaatccgcctcccgagttcaagagattctcctgcctcagcctcccaagtagctgggattacaggtgcccaccaccacgcccagctaatttttgtatttttagtggagacggggtttcaccatgtggggcagaatggtcttgaactcctgaccttaggtgatccacccgcgttggcctcccatagtgctgggaatacaggcgtgagccaccgcacccagccaatgtttcattcattaccatcttgtccctcataaacagcttccaagagggggtgctatagttgtgtccatttcacagatgagaagagtgaggcgcggatgcatccgaggccccgctccctggctgcccgattcgcaagctcatgctgggagccaccgtggggcctgacacttagtaggtgcccaagaaacattctcccttcccagggaaacacccggatgccagctgggcactgcggcctgctgagacgccagctgggcactgcagcctgctgagtctgtgtgggctctggttccggaagagggtcctgtgcccacggcctggcgcccggacggccggctgcccaggctgggtccttcccaacgtcatggccaccggtgcccagccttgagacagtccaaagggaactggccagctccgaggggccgctggcagccccagcctgggatcagctgcagggcttggggccgagctgggcacactcccctcggctgctgtccggcccagatggccacggccggggcagcctagctggaggaagggcttctctcgtctgctcctctgtttcctgacgaggaaactgaggcaccgggccctgctcctgtgctgttcatggcatccttggtcttggcaatcagtgggtgctggacacacggtgtgtgcatagccattagcacggcgccaggctaactccagaggctccgtgcgctaggaaatatcattgctttgatcattcccacagcaaccctgagagtggtctccatttatttttttaaaacaaggtcttgctctgtcactcaggctggagtgcagtggcatgatcacagctcactgcacccttgacctcccaggctcaagtgatcctcctgagtagctgggactacaggtgcctgctaccatgcctggctaatttttttttcttttttgttgagatggagttttgctcttgttgcccaggctggagtgcaataatggcgcgatcttggctcaccgcaacctccgcctccggggttcgagcgattctcctgcctcagcctcccgagtagctgggattacaggcatgcaccaccatgcccggctaattttgtatttttggtagagatggggtttcaccatgttgatcaggctggtctcaaactcctgagctcaaagtgatctgcccgcctcggcctcccaaagtgctgggattacaggagtgagccactgcacctggactgtttttttgtattttttgtaaaaacggggtctcactatgttgccctggctagtctcgaactcctggcctcaagcgatcctcccgcttcggcctcccaaagtgctgagattacaggcgtgagccactgtgccactgcccctggcttaatcatcatctcattttgcggatgaagaaactcaggccttgaaaggaaagtgaggccgggcgcggtggctcacgcctgtaatcccagcactttgggaggccgaggcgggcggatcaccaggtcaggagatcgagaccatcctggctaacacggtgaaaccccgtctctattaaaaattcaaaaaattagccaggcgtggtggcgggtgcctgtagtcccagctactcaggagactgaggcaggagaatggcgtgaacccaggagacggagcttgcagtgagccgagatcatgccactgcactccagcctgggcgacagagcgagactccgtctcaaaaaaaaaaggaaagtgaccttctcaggagcacaaagacccggggggtcttggagacagtacttggctcaggtgtctgatcccagcacaaaactgtagataaaataaccctggtgaaaaagcccatcacagggcctgggagggagaacattgctcgtggttctgacccgcagctttccttgtttatgaaatggatacagccaggcatggtggctcacgcttggcatcccagcactttgggaggccgaggcgggcggatcacctgaggtcaggagttcgagaccagcctgaccaacatggtgaaactccgtctctactaaaaatacaaaaattagccaggcgtgatgacgcgcgcctgtaatctcagctactctggaggctgaagcgggagaatcacttgaacccgagaggtggaggttacagcaagccgcgatcgcaccactgcattccagcctgggagacagagtgagaccctgtctcaaaaaaataaaaataaataaataaaatagaagaaagtaataatggggcggactctcgtgattgaggtctccaaatgccctcaagtgcttcaggagtatcctctcctcactgcctcccagctctgctaaggcctgggcagtgtttgtgcccacgtggaagatgagaaacaggctcaggacagttaggcgacttgcctgaggtcacacagcgatcgcgtcctggccttggggtctggcgggtgggcaggaggggcgtgattctcttcctgcggctttcgacgttggttgctgccaccttcgtctttgacctgggtgatccatgggtggggctggggaggggcgtctgcctggctgggcttgtccacctgccccccaacttcagccctccgtggaggggtcagggctccagagggggcggatgtgactcgtcctgcatccaggctgccagagccgataacgctgagctcagcgtctgtctgcctgcgcgtctgccaaggaacctaattatttttagataagatggaggggcgggcgccggggcagagggagcacccaagctgggcgggcagtggggtcgtcgccatcagagagaccacccctcagcctcctctctctggggtccctgaacggcaacccaggactaacagccgggtccctgggactacaggggcagaggctgaggctaagggacgtgacgtctccaggactcacctctctggtcctcagtttccccatctgtaaaacggacatagtgatagacctcctgcatagggctaaggcggggctgaatgactgaacctcattttattttatttattttgttttatttattttattttatttattttgagatggagccttgctcttgtcgcccagactggagtgcagaggcatgatctccacttgctgcaacctctgcctcccgggttcaagcgattctcctgactcagcctcctgagtagctgggattccaggagcgtgccaccatgcccggctaatttttatatttttagtagagacggggttttgccatgttagccaggctggtcttcaactcctgacctcaagtgattttcctgccttggcctcccaaagtgctgggattacaggtgtgagccaccgtgcctggccgttttgttttatttttttgttgttgcttaatttcattttctgagatggggacttgctatgttgctcaggctggcctccaactccagtcgcccagactggactgcagtggtgcaatcctggctcactgcaacctccgcctccgaggctaaagcgattctcctctctcagtctcccaagtagctgggattacaggtgcgcatcaccacacctggctagtttttgtacttttagtagagatggggtttcaccatgttggccagtctggtctcaaactcctgaccctgacctcaggtgatctgcctcccttggcctcccaaagtgctaggattacaggcgtgagccaccgtgcccggcctgaacttcattttacagatgaggctcagagaaggcaagcgacttgctcagggtcgcacagcaagaaagcggcacagctgggatttgaacatcagtctgttaagattccaggtgtctaacttcttacccacgactgagccggccctgcagaagcggagggcttacccaacatacgggtacactggcgctcacagggcctagctggtgtctgcagggtgcctggccagatgtctgtgaccctctagggcagcagccaagggaagggcccaaagagagaccccagggcctgggtgtgttttggggccactgtttgtctccatagcactggcccagcccaggactggggccaccagcatcgacacttcatctgctcctggggtggggtctctgtgatgccaccagtgtttcttccctctctttgcagatgcagagcaaagcggcagtccccggacagggatgggctctgaccaggaggacagcaagcccatcacgctgggtgagtctgggggcagcgtggcggtgaagggcggagggcgcagccctgtcctcgtcttttatttgggaatcatttgcttggcaccactcgttttacagatgagcagactgaggctcggagaggttaaggggcctgtccaggggctaccagggagctgggttggaacccacgactctgagctcccagcttctgggctctgaggtgctcaccccatgggagaccccggagggttctacagtcccatgggacgtttgagggtttttgtttgttttgttttgttttcattcatttatttattttgagatggagtctcgctctgtcatccaggctggagtgcagtggcacaatctcagctcactgcaagctccgcttcccgggttcaagtgattctcctgcctcagtctcccaagtagctgggattacaggtacctgccaccacacccggctaatttttgtatttttagtagagacggggtttcaccatgttggccaggtcggtcttgaactcctgacctcaggtgatccgcctacctcggcctcccaaagtgctgggattacaggcatgagccaccgtgcccggcctgtttgtttgtcttagaaacggtctcacgctgctgcccaggctggagtgcagtgacaccatcctagctcactgcagcctggaccagctaggctcaagcgatcctcctgccttagcctctcaagtagctgggactacaggtgtgcaccaccatgcctggcttttttttttttttttttttttttttttttttgagatggagtatcactctgtcgcccaggctagagtgcagtggcgcgatctcggctcactgcatcctccatctcctgggttcaagcaactctcctgcctcagcctcctgagtagctgggattacaggtgtgtgccaccacggctggctaatttttgtatttttagtagagatggggtttcaccatgttggccaggctggtctcaaactcctgacctcgtgatccacccacctcggcctcccgaagtactgggattacaggcatgagccaccgcgcctggcttttttttttaattttttaaatatttttgtagagacagagtctcactatgttgctcagactggtctcaaactcctgagctcaagtgaacctcctgtcttggcttcccaaagcgctgggatcataggtgtgagccaccacacccagccctcatggggcgtctaatagatgggtaggacagtgtaattctatgttgtagggataggaagtgggaaaattaacctcacttagaccagagcagtcacttccatcctagcccccagctcctgcccttggcccccaccatttgtccttctcactatggccagaggacacctgtgagcccccaagtcagggcccgtccctcctctgcgcacagccatccacggctcccacctctcttggggtaaaagcccaggtcctccctgtggcccacaaggccctgcacaacctgtcccatccctgccctgtcctcccctcctccctctctccccgtcgtccactcccagccacacagacctcctcgccgttcctccagtgcaccagacccagtcctgcctcagggccgctgcacattctgttacctctgtctaaacagccaactaactgctcgcttgttctctccagatctcccctggtctcagctcaaatgcccccttctcagagaggtctaccctaaaccccttcagcataagcagcctctggctaccctcaatctttttttttttttttttttgagacagagtcaggctctgtcgcccaggctagagtgcaatggcgcaatctcggctcactgccatccccgcctcctaggttcacgccattctcctgcctcagcctcccgagtagctgggactacaggcgcccaccaccacacccgggtaattttttgtacttttagtagagatggggtttcaccgtggtagccaggatggtctcgatctcctgaccctgtgatgcacccgcctcggcctcccaaagtgctgggattacaggcatgagccaccgcgcccagcctggctaccctcagtctcagccctctgttttctttccttcagaggaagttagtgattgcctatggatttgcttagttgtttagtgactgcacgggtgtctgctcatctccccagtggaatgtcacctcctccagggcagaggctttgtctgtctacatctctgttgtgccctcagggcttagaatggggcctgatgcagagtgggtgctcaataaatacttgtagaaagaaaagaaggagagagggagggatgaagcagagagaagaagacaagagaggatatatggggagaggaaggaggagagatgaaaaagaaggaaggggccaagtgcggtggctcacgcctgtaatcccagcactttgggaggccaaggcaggtggatcacctgaggtcaggagttcgagaccagcctgaccaacatggtgaaaccgtctctactaaaaatacaaaaattagtcgggcatgttggcacacacctataatcccagctagtcgggaggctgaggcaggagaatcgcttgaacccaggaggcagaggttgtggtgagccgagattgtgcaccctgggcgacacagcgagactctgtcaaaaaaaaaaaaaaaaaagaagaagaagaaagaaggaaagaaagaaagaaaagaaagagagagagaaaaagaagggccgggtgcgggggcttacgcctgtaatcccagcactttgggggactgaggtgggtggatcacctgaggtcaggagtttgagactagcctgatcaacatggagaaaccctgtctctactgaatatacaaaaattagccaggcgtggaggcacatgcctgtaatcccagctacccgagaggctgaggcaggagaattgcttgaacccgggagacagaggttgcagtgagctgagatcgcgccattgcactctagcctgggcaacaagagtaaaaactccgtctcaaaaaaaaaaaaaagaaaagaaaagaaaaagaaggaaggggccagggcgcagtggcttacacctgtaatcccagtactttgggaggccgagtcaggtggatgacctgaggtcaggagttcaagaccagcctggccaacatggcgaaaccccatctgtactaggaggacacgggaggctgacgcaggagaattgcttgaacccaggaggaggcggaggttgcagtgagccgagatcacgccactgcactccagcctgggggatagagtgagactgtctcaaaaaaaaaaaaggaaaggaaaagaaggaaggaagagaaagcgagtgggtgaggcgtccttcttggaaggaccggaacaggcatgcacagggaggctggaaggttctcggaggttcacaggcctgaggccactcctcactggcccccggtgactcctccgtctgtgacccgggtcctccgcggcctcctgtgatccccagacgcctctctccaagccagatgttggagggaggtgggggcagcggcgcttggcctggtcccctggggagcttgggcgtctggtagaggaaatcacgtcctcccagctcgccagggagtcccccagagatggagctgagcaggcgctgcacaaacaggaaaccccggtcgggggaggcggagggggcgtgctgacaccagctggccagctgggtcagcaggaaacggctctggccacttctcctggacactcgggggccaccgctctgtcctcttcagaatgcgtggccctgaacctcccagcgcggggcagggttggttcattgccttcactcagcaaatgactgtaacagggggccgggtgcggtggctcacgcctgcaatcccagcactttgggaggctgaagcgggaggatcgcttgagcccaggagttcaagaccagcctgggtaatatagcaagaccctatctctacccaaaaaaaaaatatacacacacacacacacacacacacacacacacacacactagccccaggagttcaagaccagcctgggtaatatagcaagaccctatctctaccccaaaaaaaaaaaaaaaaatatatacacacacacacacacacacacacacacacacacacacacactagccaaacacggaggtgcatgcctgtaatcccagctacttgggaggctgaggtgggaggatcgcctgagcccaggagtttgagaccagcctgggtaacatagcaagaccctatctctacaaaaagtaataataataatacaaaaattagccaagggtggtgatgcgtgcctgtagtcccagctacttgggaggctgaggcaggagcatcacttcagcccaggagttcgaggctgcagtgagctatgattgcaccgctgcactcgagcctgggcaacagagcaaaattctgtctctaaaaaagaaagattgtaacagggggactggcgggggtttgggtctgcagaactggacacagccctgagctccctgcagtccgtgctgccccctgggggccgggagaggaactgctcccaccgccacccaaaagccaagagcctgtcccacctccaaacctaccaggctccctggctctttccactccaaccctgctggcctgcaacttgccaagtgcatttctacccggaggcctttgcacgggctgttcccagtgccgggaacatcgtggccctcagggaggtgatgaaacatcatccccatcggagaagccaacagtcacggggcggttgccaggcgctgttctcggagctttgcagattttaacaagttccttcctcttatccagtctcatcttgaggtctgtaaaatgccaccatctcggtcaggctttctctgagccctgggtgtaaaatagcctccctccccaccctagctagttccccaccagccgcctgccttaccacaggctgatgcacctcgcatttgacttaatgagcttttaatttgtagtaaaatgtgcatgatgtacaatgcatcattttagccatttttaagtgtccaagtcaaagtgcactaagtacattcacctctatctaattccagaacctttctttttttttttttttacccccaggctggagtgcagtggcgcaatctcggctcactgcaacctccaccttcctggttcaagcaattctcatggctcagcctcccaagtagctgggatcataggcacatgccaccacacccggctaattttttgtattttcagtagagatggagtttcaccatgttggccaggctggtctcgaactcttgaccttaagtgattctcttgcctcagccttccaaagtgctgggattacagatgtgagccgccgagcctggcctaattccagaacatttcatcccccctaaaagaaaccccatccccatcagccaccactccctgtctcctctcccagccctggtgcccacgcatccccttcttgtctctgtggcttggcctgtcctggacatttcagtgaaatggctcatgcctgtaatcccagcactttgggaggccaaggtgggtggatcatgtggtcaggagttcgagaccagccggaccaagatggtgaaaccccgtctctattaaaaatccaaaatttagacaggcactgtggcaggtacttgtaatcccagctacttgggaggctgagacaggagaatcgcttgaacctgggaggcataggttgcagtgagccaagattgcgccactgcactccagcctgggcgacagagtgagactccgtctcaaaaaaaaaaaaaaagaaaagaaaaagaaagaaagaaatggcatcacacactgtgtggccttttgtctctggtgtccctcactgaatgatgtcctcaaggtgcatccatgttgtagcctgtgtcagagcctcgttcttttatttttatttatttactggttttgagatgaagtctcactctgatgcccaggctggagtgcaatgtcgcgatctcggcctgtagctgggactacaggtgcccgccaccatgcccggctaatttttgtatttttagtagagatggggtttcaccatgttggccaggctggtcttgaacccctgagctcaggtgatccacctgcctcagcctcccaaagtgctgggattacaggtgtgagctaccactactgcgcccagcccaaggcctcattctttttcttttccttcttcttttttttttttttttttttttttttgagacagggtcttgctctgtccccgaggctggagtgcagtggtgcaatcatagctcactgcagcctcaacctccagggctcgagctatcctcccgcctcggcctcccaagtagctgggactacaggtgtgcaccaccacgcccagctaatttttgtactttttgtagggatggggtttcgccatgttgcccagtcccgtctcaaactctggggctcaagtgatccacctgcctcagcttcccaaagtgctgggactataggcacaagccaccatacccagctaattttcgtattttttgtagacacagggtttcgccatgttgcccgggctgatctcaaactcctgagctcacgagatccacccacctcagcttcccaaagtgccgggattacaggcatgagccaccacgcccggcatccttttcacggctgagtcctattccagtgtgtggctagaccacgctgtgtttatctcttcatcttttgaagggacatttgggtggctttccagtttgagctgtggtgaacagtgctgctaggaacattcgtggacttttgctgacctattaatcttggctgctgtctgtcgctcacactggactttgagtctcacaggggcaactgcttcagcctgtatcatctcctgctgtgccggggcccagctcagaatcagacactgtggatgcttagtaaacgcctgttgagtccatgaatccctcctacaagggcgtccgagggcaggacagggctgtccccaagctgtctgaggttggccaaggctcccgacctctcggggacaacttcgatttccaaatctgtgaaatgggtccaaaccactccagtcgagaggacagtctcccttcctttaatattaggtaggagcaatgctggggacactgagggttttaactgcggcttgtgggcctcccattcaaccccccattttaactgacccattgctgggtgccaagctctggtctaggcacgaaggacactgcagggtcggggcagacagacatccctgcccacacggacctcccagtctgaaggggagaagaacaagaagccagagtatctcgaagggtgacagtgtgtaaagcaagccagctgcccctcccaggcagttggatacagatctcacgacaaccccgatgatgggattgatggtttcacttttgcaattagggaaacttggaggctgagagagggaaagtgacctgccccagatcacacaccgaggcaggtgatggagccgatgtgagcccaggcctccgctttccgctcttttttttttttttttttgagatggagtcttgctctgttgcccaggctggatggagtgcagtggcgcaatctcggctcactgcaagctccacctctcgggttcacaccattctcctgcctcagcctcccaggtagctgggactacaggcgcctgccaccacgcccggctaatttttgtatttttaggagacagggtttcactgtgttagccaggatggtctccatctcctgacctgtgatcctcccgcctcggcctcccaaagtgctgggattacagacgtgagccaccgcacccggctccactcgttttttaagagagggtgtcgccctgtttcccaggctggagtgcagtggcacaacaatggttcattgcggcctccacctcccaggctcaagtgatcctccagcctcagcctcctgagtagctgggactacaggcacggaccacaacacctggctaattttaacactttttgtagagatggggtctcgctgtgttccccaggctggtcttgaagtcctgagctcaagcgttcctcctgcctcggcctcccacagtgctgggattacaggcatgagccactgcgcccggcctgctgttcacttgaatgcagcattccacagcatgggggaacccggatgaaggctgtgtgaaggcccacactggacaaggaccccccacggggccttccccatcagactggagctgtcattcccccacagcacaggatggacagggggaacgtccaggctcgggccagcccccaggagtccaggcagccctggagtgtggggaagggaaacaggcccagctcagcctactgaccccgctgtcttcctgttccagacacgaccgacttccaggagagctttgtcacctccggcgtgttcagcgtcactgagctcatccaagtgtcccggagtgagtgttcccgtcagccctgagctgggtcttggagaggggagggggccgcagggaggaaggagcccacccccctcaccctactccttgtcctttccagacaacccctgtgtcactaagccaaggttcctagaaagggaggtggccaggcccttcccagagcccaaggtcagggctccctcccacctctccaggaaacagaatctaaatgctggatggcaactaaggaaacttctgccccagcatccctcctcctccctggggcctccactgtcctgtcccaggagaccccaaaggaccccgcccctcctgtccccttgctttctctgctgacctgctggggacccagcacattccgtcacacactgtctgaatcccaccccagcgagtcctgggcgctgtccttctttagccctgactgacaccttccctgtccagatcagcagagcctggcctccagctttggctacacctctgcctcacagtgtgctcttggcctctccccatggccttggtcctctgatccatagaataaaactggtttcagccaccctaggaaccgggccaatatgggaagggggtccccctttggactgcacccagtggctttccctacctctctaaagcaaaccgcagcactgggcactgcttcctgcctcactctcctctgtcaccctctgcagcacccgtggtgactggaacaggacccaacttctccctgggggagctgcaggggcacctggcatacgacctgaacccagccagcactggcctcagaagaacgctgcccagcacctcctccagtgggtaagtacccaggtccccacctctgggcatttcatgaccccattcatcaacccatcccctctggcccgagctgactcattcctctccctggaatacctcttttcacgattcacctggcctgagaaactcctactcatctcatccttcaaaacccagccagccccacgtgcctcttcccctagccctgacagcccaccgtgggctcccccagcctcaagtcctgccggctcagccagcccttaggaccctccccacccagaagaatgcagacacaggttgttgctgagatatgctttgtgacctcgagcaggtcacactgtgtgtgccccagtttccccatccataaaatgggatcatacccctaacaggcagttctgaggactacaggtggccaggagattagccaggctgcctgggttttggtctccaccatgctagcttggtgtccgacctgtgttgagaccctccctgcctctggcccgggtgtcccatccaagcaatggacaggttggaacaggcgttcgtagggaacgggctgaacgcccgcggctcccgcgatgtctcgcgatactacctccctcgcccccgctcacttaaggaccggaagtagcaaagcccgccgtcgcgccccccgccccgcgtctccctggtaaccagcctctccccttccctcgcccataaggagcaagcggcacaaatcgggctcgatggaggaagacgtggacacgagccctggcggcgattactacacttcgcccagctcgcccacgagtagcagccgcaactggacggaggacatggaaggaggtagggctggtggcgggggcggagccggccttccggtctgagtcaccgcggcgggaactacgtcttccggcagccactgcgcgggcgccgcggggcaggaagccggcctggagccgcggggcctcctgggaattgtagtcgtcccgagctgcgcttggctggaagtacggtccgggttcgcgttctcggatctctttggttccgctgcggcgaaggagggcagagactgtcccctgcctgactctcctgccctccggccgtgaatgccacatctctgtggggtccccgagctgcaggatggactcagtagtgactctgatcaacagggcgcctcttcctgggatctgtcatagaatccctcgtctgtagggaccctgtttgtcctcttcccctctagaaggtcctgagatgccggatcccttctcattggggtccttcttgaggttacttttttttttaaccaggttcccatctccatgggatcttctggttctgcaggagactcgtctcctttctgtagggtctccattcccatggcgtcgttttctaggaagattttatcctcttgcttttctgtcttcagaagggtcctctctggggtgtctttctttctttctttctttctttcttttttttgagatggagtttcgctcttgttgcccaggctggagtgcaatggcgcgatctccgctcactgcagcctccacctccctggttcaagcaattgtcctacctcagcctcccaagtaactgggattacaggcatgcaccaccatgcccggctaattttttctatttttagtacagacggggtttcaccatgttggtcaggctggtctcaaactcccgacctcaggtgattcgcccgcctcggcctcccaaagttctgggattacaggcgtgagccaccacgcccggcctctgtttttgtttgtttgtttgtttgtttgtttttgaaacggagtctcggtctgctgcccaggctggagtgccggggtgcaatcttggctcactgcagcctcgacctcccaggttcaagtgatcctcctgcctcagcctcccaagtatcggactgcaggtgcatactgccatgcgccgttaatttttttttttttttttttttttttttggtagagatggggtctcactatgttgcctaagctggtcttgaactcctgagttcaagtgtgatctttcctcctgcctcgtcctcccaaagtgctgggattccaggtgtgagccaccatgccgggcccctcttatttttttttaatttttgttttttgagatggagtcttgctctgtcacccaggctggagtgcagtggcgagatcttggctcactgcaacccttcctcctgagttcaagcaattctcctgcctcagcctcccaagtagctgggattacaggcacccaccaccacacccggctaatctttatatttttagtagagacagtgtttcaccatgttggccagtctggtctcaaactcctgacctcaggtgatccacccacctcggcctcccaaagtgctgggatgacaggtgtgagccactgctcccggccacctgtaggatttttagaagcagtataacattaggattaagaggtcagattcaggcattggagagacctgggttcagatcccagccctgcccgtgtctagctctgtgtgctgtgtaacctggggcacatcacttaacttctctaagcctcagtttcttcatctccacaatgggggtgatgtgaataatgttctttgggagctacaggaggaggaagggtaggatgtgcgtgaagcaaccgtctggcccatgcgacatacccgggaaacgggaggtcactgtcatccacgtctttataacattcctgtctctgaccaggctcggtggctcacgcctgtaatcccagcactttgggaggccgaggcaggcggatcacgaggtcaggagatcgagaccatcccggctaacacagtgaaaccccgtctctactaaaaatacaaaaaaaatagccgggcgtggcggcgggtgcctgtagtcccagctactcaggaggctgaggcaggagaatggcatgaacccgggaggcggagcttgcagtgagctgagatggcgccactgcactccagcctgggtgacagagcgagactccgtctcaaaaaaaaaaaaaaattcctgtctctttccggcactcggacgcatctagttgtgacatttcaggtgccaaggcccctcccttccacagtgtgggctcccagagcaggaacattcctaaagggtctccatccctcaggggacctgtctcagtatttatgaggttctttttttgtttgtttgttgtttttgttttgagatggagtcttgcttgttttgagagatcacgccagtgcacgccagcctgggcaacagaacgagactatgtctcaaaaaaaaaaaaagaaaaaaaaagtcacttctgtttcgttttttttgttttttgttttttgttttttttttgagacggagtttcgctcttatcacccaggctggagtgcagtggtgcaatctcggctccacctcctgggttcaagtgattctcctgcctcagcctcccgagtagctgggactacaggcgggcaccaccacaaccagctaatttttgtatttttagtagagacggtttttactatgttggccaggctggtcttgaactcctgacctcaagtgatccgccaacctcaagtgatccgcccatctcagcctcccaaagtgctggcattacaggtgtgagccaccgcacccagccgtgacttctcattaactctgtaattgatgaggctgtcagaatgtaaactgcacgctaattaaagtgaaagaccacctttgcgatgagccaaagcaaccctgagaggaaaaattgtagctttaagtctatttattaggagaggagaaaggtggaaaataaagaatctagctttcaacagagaaaactcaaaaagaaaacattttaagctctggagctcagtctgacttttctgcccggctgctcactggcaaccccttccactggggaaggaggtggtagcaatggcggggacaaagaggaagcccccaccagcttctgctctgtgattgggaatcgcagagctagcagggaatgtcagaggaggtctgtgctcctgcagcttccacttgattacctcaggggatggcaaactcactccctcctgagggtttctttttttttttttttttttctttttgagacagagtctcgctctgtcgcccaggctggagtgcagtggcgccatctcagctcactgcaagctccgcttcccgggttcacgccattctcctgcctcagcctcccgagtagctgggactacaggcacccactaccacgcccggctaattttttctattttcagtagagacggggtttcaccgtgttagccaggatggtctcgatctcctgacctcgtgatccgcccatctcggcctcccaaagtgctgggattacaggcgtgagccaccgcacccggcctcctcctgagggtttcatcctcagtgtaaagccctcctgtgtgctggccctacctgaggccctggggacacagagatgatccaacccactcttgtccctaccttccaggggctaacagcctagtgagggagatgggtttttatccaggtgactacagcccagaggaggaggcacagaagacagtcagggggaacaagaggaccctgatagaacttggaagaaaagggaggacctccccgaggaggagaatcaggctgacagagcagtgaggagctcgggcaactggcttctctgcttctccagctgtgtgacatttggcaggttccttaacctctctgcccctcaatttcctctgctatacgatcaggttgctggccgggtgcagtggcttacaactgtaatcctagcaatatggcaagaccccatctctacttaaaaaaaaaaaaaaaatagcatcacatagtggtgtacacctgtagtcccagctccttgggaggctgaggtgagaggattgcttaagacgggaggtcaaagctgccctgagctatgatcataccactgcactccatccggggcaacagagaaagaccctgtctcaaaaaaaaaaaaaaaaaaaaaaaaaaaaaaaaaaaaaaaaaaggctcacctgtaatcccagcactttgggaggccgaggcaggcggatcacctgaggtcaggagttcgagaccagcctggccaacagggtgaaaccccatcattactaaaaacacaaaattagccgggtgtggtggtgggcacctgtaatcccagctactcgggaggctgaggcaggagaatcacttgaacctgggaggcggagggtgcagtgagccgagattgtgccattacactccagcctgggcaacaagagcgaaactccatctcaaaaaactctgccttgatatcccagtgaagagaaaacactggaagaatttttttttttttttttttgtcagagtcttgctctgtcgcccaggctggagtgcagtggtgtgatctcggctcactgcaagctccgcctcccgggttcatgccattctcctgcctcagcctcccgaatagctgggactacaggcacccaccaccatgcccggctaattttttgtatttttagtagagacggggtttcaccgtgttagccaggatggtctcgatctcctgacttcgtgatctgcccgcctcggcctcccaaagtgctgggattacaggcgtgagccaccgcgcccggccaaacactggaagaattttaacacccgtggcccagggctggactttacgtaaagcacgcacctggggcgtgagagccgggtttattattaattcgcggctaagctacaaccgggatgatttaagtggatttatccgcagggaagatgatgggagggcattcccagcagggagaatcgtggtttgaggagttgcactgtggatgtttggggccagaccatcctctggggcggggctgtcttgggcactgttgggtgctgtgcagagttcatggcctccacccactccgtgtcaggagcaccccccagtggtgacaaccgtaaatgtccccagacctggccaaatgtctcttgcgggcagaatctcccctataatatagccagaggcatatgcaaagcacctaaacggagtggggagaaggtgcgtgacccctggtctgggccactcttttttttttttttgagacggaatctctctctgtcgctcgcccaggctggggtgcaatgcgcgatcttgactcactgcaagctctgcctcccaggttcaagcgattctcgtgcctcagcctcccgaatagctaggattacaggtgcccgccaccacggctggctaatttttgtatttttagcggaggcgggttttcaccatgttggccagtctggtctggaactcctgacctcaggagttccaccacacccggctaattttgtgtttttagtaatgatggggtttcaccctgttggccaggctgctctcgaactcctgacctcaggtgatccacccgcctcggcctcccaaagtgctgggattacaggcgtgagccactgcgcctggccttttttgttttgttttgttttgtttttcccaaatagtgacttgctctgtcgcccaggatggagtgcagtggtgcgatcagcgcccactgggctcatgccatcctccttcctcagcctcccaagtagctgggactatgggcacttgccaacacacctggctattttttgtactttttgtagagacagagttccctgtgttgcccaggctggtcttaaactcctgggctcatcctcctgcctctgcttcccacagtgttgggatggcaggtgtgagccaccacacccggctggccgctttttctctatgtcccttcccaacattttagtcccagacagccctgcggaggtgcctggcaggcacctcattttgcagagggaaaccctgaggctcaaagaggtgacatcacctgctccaggtcaccccagcggcaagcgggtgcacagggacacggaaccacgtggccgttcccagcggccccactcagggtacctcgctctctttgttttatggggcatctgtgatgtcctaagccgggttatttcccctcccggcaacactctgtgagatcagggctgcccctggccatcagttgacaagtggggaaactgaggcccaaaggtcccacagcaaagaaggggcagagccccgagcttatgcccagtgcttcctgggcctctccccatcgctgtggcctgcatcggtaaacatttcgcagcctctgaagtcccaagggggacgcctcagaacaggcctggcccctgggctggagcagggttcctgaggttcccagtggggcccagctgtaacctcattggtggaccgaggcaagggccagaggggcccaagggaagggccagaggggccgggggcacaggaagggccggaggggctgggggcacggggagggccaggcttattgttgcagcctgcaaggctgtcccaagccgggtgcctccgcagagggaggacacaaaacaggaacccaggcaggcagggtctctcccgaaggtgcccttggcccctggccaccaccctgggatgctcctcctcctcctcggcatcctccccccacccttccctgccctttccagcttcctgtctagacagcccccaattagccactcattaagggggttaagctgattagagcagctctcccttcctctggcggactcggggccttttctcccgggcagtgctcagccagtccccaaccctgaggctcacagaggcctggggggatcatgccagcccgatgccaggcaagacccccaccccacacctccaggccccacattccagcctctaggctttgcccgcttggggcctgggccaggccctttctcctggccgcctccacccgaggcctccctgcttacgcggctgcgtggggtggagggaaggtgccttggagcagcccccactgtgctttgtttttgctgcttgtgtagctcccccttgaaggcgacaaaggtcccgtccacaggcggttattacacagggcggggcaggcagcccccatccattcctctcctctgtcaccccaggcttcccatcccttttttttttttttttttttgagtcagaatctcactctgttgcccaggctggagtgcagtggcatgatctcggctcactgcagcctctgccttccagattcaagcaattcttctgcttcagcctcgcaaatagctgggactgggactacaggcgcctgccaccatgaccagctaatttgtgtatttttagtagagatggagtttcaccatgttggccaggctggtctcaaactcctgacctcaagtgatccgcccgcctcggcctcccacagtgctaggatgacaggtgtgagccaccgagcccagcccgcccatccctttttttaaccccagggtggaggctagtgcaacgtggcctggggagggacagagttgggttccaactccacctccacccccccttggctctatggccttaggcgagtgacgtcccccatcaggcctcagcctccacatctgtgaaatgggcgcagctcctgtaagctctgcacggggcagctgtgaggaccacattaagagaggaggctagtgccttcacagaaggtcctcacccagggcgatgctgccccacccccagggacactggccggtgtctagggacatctgtggttgtcacaactgggagagctcttgacatggagtgggtcgaggccagggatgctgcttagcaccctgcagtgcccaggacagcccctccccagggaacgagccagccccaatgtctacagtgctgaggctgagaaacctgtattaattatgtagaaaaaaattgaggctgagtgtggtggctcacacctgtaatcccagcactttgggaggccaaggctggaggatcgcttgagcctagtagtttgataacatagggaaaccctgtctctacaaaaaaataccaaattagctgcatgtggtggcgtgtgcctgtagtcccagctactcgagaggctgaggttgggaggatcgcttgagcccaggaggtcaaggctgcagtaagctatgattgcaccactgcactccagtctgggcaacagagtgagaccctatctcaaaaaaaaaaaaagaaaaagaaaaaagtctgccccctgctcacaacggattaaactcctagtgtggcagacggtgtgtaaaccagggggacccccagctcctgggactcacctcctctctccctccccactcaaggtgtggatttcaatgtgtgcagcctcctgggacctctgcagggcagaggatcatgggacgcagaggatcatgggacgcagagtctcttgggggtccatggaatcctctaagacagaggattttacctatgggtgatcctgaccccagaggacactgggtgacatctggggacctgtgtggttgtcacgactgcagggtggtcctggcatggattgggtccagggacaccgcttagcaccctgcagtgctcaggatggccccaccctagagaatgatccggtcccaaatgtccacagggcccagaggagaccttggtgcactgtcaacgccccgtggtcactgctgtcctcatcagattcatgccctgcatcggggcctctgtccactccacacactctgtgtagggcccctcctgaccccggaccctagagacccagccagagtgggccttggccccctgggggagccggcatttcagtgggagatgggcttgtttgttgagcaaacaaatggctgctccgacggggtgatgagggccttttgtcaaatacaaagaggaggtcagatgggcgtgtgtgacaaatggctgctccgacggggtgatgagggccttttgtcaaatagaggaggtcagatgggcgtgtgtgacaaatggctgctccgtcggggtgatgagggccttttgtcaaatacagagaggaggtcagatgggcgtgtgtgttaaacagacaggaagaagctctgatgggggagccctcgggcctgcgtcctcctcacagtcaatattctcagatggggcattcaggatgccgggaggggcgtatggatgtgttccctgagaggaaagatggccactgagatgggcgggggacgcacatgcccgctggctgaacagggaggtcccacaggggtcccaggcatgcctgctgaacagacagaggatgcttggaggcggggtgcagagtcagtgtccgtagagcctgccgggagcatgccggcttattctttctcgcggtgcctgagctgcgctcccccctccttcctgccctgccctggctgccgctggccccatctcaggaagctctagcggtgcctgcagggatgtggcggccgggggtggagtctgagccagactatttccatccaggacaagcggttctaggaaatcctcctaaatgagcgtctgacaaccctaacctcgttcccgccgtggccctgcgcttgcagggagctgccagcccctgcacacacacacacacgcttgcacacacgcatgcatgctcatacatatatgcacgcacgtgcacaggcgtgcacacatgtatgcatgcatgcttgcagacctgtacgtgtgcgtgcaagcacacatacatagacatgaacatgcatgtgcaggcatacacatacatgcatatattcacgtgcacacgcatgtgcgcattcacacacatagacacgtgcacaggcatacacatacacagatatgaacgtgcatgtacaggcatacatatgcaggcgtgcacacgtccacatatgctcacatgcgtacacacacatgcacagacatgcacacatgcatgcagctgtgcacatgcgtgcaggcatacacacatacatgcacgcacacacatgcatgtattcacatgcacacacacacgtgcacaggcatacacatgcacacacacgtgccgacaagaccagcctggcctccccggctccaggccaccctcattcctgccacatcctcctgccctggaaaagcccgggcctggctgctggggcccagcttggtcacagacttcatggcatcccactgggcagtggggcctctctgggtggctcagcctcgatgtccgaggcctcaggagtgttcccccttgagtgttcacaggctgggcatgagtggaggtgtcatccttcctgccccccatgtgggtgtcctgggtgcccgcctcctccagagccgggtgttcccgggtccctgggaactgctgacctgcttctggggtgtgtcccagtgacaccttcactcctcacagcatggtgtgtgcagggccatggggacagctggttccataaccacaaaagcagatgaagagctgcatgtccccccacagctgggtcctggatctgggctccccctgggctgcagccatcagagaggacggaagttccctgagtggtaaccccgttcagggaaggatgcagcgatgctgggaggatggaggaggtggggacaggactggggagggcctgtaccacacagatgcctgcaggtgcctatggaaccaccagcaggagacccaagacacggtgacatcctcaccgtttctcatcagggcatcacccggggacagcaggtcacatctggggacatccgtggttgtccccactgaggggcgctcttggcacggagtgggtggaggccaggggtgctgctcagcgccctgcagtgcccaggacagctccctacagagaccgatctggcccccacatcagcagtgctgagactgagaaatcctgcgtgaattatttggaaaatattgagttatgtcactgctcacaccagacaccagaagaagctcctgacagggcagacggtagaaaccagggggaccccagctcctgggattcacctcctctctccctcctcactccgtgtggatttcagtgtgtgcagcctcctgggaccacagcagggcagaggatcatgggacatagtctcgtggagggtccatgggatcccctaacccagagggtctcacccacacgtgattcttgcccagggtacttttggtgatgtctggggacatctgtggttgttacaaccgggggtgctcctggcatgaagtgggtggtggccagggactctgctcagcaccctgcagtgcccaggagggccccaccccagagaatgatccagccccagtgtccacagtgcctgtctgagagaccctggaggtaaggaactccaagggccaggtcgaagggaagctaaactcatcaccctgtttggatggtctcagtagatatgttttaccttaaaagaaatgtaaaaatcctttctaaaaattcggctccccagggcacgcctccctgagattccatttccagggatagggtagggcccaggacactgcatttctcaggcaagatgtgatccttagccctcacttgaaaaagcttctctggggccaggcactgtggctcacgcctgtaatcccagcactttgagagaccaaggcaagaggatcccttgagcccaggagtttgagaccagcctgggcaacatagcaagaccccatctctaaaaaaaaaattgcctggacatgatggtgcatgcctgtggtcccacctacctgggaggctgaggtgggaggatcacttaagcccaggaggttgaggctgcagtgagccatgatcgtgcctctgcactctagcctgggtgacaaataactcggctgggtgcagtggctcacgcctataatcccagcactttgggaggccgaggtgggtggatcacctgaggccaggagtttgagaccagcctggccaacatggtgaaaccccatctctactaaaaatacaaaaatgacccgggcgtggtggtgggcgcctgtaatcccagctactcgggaggctgaggcagtagaatcgcttgaacctgggaggcggaggttgcagcgagccgagatcacgccattgcactccagccagggcgacagagggagactctatctcaaaaaaaaaaaaaaaaaaaagacacagccccagaaggccaggcatttcggctccagagctgggactccaccccagcctcctggaaatacccaaaatggccctctttggggctctgtgttcccacttcattttgaagacagggtgaaagtgtcaaggggcaccgtgtcatctccccactcaccccaaatagcagcagcagcggctcctgcagtagctaacattcttccagctgggtggctgacgttccctcggaaagcagggctgaaggcatcctcagagaatgccccgatgcccagggatctgggacggccatgggcttcacctgcacaggcacccctggcccaatcctcacagctgccactcccacactgctcccgatggaaattccagagctttacagaatcccctgttttatgaaaaggggtagacgtggcagctcaccccaggtcgcacagcctcatggccagccggggtttgaaccctggaccacctgcttcccccacacccaggggctttccagggggtgcctggagggggagggaagccgatgtttggtgggtgagcctccctgagtccatccgttttttgtttgtttgtttacttgcttgtttgtttttgagacagtttcacagtttcattcttgttgcctgggctggagtgcaatggcgtgatctcggcccactgcaacctctgccgcctgggttcaagcgattctcctgcctcagcctcccaagtagctgggattacaggcgtgagcccctgcacccgactatccatctgttttttgtgtttgtgatggagtcttgctctgtagccctggctggagtgtagtggcgtgatctcagctcactgcaacctctgcctcctgggttcaagcgattctcctgcctcagcctcccaagtagctgggattacaggcacccgccaccacacccacctaatttttgtatttttagtggagacagggtttcaccatgttggccaggctggtcttgaactcctggcctcaagtgatctgcccacctcagcctcccaaagcactgggattacaggcatgagccactgtgcctggcctctgtttcttcattcattgattcactgaggaaggtgtgaggggctgagctgctgagttgggggctgtgggggcttttgtcccaggcagcctgggaggtagtgaggcccctgtctgcagagtgatgccagcaagtcactgcagaggggggatgcacctcatttcagccccagggaggctccgttccttcctcccgcgtggacgagggaaggcagagctgagctggggcttgtctgtgcgcccttagccagtcagggtctaactggacttcggatctgactgtctctgccctccctgccaccttctctagggctcgggtgactcccaggtgatggggcagccctgagccttcccatttctctggaaggagagtaggcaagggccaggagcgaggcccaggggcacgtgttgatacccagctctccatcccccggctgtgccgccctggctagccccttctctgctctgagccttcgtttactcctctgtgtaatgggctcacagcctctccccctcaggattctggggtaagaggaggcggggtgatgaggcttcctatcccttcggaggctggctttggggaaggtccagggctcatggggtgtgaccagcctgtgactctctcgtcccatcccctccacaggcatctcgtccccggtgaagaagacagagatggacaagtcaccattcaacagcccgtccccccaggactctccccgcctctccagcttcacccagcaccaccggcccgtcatcgccgtgcacagcggtaagcgccacgggcccctggcggggaggggcggcgggccctcctatcaggcctctcacagccggggaagtcccactggatgtctgaccatgagtcctattgctgtagccttctaggtgggcaaaaaaccatagaggtgccgtagtggagagcgcccagggccttgttccagcccggctgagaggttggactcagtccctttgggcctcagtttcccccctgtataacaaaaggctgcaacctaacttcacctcactcccctcacccccgtctcaatctaatccccccattccaaccccagacactgatggacaggcaggatcagaagctgccaatgaggccaggcacagtggctcacacctgtaatcccggcactttgggaggctgaggcgggtggatcatctgaggtcaggagtttgagaccagcctggccaacatggtgaaaccccatctctactaaaaatacaaaaattagccaggcgtggtggcacgcacctgtagtcccagctactggggaggctgaggcaggagaattgcttgaacccgggaggtagaagttgcagtgagcagagatcacaccactgcactccagcctgggcaacagagtaagattccatctcaaaaaaaaaaaaaaaagctaggcttggtggctcatgcctgtaattctagcactttgagaggccgaggcaggcagatcacaaggtcaggagttcaagaccagcctggccaacatggtgaaaccccttgtctactaaaaatacaaaaattagccgagtgtggtggtatgcgcctgtagtcccagctacttgggaggctgaggcaggagaatcgcttgaacccaggaggcagaggttgcggtgaggcgagttcacgccattgcactccaacctgggcgacagagcaagaccctgtctccaaaaaaaggctaagtgcaagtggctcacgcctgtaatcccagcactttgggatttcaaggcgggcggattacgaggtcaggagattgagaccatcctggctaacatggtgaaaccccgtctctactaaaaatacaaaaaattatccgggcgtggtggcaggcgcctgtagtcccagctacttgggaggctgaggcaggagaatggcgtgaacccgggaggcggagcttgcagtgagccaagatcgtgccagtgcactccagcctgggtgacagagcgagactccatctcaaaaaaaaaaaaagagacatctccatctcggccaggcacagtggttcacacctgtaatcccagcactttgggaggccgaggcaggcggatcacctgaggtcaggagttcaagaccagcctggacaacatggtgaaatctcgtttctactaaaatacaaaaattagctcggtgtggtgatgcatgcctgtgatcccagctactcaggaggctgaggcacaagaatttcttgaacccgggaggcggaggctgcagtgagccaagattgtgccattgcactccagcctgggcaacagagcaagactccatctcaaaaaaaaacaaaacagaacaaacaaaaaatcaccttccatggttgccattgggattaaggggggtgaattgtaggaagcctcaaatattgcttaccaccccatgttctagtgatcaactatttagttctttacacagtcatgcacacagagaggcagtcccaaatcaaagcagccatttgggccaggggtcagcaaacgctggccccctggttgcctgttcttacgaataaagttttattggcaaacagccacgaccacgtctttgtatatgtcctgtggcagctctcaccctgtcttggcagggctgagtaattacagcagagaccacgtggccaaaagccaaaaatatttactatctggccagaggctgtggagatgagggagtgactgctataaatagtgaaaatactaaaaatcactgaactgtttagaaagaggaaaaggcaggcaccacaatagaatatgactcagccatgaaaacgcacgaggctctgacgcaggccaccttgaggacgtcatgctcagtaagagaagccagacaaaaaggccacacagcatgtgatctcatttctatgaaatgtccaggacagggccagccacagaggcaggaaggggatgtatgggtgctggggctgggggaggaggtgaggagtgacggctgatggagacggaatttctttatgtgctggaattaggccgggcacagtggctcatgcctgcaatcccagcactttgggaggctgaggtgggtggattgcttgagtccaggagtttgagaccagcttgggcaacatgatgaaaccccatctctactaaaaatacaaaaaattaaccaggcgtggtggcacacgccggcagtccgtgctactcaggccgaggcaggaggatcacctgaggtcaggaggtcaaggctgtagtgagccatgatcatgcccctgcactccagcctgggtgacaaagcgagattctatctcttaaaaaaaaaaaaaaaagatcactattcagccatttgcagaaagagcttgccaaccctagatttatagtgtagactgtggggccagatgggctgggttcaaattcccggtctgccatctgatgccgtgtggccccaggcaggtgacacatcccctgaaggccaccctgtcatcctctgtttaaaaaaaaaaaaaaaaaagacggggccaggtgcagtggctcacgcctgcaatcccagctctttgggaggccaaagtgggcggatcacctgaggtcaggagttcaagaccagcctggccaacatggcgaaaccccatctctactaaaaatacaaaagttagccaggcatggcggcgtgcacttgtaatcccagctactcgggaggctgaggcagaattgcttgaacccaggaggtggaggttgcagtgagctgaggtcataccactgcactccagcctgggtgactgtctcaaaaaaaaaaaaaaaaaaaaaagaccaggctcagtgggttacacctgtaatccccgcactttgggaggcctaggagggaggatcgcttgagcccaggagttcgagacctgcctgggcaacatagcaagacccccacctctacaaaactaaaaaattaaattaaaacacaaggataatatcacagccccagtggggttgccgtgggagtcggggaatttgggtgtcaatgtggtcagtgctgctgggtttttttggtggttattgttactaaacgcactgagatgccggcaggaatgacacccacagacacacagtcacacggtcacagagcagaccggctggagcccccaagtaacccccgcttcccactgtctccgcagggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccggtgagttgggcggggcgcgttcgggcctctcctggcggctccaggtgacctcccgggggccacgtgctcacacgaaggcacaacctctgcttaaaagggtcttgaggacttggctctgaagtcccctcctctgtcgtgctgggaggcagctggattgggtcagaattgagatgctttcggatgtcagggtttcgggcgcatcatgtcgcaccctgtggggtctgggtagcacccgtaggtcccagcaactgcgtgagtcgtactcatgttaacacaaggcagggagggactgggcatagcggctcatgcctgtgatcccagcgctttcggaggccaaggcgggaggattgcataagcccagagttcaagaccaacctgggcagcatagcgtgacccagtttctacaaaaaaaatacttaaaaatgagccacgcatggtggcgggcgcctgtagtcccagctactcaggaggctgaggtgggaggatcgcttgaacctgggaggtcgaggctgctgtgagctgtgattgtgccactgcaccccagcctgggtgacagaacgagaccctgtctcaaaaagaaaaaaaaggttggggggcggggggcaggaagacattgattacaaaaaaaccaccaaactcagttcgagcaagacagcgtttgccagactccacaggaagctttggatgttcagagcttttcggactttggaaccacgggccaggccgtggatgatggtggatgatggcgtgctcgcagtgaattaggaaaaacgcggagaacctgctgttaggaggcggtggcactgtttggaaggaaatcagtcgagttggcgtgcagggggtttacagaggagatgcagtgagcgtggccccagtagtgccgggctttgagtgacaccagcaagcgggtgtccccaggcccctccacctccggccgtcctcagacccaccaaacccgccatggtcacacccgcgccctggccccccagcctgccaccccgtccgggccgtgcacagagccgggggcggccggcgccagcagcccgaggtagagggggagcccaccccttaaccacgtgtctctctgttcccccagttaaatggaagtggtcagctcaaaatgcccagccactgcctttctgctcagatgctggcacctccgcccccggggctgccacggctggcgctcccccctgccaccaaacccgccaccacctccgagggaggagccacgtcgccgacctcgccttgtaagcacgcgggaagcggtgccctggtggggcggatgtccgcaggggggcctgtcccctccccagccccactgccaggtcagaggtcaggcccgaccctgcagggcctggcgagtttggtgggtctccggaaaacagcccagtggccacgtggttgggcccatgtagggctgaggcagccttaggggctggccggaccaagcctcgggccagggtgagagtccagggtctgtccccttcgccgagtcacctgggggaccccggtgcccgccgtgggccgtcagaaaccctccctggtatgtcaggcagctgacagtggacacggatctcacagtggcggcccgagggccagactcgacccccagactggtcttttgtttgtggagaaagagaatcggttgttatcattttaaaatcaggacgttttacataaacatttccagagttctggcttcttggggagaaaggagctacaccaggcccagttcctttgggtgacctgggctggaccacacctttagatgggactctcttcgcctgtccacctgacctggaagcccctgggttggcggctgctgcaccttctagatttttctgctctctggatgtggttctgggtggctgctggatggcccctcggtcctggcatccctgtcctgaggtccaccccattcgtccgcagtggctctacccccagactctccccacgacccccatgcaggcttgggtgggtcacccaccctcacagggcgccagacatctctgaacccagagacctctccccatggactccatctgcccctcacccccctttttgagcatctctgtccctcactctccaaatgagaccccccaccccacccaagcagttggtggccacggttccttctaggtgccctcagctcctcttctccctgccccggcgttcctgtccccgtccccactgcgtgccagaacccaggctgcctgcccataaaaaccggcttctgatcactggctggaggagatcagccccaaatccaccctgggctggaatcccacctctgcagctctctcactgtgtgacctcaggcaggtgtcttcccctctctgagcctcagttttctcagctgcaaagtgggtttgccttggtgcccaattcacagggcagtgggggacaagccggtgacatgggtcagggaggcagagaggacattccatgtggcgcctgatgctgcgtggtgtcaggcagctgtggtcattcttgccggctgtccctgcctgctcatctgtgaaatgggagcgttgactgcataggatccagtcagggctcagtgggatcatgcccagagcctggtattcagtagacacttaataaatgcaggatactgcgtgggatccactcagggctcgatgggattatgcccagagcctggcatacagtagacacttaatagatgcaggatactgtgtaggatccactcagggctcggtgggattatgcccagtgcctggcatacagtagacacttaatagatgcaggatactgcgtaggatccactcagggctcggtgggattatgcccagagcctggcatacagtagacacttaataggtgcaggatactgtgtaggatccactcagggctcagtgggattatgcccagagcctggtatacaatagacacttaatagatgcaggatactgcttaggatccactcagggctcgatgagattatgcccagagcctggtttacagtagacacttaatagatgcaggatgctgcttaggatccactcagggctcggtgggattatgcccagagcctggtatacagtagacacttaatagatgcaggatgctgcttagtatccactcagggctcaacgggattatgcccagtgcctggcatacagtacacacttaataaatgcaggataggcatggattccacccccctttccctgcaccggggctcttaactgcaaatctactcctacttctccccataagcctcgctgcctccagctccccccaaccccagccaggacaacttggggaccctgcctgttgcagcttcttctccccctacctgggtcccggcctgtctgaggcccccatccctgctgtagccccaggccgtgagttactcacacgccgacaaaatataatcgctgaggctgaaatataaatacgcacatctgtatgtatgcacacacccagccctccctctgccctctccgggaggaagattaataaataaaacgccctcaataattcatgcaccccgcgcggaggcagccctcagtggcaggaccgggcgggcgctgcccaccctgaataattcacgggcggttttgtgaattacagagccatcctgccttccctctcagcagacaccccgcccacctgggcgatctcagccgtgacccccgggcccctcgagtcaggatccccgcctcccaaggaccttgggcctttcaggggggcccggttcaactgggggtagggcggcaggctcggaggccccaggcactgggtgcagaggcccggctgtgtgacgcctggcggtggccaccctctctggggccagggccgccccggctcccacaacccctcgctaacgggctctcggtctctctcctccctgcagcctactctccgcccgacacgtcccctgcaaaccgttcctttgtgggattaggaccaagggatcctgcgggcatttatcaggcacaggtaggggccgagaggccggctggtggggtgggaggggcagggcagaggggccggcccggggggctcagggcgaagagggcctgctgggtcccacgccacacccccggcacaggggcgccagcctcccacaccccacctgggcctcgagcccccacctggcctctccctgaggccaaatttccctccaccttggtcctggggggatggggtgtggccccagactcagcctgtggggtccccaggagcgtctctggagaccatcgtggtacagctatgggaccagtgtcattaccacctgcttcccatggtatagatgggaaaactgaggcccagagagacaagggggtctgcccagggtcacacagtgcatcaccctccctcctccagcctccatcccccatccacgccgaggcctagagggaccgcggggtggccgggggaaactgaggcagcccatggcggggcgtggggcctcccaggacagcatccaagcccccaccccaggcttcagcccacatctaagccagtgtgaggagtcagggcggagaggcttcgtcagcaggacagacaggatggggcaggggccagcgttcatgttcacgttgatgttcatagtcacgtacatgttcagacggctgcagctgagtgagcatggccggggtcccaccacccctagaaggcaggcaggcaggcaggaggttgacagaggaggctcagagaggggaagtcaattgcctgaggctgcacagtagtctagggagtgggggcgtgggagggcagccttagccccaggcccaggtgtccctcaccccccacccccataaggggctctgtgtaggccaggagtgtgtgagcgcgtcttcgggttatgggtaagcagctggacctttgagcctctgctctctccccggtttgtgttggggagagggttggaggatgtaggagtggctgccacaggcccgggaggtccagactcagagagaaacgagctctgggctacccagcggccacggaactgcagagcgtggagatgtatggggtccccaggggccgtgttcaaatcttccagccactgagggaggtttcctgctgcagagcccacgggcaagggtcacggggcctccccgggaccctgcggggctgtcctggctgagcggatgggggcggggaagggacatggcattccccctccctccctgtgctgggtgcccaggatgcctgtaagcggcccctccctctcttcccaggctccgcaaaaccagccggaggaggaagcagggatggaggctgcttctcctgagttcagaggagatccatgtgctatgggtggagggaatcctgggtcaggggccagggctccagcccagtgctggctcacccactctgaacctctgtctcttcctctggccttgggcacccgcaccaagagcctttgaagggcactgggggacagaaagggcactgaaaggttcaggcttccccacaccccgtaaatattaagtaccctgccttgcacccatagagccccggagagggagtaacttggtcagggtcccccagcgagcagacgtccaggactcctcgctttgggatttgggccccctatggccaacctctcccccgcctggtgctgatggagcccggcattacctctgccacccccaccccacatcgctccctgcccctgcgggaggctgggaacgtcttaagtggttcagaaaccaaagctaataaaagctgcggtgggaggaggcccagcccgcttaacccttccccagcctctgccttggaccaaactctctgaccaggccctcccgccagggcccgggacccttctctcagactgtgctggctccagccccaccccacccaagcctgggagggaagggaaactgaggcaggcaagggtggcacctttctcagcatccctatcttgactggctggactcctctggggacccagaaagggtgggaccagggctggcagaatggggtgtgggggggcactggcaaggggctcagcataggcaatggtgtgggtcgggggagggggagctggctggaatgtgagagatctccggtggcaggggccagacagatgatgcgggctttgctctggggtagtggggagccatagaagggtttagagggagggagtggacacccaccaggcctgggagtcagaactttctggagcacagaaaggaggtgacacattgtcaagaggctctcaggggagcatgggttagggggaaggcgaggtccccaaactgggcatccagggagcacaggtctggggaggaccccattgctgctgccctgactggactaagagcacctgggttgaggccgggcgccgccacctccctgcagaccccggagagagggagggaagaagcagtgagatcccgctctcccctctcccagctcccgctcaaagggccctgagcttggaggcctctcatttccgattctggccagtcagcacttctgcctccgcctcctctattcctggcggattcgcttccctctgccccctcctcccccaaagcctgggtgggcgcgcctttccctctgcctctccggctcccgacaccccccagtccatggactctccccccatcaatatccctccccgtgatctatgctaattgatctcgccctggtcagttacccacccatcgccccatgtccgtccctatcaatccccccactgtgaggctgggtggctctgacgccctggcccctcccctctgtgatgtccttcacgcccctacatttctcctgcacgggaacccacgtaagcagctgggtaaaccgagggtggggggcaaggcgggcattgagccacatgccgggagccacacaggcggctgcagccaggccagcaggataccagagcccaaacctcccccttcacacctactgcctcagtctcccctcagctgagtgggaggatgtggagttgagggtgcccccaccccacccccgccccattgctggggccacagccaggcaggaaggggaggggagggaagggaggagggaggaagggctgaggggaggctggtccaccacggggagggtcacgcccagagtctgtcggttgccaacagaaaccagacatgaggtaatggccaagatgaacttgaacttggctggaggtggggcgctgggaaccactgtggcgccagttccatgggctggcccagtggctgcctggttggaggggctctgttgaatgatttgctgcagcggtggggggcggccccacctctaacctcagttggggagtggaggggtctccccagttccagaggcacagccctcccctcacagtccaccctggatgctccatctggggttggagtttgcgtttccagggcaggggtctggacagcagcttctctgcagagactgaggccggagctgtccccaaatgacgtgaccttgggtacagccccatgcagaactcccctcccttagcctcggtctcccgcctctgggaggttgagagtcatcctcagcccccctgtgcttagtgagcttctgtggagcaagagggggccatccgggggacctgtgacaggatgggccctggacgcccaggacagtgctcagaagatgccaaggggattcctgagaggcaggcgagggggttggccctgggcaggagcagaaatgagagccagagccagacaggcctgagttcaagttccacctctgccgcttccatgctggtgacctcgggcaagttccttgacttctctgggcctcactttcttcacacaaaacagcggtggagggagacctaccccctccttcacggggataccggggacatcattaaagaggagaatttttttttgtttttttttggtttttttggtttttgttttgagacggagtcttatgctgcccaggctggagtgcaatggcacgatcttggctgactacaacctccgccccctggattcagacgattctgctgcctcagcctcccgagtagctgggattacaggcacgtgccaccacgcctggctaatttttgtatttttagtagagacagggtttcaccatgttggccaggctggtctcgaacccctgacctcaggtgatccacccaccttggtctcccaaagtactgggattacaggcatgagccaccgagcccagcctcttgtttactttttaaaaacattctcaaggccatgtgcagtggctcatgcctataatcccagcactttgggaggccaaagcaaacgaataagctgaggtcaggagtttgagaccagcctggccaacatggagaaaccccgtttctaccaaaaatacaaaaattagctgggtgtgatggcgcatgcgtgtaatcctagctactcgggaggctgaggcaagaaaatcacttgaacccgggaggcagaggttgcagtgagccaagatcgtgccactgcactccagcctggtgacaagagcgtgacgctgtctcaaaaaatcaacaaaaaacctctttataaagtgaacaaggcagctgatgtggtggctcatgtctgtaatcctagcactttgggaggaaggagttcaaggccagcctggtctacatggcgaaaccccacctctacaaaaaaaaaaaaaaaactagtcagatgtggtggaacatacctgtggtcccagctactcgggaggctgaggtgggaggatcacttgagcccaggagatggaggctgcagtgagctatgatggcaccactgcactccagcctgggcaacggagcaagaccctgtctcaaaataaaataataaattggctggccacagtggctcacgcctgtaatcccagcactttgggaggccaaggtgggcggatcacttgaggccaggaattcaagaccagcccggccaacatggcgaaacccggtctctactaagaatacaaaaattagctgggtgtggtggggcgggcctgtaatcccagctacttgggaggctaaggcacaaggatcacttgaacccaggaagcggaggttgtagagagccaagatcacaccactgcattccagcctgggcaacagagcaagactctgtctcataaataaataataaatagagaagaaaataatttttaaaatataaaataaaggccaggcagagtggctcacgcctgtaatcccagcactttgggaggccgaggcgggcggatcacgaggtcaagagagtgagaccatcctggccaacatggtgaaaccctgtctctactaaaaatataaaaattagctgagtgtggtggcatgcgcctgtaatcccagctactcgggaggctgaggcaggagaatcacttgaacctgggaggcagaggttgcaatgagccgagatcatgccactgcactccagcctggcaacagagcgagactctgtctcaataaataaataaataatataatataataaagtaagattgagttccagactgggagtgctggctcacacctgtaattccagcactttgggaggccgaggaaggtggatcacttgaggtcaggcgtttgagaccagcctggccaacatggtgaaaccccatctctactaaaaatacaaaaattatccaggtgtggcggtggacgcctgtaatcccagctactcgggaggctgaggtaggagaattgcttgaacccaggaggcagaggttgtagtgagccaatatcacgccattgcactccagcctgggcaacaagagcgaaactccatctcaaaaaataaaataataaataaaatataaaatacagttccagataaatggatcttttgtgtgtggtgtgtaagtatatccccaatgttgcgtgggctagacttatactaaaagaattctgtgttaaccagaactccagtttcactgggcatcctgtactgtgtctggaagcctccctcagagacaaagtcacttgccatgggtcacccagcaggttgttagagcctgggatggggaaactgaggtcacagggttgcaggaggtggggggtgagcgtgggaagaggtaaaccatgtctgcagcagagtctgacccctcgacttctctccctttttctctctccctctttctgtcgccactgggccactcagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggcccctccaccccccacccccggcataggaggcccccccacctcgcccggctcacacccccaaagggagggacccacattgcacacactgtaagaaatgcactttccgaggaaggggatgggggagcccggacacccagagctccccgagttgggggtgcccgtctggagcgcccccgtcagcccctggcggtgggaggtgagagcgagtggtttaagtgcctgattaccaccacccgcccccccctttgtccagctgggacacggaatggccgcgggcctcctccccctcccctccagcctctccaccagcccctccagtcaaccctcatcgccgtgcccccccagagctagagagatggggcccctgcgtggcccgaggggcagagctgggcgtcacttcgcaagcgtcctgccctgccggggcgcgggggtgggctctggggaagccggtgcgccccccacgcctccgctgccagtgccttacattctggagcgacccccctccctggtgcctcccagcgaagggggaccgccgtttgcactttcatcgcctaccccgacgcggggcccagctgcgggacgtgcatcacggctgggcccccagaggagagaggaggccgacgccagcggtccccgctcggaacggggagggttttcggggggttcggcgtcgcaccttggggccccccgcagccgtgtagggggcctcccatctgctaagcgtttttccgttgagccgctccaaaaacactaagctggggacgccaggtgcccccccaccccggctccctggccctatccacacctccacccccaccccaggatcgccatctttaggggaggcctgggagggggtgttaggtgttttagggccaccgagctcaaacacaaggacccctccccggcccacccagcccagccccaactgacctccatgcctagggaaaaactccccccaccactgccccctcccccgacccaggccaaagccagggcaggtctccgggtctcacctgctcctagcctcacccccctgcccccgaaaaccagactctcctcccaaactagcctcaggagcttggcgaacccgctcgctcctaaagagaaagacccaggaccctcccccatcacccccaagagaggttcgccatcctctggcctcgagcccttggtccctccgtccgtctgtcctcggggcccgctcccccggtggcccttggggatcaaagcgtgggccgctctccgggagggcgggcgggggagggggtggtcgggttgtgccattggggtgtccggaagcttctcagccagggtgggggtcgtggagtgggggagggaggc

SEQ ID NO: 12512 - DNA, 5941 bp, Human
cgcgtggtgggggtgcaggtccgtcctgctggcggcctgtgggctcgcccctcccctatccatttctctcccccacacacgctcataaacacaggacacgtggaaattctcagccaaagcgtcttgcccgggcgggtgctcaacgtggtgatttataaacagctcagccactctccaaagagcatgactccttgttagtcatgatgaattttctggcccgctccagtctgctgtctggattcagatgctcagaggccccaaaatgctccctctgagcgttgatttggctgccctctcaagcctacgaccgccggcaaaaccagcgatagagcgaggggtgagaggtggggacgcgatccaggttccctggggtctgtcattcccttcccggcagtaactgttgattcgctttacagcgcccatgtacacacccggccctgcgtggcggtcacgccgctccagcctgggtccgcgcccaagttctagctaccgggcttgcaggctcggaaactcgcaggcggcacctgctctgggcggctaaagaactgatggcgcgacgcgcccgcgctccgtagagcggcgctgcgggtgcatggtcccatagtcttgctctggagttcactgctgaaagctgagctgggagcttggccagggagcgccaaagacatagactaaccccacccgctagcgcccaccgaagttactgattaggaaggttcccctggcatcagcccatttgcttcacacactcttcctccttcccaaggggctaacggaaaagttgcacctaccagcggtaggagcacggggaatcgcgcacgcaggccctccgcgcggcttcccggagcggcctttggcgactgcgccgcccctacaaggccgcacacccctcgccagcactccggcagcctcgcacaagacggagcccacgcaggcttctagttttctaaaccaaaaactgcacgcgccggcgtgtgaatctgacggagagacttttagagttttgtttggttttcagttcagaccgctacgctgtcagagcaagcaactccgagccttgatgggaatgacttacaagccgcggtgcgggctgagcctgcctctctcggggttctttccccaagggagtgggagacaattgggcctggaacctaaaaggaagagagcctgtgctagccgcggggtagaggggaaggagaagagctttgggcagaagtgtccgcacaccctggagcaagagacacttgtgcactgaaattctaaccgtgggatgcaaggagagttgaacaggggaacaggtctggctcttggctctaggtttaagagatacacactgtgtgtgtgtccctaggtgaataaaaatccgactcccgctggctcggtgcgacccagcttttcccttaccccctccgtttccccatcttaaagccctattgggaaacgaaagtggacaccactgcctcccgccccccaccccaatccaagtcttccaagtgtctgtggccgataagagcaccgggaccgcccccctgccggtcttctctgcctgggagacagatggggggcggggcccatccgagagagggcggaggaggccccgggtgaggaagaagcgggggggtgagaactgagagaatctgaatcgggaggcgaaggggacggggaggagggctaggaggactccgagcccgggggagggggagggagtagctctgcgccaatcagtggcgccggcctgggaggttgctagcggtatccacgtaaatcaaagggcgcggagccaatgggagggggcggagggggcggggcccaggcgcgtgccgctgcgagccggcgctgccaagagagcgggagagagctggagagagcagggagaggggggagcgccgagctagtcagagagtgagcgagagcgagaaggagggagaggaggagaaagagagcgagggcgggcgggaggcggcggcggcggcagcagcagcagtaatagcaggagcagcaacagaaggcgtcggagcgggcgtcggagctgcccgctgtgggagagagaggagacagaaagagcgagcgaggagagggagcccgaggcgaaaaagtaactgtcaaatgcgcggctcctttaaccggagcgctcagtccggctccgagagtcatggcgaccgcagcgtctaaccactacagcctgctcacctccagcgcctccatcgtgcacgccgagccgcccggcggcatgcagcagggcgcggggggctaccgcgaagcgcagagcctggtgcagggcgactacggcgctctgcagagcaacggacacccgctcagccacgctcaccagtggatcaccgcgctgtcccacggcggcggcggcgggggcggtggcggcggcggggggggcgggggcggcggcgggggcggcggcgacggctccccgtggtccaccagccccctgggccagccggacatcaagccctcggtggtggtgcagcagggcggccgcggagacgagctgcacgggccaggcgccctgcagcagcagcatcagcagcagcaacagcaacagcagcagcaacagcagcaacagcagcagcagcagcagcaacagcggccgccgcatctggtgcaccacgccgctaaccaccacccgggacccggggcatggcggagcgcggcggctgcagcgcacctcccaccctccatgggagcgtccaacggcggcttgctctactcgcagcccagcttcacggtgaacggcatgctgggcgccggcgggcagccggccggtctgcaccaccacggcctgcgggacgcgcacgacgagccacaccatgccgaccaccacccgcacccgcactcgcacccacaccagcagccgccgcccccgccgcccccgcagggtccgcctggccacccaggcgcgcaccacgacccgcactcggacgaggacacgccgacctcggacgacctggagcagttcgccaagcagttcaagcagcggcggatcaaactgggatttacccaagcggacgtggggctggctctgggcaccctgtatggcaacgtgttctcgcagaccaccatctgcaggtttgaggccctgcagctgagcttcaagaacatgtgcaagctgaagcctttgttgaacaagtggttggaggaggcggactcgtcctcgggcagccccacgagcatagacaagatcgcagcgcaagggcgcaagcggaaaaagcggacctccatcgaggtgagcgtcaagggggctctggagagccatttcctcaaatgccccaagccctcggcccaggagatcacctccctcgcggacagcttacagctggagaaggaggtggtgagagtttggttttgtaacaggagacagaaagagaaaaggatgacccctcccggagggactctgccgggcgccgaggatgtgtacggggggagtagggacactccaccacaccacggggtgcagacgcccgtccagtgaactcgagctgggggaggggcagagcgcggggctccccctccccttcggtccttggccctttcccggccctcttgttccctctctaacttctgattgttcttttatttttaattattatttccccgtcccttaaaaagacaaaaaaaataaggcaaaaggaaagcaactaagacactggactatcctttaaaggtagcaggtgtaatgatgtgttttgacctttgcaggcgagtaaccaggcaatggagtggagtgtctcctggagagagtgaggagagtgtgtgatagctagaaagagagagagacagagagatggcaagcactgagataaatacctggcaaaactaaataaattaccaaaaaggaaaaaaaatccaccaaaccatgataaacacaaaatgcagcttcctgatgcttagagttggcacatgctgctgtgtttatttattgtggattcccatcaggaaagaggaaaaaatacacatgttctttcatataggcaaaatttaaccacataaatttgcactgcaagaaaattgaagtttacgtgaacaaattcatgagcatattttctctttctccccaccgttaatttgggagttgccgttttgggggattttgttttgctttgctttattcatcggagagagttgaagccagctcttggccactctccatttctaatgttcttgtgttgccccttcttcgtactgtttgtgaactttggttaccttcacattccccttacgagggtgtaacatctatttgttcctcttaccaaagcaaaaggattggcttcatacaaaatagacaattctctgatttcaggaaatgtgcatggtctacccgctttatcgaaggcaagaatccggtttggaatataaaaataagcattggttgttcttaccagccacaaagtaaacttcattttcaggcagtgtttctgggggaggttatggagggaagaaaaaagaaaaatcgatagtgagtgactgattgcttcattttatcaggcgggcccattgtgaaagagctcaggggaaatgtggaggttaaatatatttccagagttgtccagcagaaagaaagtggcactttgaagagaactagggaagtacatatcttcagatatccctatatagttctctaccttcagttttagtaacaattatgaagaattatttgtgctgacagcagcagttaaactttgtttctctaatagctttttttttacataaaaaaagacccaggaacttaatagtgtatgcataagactgtgttttttagcacacagatacccacagcatacactgacgatctccacgcagtagacaggttttgtcttcactagctcatttgtttatcaagtcatatttagggtcccacaccctcttttcctgtaatttattgcagaatacaccactttgacttggacagctttctgccccctctttcactaaggaaggcaaatgaagtgaaaaaaaaaatgccattttcaatccttcctttctcccctttgttaatagttttaagtgaatttttgaccttatcttaatggaaaacggttaactccaaacacaaaagactctactggaaagtgtaggtgaaaaaacttgtaactgtattgaaaataaataccattaaactgtgatcagttaaaatttaaaagaaaaatcagcacaaaagggcgctaaaagggaaaacactttttattaatcttaaaagtttgggggtttttttccagttaggtattagataaatttttattttaaaaaatgaaagtctcactaccataaaattatggttcagcatcagattagcattgcactcagtagtctttaaggttttaggaaatatgctttatattgtcttttcaaacacctgtgattgtttcattttccatgtttttgcaagataaatggtgacttataatgggcatatttatttgcctgtatttcatttcccccaatgaatgtcacaaggagatgggcacggagctgcttcgggtgcatcacgctgctcgttcctgaggtatgggaactggcctttagtgaagctatccagagcagggcaaatagccactggtaaagggaggaaatgaatttccagatacttattaccaagtaggtaaggtcagaagctggagttcagagaatgtgtctacagcttctctgactcttataggtttactaagatgaaagttaccactgaaccttaccactatgtatatatgtttaatatctgtcttttgaaatgcagaaatagtttaaatgtttctttgtctatttttctttttttttaatgctacccagggaaatattttcatatcatttttaagtggcctgcctcaatgtatatttatttcttttgaaacaaaaaggttctggaaactgtttttctgtagctttaaatgaataggtgagcaaaatctatatgggatgtaatttttttgttcag

SEQ ID NO: 12513 - DNA, 103987 bp, Human
tgagccaccttgcccggcccgcaatgttttttctttctttccttctttctttctttattttattttttttttgagacggagtctcgctctattgcccaggctggagtggtgcagtggcgcgatctcggctcactgcaagctccgcctcccgggttcacgccattctcctgccttagtcttccaagtagctaggactacaggcgcctgccaccacgcccggctaattttttgtatttttagtagagacggggttgcaccgtgttagccaggatggcctcgatctcctgacctcgtgatccacccacctcggcctcccaaagtgctgggattacaggcgtgagccaccccacccggtctttttttttttcttttttgccggcccgcaatgttttcttaaactttttatttttagctatcctgttgaggttcttccagatgaattttagcctctgacccaggggtatgatttgataggcgtggagttctggttacttcttaaatgaagagtttccccaggatatctgaacaattctcttgggtggaagactcaaggatcatgaaaacgaaaaccaaattctagtcggctcctaaagtccttttgcctcctgcggttaccatcaaagagctatggtcaaaattccaagggataattcagggtctgattccactatatatccccagaccgcctatacataaatccatattattggagatttacgcttaatcctataatcttttacctaacagctgtccagtagaattttctggatgtccaataaggtagccgcgtgtagctcttgaacacttgaaatgtggctagtcccctagaggaacgggattaatttaaatttacatagctacaactacttatcggtcactgcggtaattgttaagactggttttgcctgtaacttgcatatgttttattggacatcagtttcaatatttcatttgcattgctaaaagtcaaaatccttttgactttgccagttactcagtgagaggacagttggagccagtttctgttctaggcttacagttttaaggacagataaaggttagtttttaacctcgagatgaacagactgttaagtttctacggacttgcccatggggttccacagtgagcctgggccggggaggcaggtactgtgtcagggggaagaaaaaaggggcttctagctgggcaggtgacacacagggcataggaagaggtcagttcttgtggccgaggaggtccggcccgggggtcccaggagcagagatctcccttctcttcgatgtggaaagtgaggagggagcagagccttgctcagaaacggagctcccccaatcccccaccgccctagctactggactggaactaggatggacacgaatgtccttctcattgtactaactgcactcaacaagcgggaaagatgaagcgagggggtttaaatgtgtgcgtttgttgaatgacccacaaaaactgaaggagcgcggccggactgatcacactccttgagacaaagcgggtgggagacccagaggtgaggagggtggtcgcctgtgggcgaggactgggaggccaggggttctcggcgaggcggtcccaggaggcggcgcggagccgctgcgaggccgcagggccgggtcgcaagatggccgggccggcctcccgcgcgggtcgcgcgggccacgcgggcgggtttcagatgttccgggcccgggtaggggctggcaggagagaaggggccggctgcggggagggctggctgagaagaagcgaaaatgggcggttagcagcagggacccggagccggaggagccgagagcagcgcgtgcgccgagctctactgcctcgcgggaaggcggaagggtggggagggcggcgctcggggcgggaggcccggccgggtccgctaggacagcggggccgctgggaagttgtgagagcggcgctcgggggcgcgcttgcgtgcacgagggcccgggccgcgagcagccgcggccgtcccggtcgccacccttagcagcggtcgcggtcggtgccgaagcggtgttccccgccttagccgctggcgcctcccaagagagcggccggtgggccctcgtcctgtcagtggcgtcggaggccggcgctgcggtggccgcgcccttctggtgctcggacaccgctgaggagccggggccgggcacggctggctgacggctccgggcagctaaggctgcccgaggagaaggcggcggccgcggcgtaggcgcacgtccggcgggctcctggagcctggaggaggccgaggggaccatgtccgggaggcgcttccacctctccaccaccgaccgcgtcatcaaaggtgcctggcgggccgggccttcctctgggacccgcgggaaacggccttcggctgggcggcggctcggggcggagggaggctggggccgggctgcgcccaccctaggagggctcggaggggtgtagacagagccgggcggcagcctccgagagcagccacccggacccggcgttttctgctgcacctggtcaggtgcctggccgtcagtgccaagttccctcccgaagggttcagggtgcagtggggacttcttctcccaccgccccgaagggcccggatccctgtctttttttctctttaagaaacgactcgggggaagccatcgggggtggtgtgagcagggagtcgactcttccaagtaagatatttaagattagatctttcttgacgtccgccccccacccttttttaggacgtataccatgtgccttttgacccgctttctctagatcattgcaagtcactgctattactggaataaacttagtatgaacaagtcagataaatccattatatgatgtttaaaataagtttacggagctcttgacagggtaatggtattttattttccctttggttataaagacttggagaatgacgttttctgattcatatgtgtacctgcgttagatttctgttgttgttataagaacaaaatgtaaagggctctttgctctctaaatcttgtagagttttaggttatagttgtttctccctttaaactaagaagatggattacacataaccactaatttatgtgctgcttttattcagccgtaagtcttaggcacaacccttctctctgagattaacaatcggtttgaaagcgctattttgtaagaagggaatagacttagaccagctgtgttagtggcctctggatgcaggggttagcgtgacagtggggaaaattattaagatacttttcttctttttcattttggtattagaaggagaaaggcaactaatactagtgacgggaatacatttttaaaaggtgaaacgccttattgcatgttcagggagggggaagaattttagtgtataacttaggtttcccccctctctccccaaatcagcctcataaatgttaattatctgtactacataattataatgggatttttgagatttatctgcttagcatttgtatgctatcgttagaggtttaactgaattgttcatctaactgacattatcccctgaacagctaaattattgtgaccatttaaatgtgtcttcatattattagtgtatagcctataagaagtatatagccctctcttaagattcagagtgtacttaacataaccttttttgaggaatcaaggtcattatgtacattaatttctgtactgtgctgttaatatggccggtgcgttctgctgtataaagttgttagcagtttcgtcctgtactaaaatgacttcgcaatgctataccagttcagtgttttgtttgcttttagtttctctctccagtactgttttctgtcaaaatatgcccttaactgctttctaatctgctacgtcttagctgaagtaggcagggaaaccagataagccagaactgtgggtcaagtcagaataaataggatcttagtgaagcttagtgcagccctcaggaatctcacaatcaaatcaccattgtgccatgtaatttccaccataacatgccataagatcaaaagaagattaaaaatcttaaatgacccttaaatatagtaataaatattgtaaaataaaatgtaataaaataaaaaagttaaaatgcaggggctaggggcaggcatggtggctcacgcctgtaaccccagcactttggaaggcccatataggcagatcactgaggtcaggagttcgaaaccagcctggccaacatggcgaaactccatctctactaaacatacaaaaattagctgggcatggtggcgggcactgtaatcccagctacttgggagtctgaggcacgagaattgcttgaacccgggaggcggaggttgcagtgagccaaaatggtgccactgcattccagtctgggcaacagagtgaaactctctctaaaaaaaaaaaaaaaaaaaagcaggggctggtttattgctacgcatgcttattattaaataaacactgtcatcatatcctgcaggatgcaaatttgttctttaccaaaattaattaccgaatattgtgtacttttaagactgctcttaaataaatgaaatagaaataatttcaggtccttagaatgtatggatttctctcctatataaaaacttcggcataagagcttgaccacagcatttgtggcttcatgatgacttatggtgcttttttcagggttttccagagtttgaaatagttgaagaaaatgaggtgtcacgtgtgcatagctaaggtccattgtaacgggtactaaaccctggtctgatgctatcttgtttagtcacagctgtctgcatttattcacagcttgaaagctttttcagaggtgataccacaccccagctatttttgtttctgtcatttcctgttaactttaaagtgtacctaattgttctatttgagcaaattttggagaagagtgggtatgtgggagaggtttgtattttaggtgtcctttaaatagcagctttcttaaattgaaggatgtggctgggcgtggtggctcacacctgtaatgccagctacttgggaggctgaggcaggagaatcgcttgaacccaggaggcagaggctatagtgagccaagattgtgccactgtactgtagcctgggcgacaagagtgaaactcagtctcaagccaaaaaaaaaaaaaaaactcatctgtaaaatagggttaataataccttccctgtcaagcctgggtcatgcaagtgacataaagcatgtgaaaaggtcaagttaaggtagtactttgagacatgataataggttggtaatagatcgcttactacagaagtagttagtagagatatcattaacatttgaaaatatcagaaagtatgtgaaattataagctacaaaactgttcctagtcaggtgaatacctattctacagcataatggatatgtgggtgaaatctcgtcggtaacaatgtgaagagatcagcacagttctgtctggtactccctaggcagcagatttcttctctatctgttgaaggtgtttattttatgtttaaaccttcttatgattttactcattcattaaatgtttattgagtgccatctgcaatgtaccctagtaggttgctcattcatttcttctttgctttaaaagtagcatttctgtgagcctttagagcagtttatatgcactggggcaccataactggtatctaagccagagaactaggcacccaaatgattaaattgtgatattctgtctgctttatttttttttctagtttccacgttccttttcctgtttaaggacatgttttttctttgacagtgatttttataaaagcagtttatttccctggaatgaatcttttcagaagcaacaaggaaatttcagtaggaattacatgacaaatatagagaatccattgtcttattttgttactttatggccagatggggtttaacagaaaagtcagatttctttttagtaaggtgctgatacatttctccctttctcttagaattcaaatatattgtgtattcacagagtactgtaccatttttaccacacatggcaggctactgtttctttaatatcgtggcactgggaatattgtgcttatggctttcttaaaatattttaatattagtgtggacaaaaattgctatttctacaaatataccctaaacccgatttcaatctctggtacctatacttcatttctttccacaactctcccccgactctcccttttttatatccataatggatttaccgagggtttaaaattttttctcttaaatataagcttaatcctgctacttatacaatttgaaaatcagaaagggaagaaaagaaagacttcatattccttcccagcagaaataactgcttttaatacctttgtgtgtttccatctgcaggtatattttgaattcaaaggaaaatggatcacacatattaaagcttttgttatgcaaatatttcatattattttaacataaatattgtaattttacctaaatatttccataatggtttcaatcagcatggaaatggttttagagtgcttatattaatattttggttctttatattttcagtggggacacattagtcacttgatacaataccaacccagaagaaacattttcaagtataaattttcaatgtgaatacgttttaaagttgatatctcctggatttgtcaacagtatttgtttaatttatgcttcatttaccattgtgattaacaagctgccaaacttttgaaacattcaaaatcagtgctaatcgagattcatacatctgagtagaaatctggaacctctgaaagggcatcttaatttaaacacttaatttttttctttttgagcaaggataaagtattctttcttacctatacgttattggttgtgatcaaagctttatttatggtctgacatttgataattaagctttctctcttttattgcattttaaaataggattaaaaattttttttgccttacgtaatttttagtgtaccataacttttactggagtgtatatgggaaaatgtacaaattataaatgtacagcttagtgagtttttacaaatttagcacccacatacccatgtaaccactcaaccaaaataaatagattaccagaatcccagaaacaagcatgagttcacgttcagtccactggtttccatccctaaatgggcaacagtggggaaaatatgacacttgtaaccattattctggcgtctaacgtcatatttgtaaagtaacatactaatcacatcttactgtaaagtgaaaaaaacaagggactctgagagaaaaatgctaaggactcattacttaaagtgaaataattaattaaagaccttttcctaagcagtatttgatactaggaattgaatgtctttctattaaggtaacatttttggaaaaagctaatttttaggccaggcgtggtggctcacgcctataatcccagtactttgggaagccgaggtgggtggatcacctgaggtccggccaacgtggcgaaacccagtccctattaaaaatacaaaaattaactaggcatggtggtgcacacctgtagtcccagctacttaggaggctgaggtaggagaatcgtttgaatctgggaggcagaagttgcagtgaactgagattgcgccactgcactctagtctgggtgacagagcaagactctgtctcaaaaaaaaaaaaaaaaaaaaaaaaaaagctgatttttagacatgtctctattagagacaaaattattcatttaattccgggatttgtagtcattttggaactttgctgctacttaattgctaaatgactaatgggaataaagggatgtcttagaatcattaccatcctttggtgcaatcattactagactataatgcccgtttatagttttttttggtgggggacagggtctcgctctgttgcccaggctggagtacagtggcgcgatcatggctcgctgcagcttcagcttcctgggctcaggtgatccacctcagcctcccgagtagttggaaccacaggcatagcatacgccaccgtgtccaactaattttttttttttttttttttttgtgacagagtctcgctctgtcgtccaggctggagtgcagtggcgcaatctcggctcactgcaagctctgcctcccgggttcatgccattctcctgcctcagcctcctgagtagctgggactacaggcacctgccaccatgcccggctaatttttttttgtatttttagtagagacggggtttcactgtgttagccaggatggtctcggtctcctgacctcgtgatccgcccgtctcggcctcccaaagtgctgggattacaggcgtgagccaccgagcctggcctaattttggtattttttatagaggtggagtttcgccctgttgttgaggctggtcttgaactcctgggctcaagcgatcctcttgcctttgtctcccaaagtgctgggattacggtgtgagccactgcgccctgccttttatagtcttaatgttaaaatttagcagcattttacatttcaaaactgaggcctaaaactttcaacctaacctaagtggtatctttcttagttacccttatattctatctggttatccagatgaatgtagagagaacttttagttccccatattcaattttgttttgttggcactttagattatcctgaagtcttttagtttcttgagtcttcgtttgttgtttgaagagggtttaacttggtaaccaggatctttaaattgggcacagaaagatatactggatggctggacaagataatgtatttctttgatgatcattactagatttactaattgctaacagttcatgaaggtttttttgcagtgtctagacaatgtcagcccaagagactgaaattctaaatgaacaaacactgagaaatatttgaagaattcattcagtaattacctatgtaacattcttgctaaaggtgtttaatttaagctgagcttagttatagtagacaatcagacaaatccagtttgtgggactttctacaagacagttggcctgaactctaaaaatttcaaagtggtgaaaacgaaacgaaacaaaaagggcaggaagactgttctagatgaaagaagttgaaagagaaatgacagtcaagtacagtgtcaagcctggattaagaaaacaaaaaaccatagaggacattttggggataactgggaaaatttgaatatggtgtatatattagacggtattataccttttttttgtttttttttttttttgagatggagtttcgctcttgttgcccaggctggaatgcaatagcgtgatctcggctcaccgcaacctctgcctgccgggttcaagcgattctcctgcctcagcctcccgagtagctgggattacaggcatgcaccaccgcactgggctaattttatatttttagtagagacgaggtttctccgtattggtcaggctggtctcgagctcccgacctcaggtgatctgcccacctcggcctcccaaagtgctgggattacaggtgtgagccaccgtgcctggcctatatcattgttaaatgtcttgaatgtgactatatggtattatggttatataggaaaatgatcttatttttaggcaatacctgatgaagtattagtatgttgaaatgtcgtgatttttgcaatttgcttttaaattgttcaaaaaaaaatcatttgtagagaaaaaagcgaaagtggcaaaacatttactatggtgaatctaggtaagagcatatgggtgttcattttatgattctttcactttttaaatagatttcagtttttcaaaatgtaaagttggggacagccaggcatggtggctctcgcctatagtcccagctgcttgggaggctgaagcgggaggattgcttgaggccaggagttccaaggcttcagtgaactatgattgcactactgtgttccagcttgggtgacacagtgagcacccatctctatttaaaaaagaaaaaaaagttagggagaaaaaaagtacaatgaagaaatggcttggctgggcgcagtggctcatgcctgtaatcccagtactttgggaggccaaggcggctggatcacttgagctcaggaattcgagactagcctggcaacatggtgaaaccccgtgtctacaaaaaatataaaaaattagccaggtgtggtggcctgcacctgtggacccagctacttgggaggctgaggtgggaggatcacctgagccaggaggtggaggttgcaggttgcagtgggccaagatagcgccacactccagcctgggtgactgagaccccatctcaaaaaaaaaaaaaaaaaaaaaaaaaggaaatgcctcaaaacagctacagctaggtttaggaaaggctgtcatcatatttgaggattccatagtgtcttaatgggggaaagctgaaaagaagaaaatgagccttaaagaatattatagctgatgtgaagtggaggcagcttgtttagcagaaaaagtagtggtttcagctgcatgatgggggttagaaaaacatacagaagtcagtatggagaaagaaaaggtacttaactaagaagtagagagaagatgggcaaactagaagggccagagaactgaaatacataaaatgaagaaaaagaagagggatagttgaaaactggtggagcagttgacatcaatttcattaatgggacagcaagactattttgatgactgttatttttttcttttcttttttttttttttttctgagacagagtctcgctgtcgcccgggctggaatgcagtggcgcaatctcggctcactgcaacctctgtctcccgggttcaagtgattatcctgcctcagcctcctgagtggctgggattacaggtgtgcgccaccacacccagctaatttttttttgtatttttagtagagaaggggtttcaccatgttggtcaggctggtcttgaactcctgaccttgtgatctgcccaccttggtctcccaaagtgctgggattacaggcgtgagccaccgcgcccggctgtgatgaccatgttttaaaaacccaaaacaaatagacttataaacctattctgaaatcatagaaaatccaaatattacccagacagttgatgtggaaagtggaatagctatgtttttaattttattgaagagattgaagtgaaaaaaggggtggtagtgggataaagtaaatattaacactaatgagtagaggagaaaaaaaggattttctaagtgtatttttcatccctgttaattgcaccactcacccatttagtcactgattcagatgaccagcctgggaatcaggccagactctttcttctccattttactgcatgtccagtcccaccagactaaatgctgtgaacctttggtttgtacatatcctctacttcatcctattctcacaccttttgcttgtgccattgcaggagcctcttgctgagactatgtagtctgtccacgctgtcatcgtgatctgtgaacaatatcaagggtcattcttgtgctcaaaatccttcatgagcacttcctgcctgtgggataaactctttgttgatgggcagtaccctgcatgctaaacctctctaggcttgtgttccatttcttcctcctcatttcacaaccctcatccccaacctactttatttttatttatttatttatttatttatttatttatttatttatttatttatttattgagacggagtctcgctctgtcacccaggctagagtgcagtggcgccaccacggctcactgaaagctccgcctccggattcacgccattctcctgcctcagcctcctgagtagctgggactacagccacgcgccaccacgcccggctaatttttctttttttttttttaatagagatggggtttcaccgtgttagccaagatagtcttgatttcctgagctcatgatctgcccaccacggcctcccaaagtgctgggattacaggcgtgagccaccgcacccggcccatttatttatttttgagacagagtctcactctgtctcccaggctggagtgcagtggcgccatcttggctcactgcaacctccgcctcccaggttcaagtgattctcctgccccagcctcccgagtagctgggattacaggtgcatgccaccacgcccagctagtttttgtatttttagtagtgatggggtttcaccatgttggccaggctggtctcaaacttctgacctcaggtgatctgccctcctcggcctcccaaagtgctgggattacaggcgtgagccactgtgtccggcccccagcctcctttaatactacaggttgagtgttcctaatccaaaatctgacattctccaaaatctgaagctttttgagtgccagatgacaccacaagtggacactttctttcctgacctcatgtgatgggttgtaatcaaaacctggggacataacccaaagttttttcagtgtccccaagggaaaaagaccctcccagcccccttcggttgtgatatatcttttccatgcacagcatgatggtgatgtccaggcaaccacagattgaccacgtaggtggctaagggtagtgacacatttgctttctaattcagtgtacgcaaatttattttgtgcacaaaattattaaaaatatttataaaattatcttcacattctgtgtatatgaaacataaatgaattttgtgtttggacttgggttccattcccaacacatctcattatgtatatgcaaatattcccaaatctgaaacaatctgaaattgaaatgcttctggtcctaagcactttgaataagaagtcatacttgtcgtcctagaatgttttatatctgtgaatgggctctttgcttctgtgcataatggttttttttttttttaacagttttagagataaggcctcactctgttgtctaggctggagtgcagtaatgcgatcaatgctcactgtggcctcaaacaaactcctggcctcaattgatcgtcctgcctcatccctctgagtagctgggactacaggcgtgtgctgccatgtctggctaaatgttttatttttattacttttttgtagtgacagggtcttgctatgttgcccagcctggtctcaaactcctggcctcaagtgttcctcccacctcccagagagctgggattacaggcatgagccactgtgcctggccctgcgtagaatcttgtccctcagcttgaccagctcctgtttgtttttcaagatttagccaaggggacttctgagaagctttttcttctctgctaagaagctgtggagagtaatggtttgagaacatgggcttcagtcagacatacctggattcaaatttctgtttgttttttttttcaaggagatggagtcttgctctgttagccggctgaagaagtgcagtggcaccatcatagctcactgcagcctcaaactcctgggctcaagtgattctcttgcctcattctcatgcctggcactacaagcatgtgctactatgcccagctcaaattcttttagtgatgcatgaccttagataaatcacttacacttgttttacctgcatttctttatgtgtagaagagggataatgaaacttgcagtggcaagcacatagtgagtactccatatatgttatggtaggtgctgctgccgccatcgctatcatcatcatcatcataagaattactgtctcctatgagctcccataaacaatctcattgctttgcaaatcgctttaaatattttcttgtcctttcttcacaataaactcctctctttaagggcaaccactgtatccttaatgctgaatgcagtgcttaacacacgcttaggtgcttagtaaatatttaagtatgtgcaagcataagaagcttattttatggatgacagtgtaagaaagagtacagactctgctgattaccagccgtgtggcctttgagctttgttatttattttccttgccacaggtgtaaaatgggagatagtgcctacctcagaatttaaagattacatctcatattgtatgtaaagtgcttagcataatgcccatagtgggtggttaataaatgttagctattatttaaaaaataaatcaatcttggatcttggcgagatttgacagtagatctattttactttaagtgacatgtgaaatgaagatttaagagtactgtattttatatagtcacgcttacatagttgcttaataattcggagttctgacaaatgcatccttaggcgatttcatcattatgcaaacattgtatagtgtacagttatcccttggtatatgtgagagcttagttccaggacccccacatataccaaaatccctgaatattcaagtccagaagttggccctgtggaacctgagaattcaaaaagttggccctctgtatttgcaggatggggttttgcagcctgtgtttggttgaaaacatttgcatataagtgaaccagtgcagttcaaacccatgttgtttgagttaaccatacttatacaaacctagatgttatatatatctacaaacgtagatgttacacacctaggctgtatggtatatagcctattgctcctaatctacaaacctgtgcagcatgttactctatttaatactgtaggcaactgtaacacaacagtaagtctttgggtatctaaacatatctaaacctagaaaaggtacagtaaaagtacagtattaaagataaaaaatggtccacctgtggagggcacttaacatgaatagggcttgcaggactggaaattgctctgggtgagtcagggagtatgtggtgagtgaatgtgaaggcctagggcattactgtagaacaccgcaggctttacaaacactgcacacttaggctatgctaaatttataaaatatttttcttcaatagtaaattagccttagcttactgtaacttttactttataaacttaaaaatttttaaactttttaactcttgtactcatacttagcttaaaacacaaacacatatagctgtacatattttctttcatatccttattcttataagcttttacgatttcaaacatttcttatttttaaaacttttttgttaaaaatgaacacacaccacatacattagctgaggcctccagagagtcaggatgatcaatgtcactgtcttctacctccacctcctgtcccactggaaggtcttcaggggaattaacaggcatggagcagtcacctcctatgacaacaatgccttctcatggaatacctcctgaaggacctgtctggggctgttttacagttaccttttttttgttgtttttgttttttgaataagtagaaggagtatactctaaagtaatgattaaaagggtggtatagtgaatgtataagccagtaacatatttgttatcgttatatgactggcagtgcagtaggtttgtttacaccggcagtaccacaaatgtgagtagtagtgccttatgccgtgatgttaagacaggtgaaaacatcactaggtgatagaaacttttcagctccattataatcttacaggatctctgtcatatatatatagtcttgtagactgaaatattgctatgtggcacatgactgttttctaactttagtcttagatattgaaaggatttaaggctgggcgcggtggctcacgcctgtaatcccagcactttgggaggccgaggcgggtggatcatgagttcaggagatcgagaccacggtgaaaccccatctctactaaaaatacaaaaaattagccgggcgcggtggtggacacctgtagtcccagctactcgggaggctaaggcaggagaatggcatgaacccgggaggcagagcttgcagtgagccgagattgcgccactgcactccagcctgggcgacagagtgagactccatctcaaaaaaaaaaaaaaaaaaagaaagaaaggacttaaacctaaaatgcttaagaagaaaaatgatgaaattttccttttctatagtatagatagaattttggaagtgatgtattcataaatatttgatgagttcctattacatggagcacatttctggttatgcttagaagggttaaatactacttgaaaagtactcatgcggtgtagcatataatagcctctcaaaaatgtcacagaaatttagaactatatagtgacctatgactaatcccactgcaaaaggagcaggtgactaaattgtagacaatacctggtgtgaaatgtttgttcccttgatctataaattgataatcctttaatgtttaatctgactgtgactagtggcctgaagaggtaagacttttgtgtttttttatgtgtgtgcctacgtatgtttttttcttgtgacctaaggctttgtggaagtttaaaatagagtgattttaatgaatggctggagtaataaagatagttggtgggcttctccatggaagcaagttggttatttttaactactttgcactgctttatggaaaacatatgccactatagaagttattgtttctgttgactgtgactggtggtggttattacttagttggttctaggagggccagtttttagctaatactttgaaagtgagttctgtgactattattacttagttggttctaggagggccagtttttagctaatactttgaaagtgagttctgtgactattattacttagttggttctaggagggccagtttttagctaatactttgaaagtgagttctgtgactatcaaagaccagaggaataatctcaaagaagctgatcagatcatggaactaaagtcacttgttctggtgaggaacagttgaaagggcacataatacttttggtaataatatttaatgtaacttatttagcagtgcgtgttcatgattggcaaggcaggtgagtagattaggaaatgagtctgaaaaagtagggcaggactgctggcttaaaataggagtgaaagcagtgaacagacatagctatttaggcaaatcctagtgtcccatgaggataagactaccacaataatctaaaaataatagcttataggccaataacctttaaggtttatgtttcatactcaccgcaggtcaacccatgtggctgtttctcatttatgcagatctacatcagattttacttgtgtttacctgaaaatacatattgtttatgtagtcaatgtatattgtagtagcatacagaatctgatcttgaaaaggttgcagaatttcttgagtgtactttaggaacttagtttttcaaaatttatttaatttttattttgataattatagattcacaggaggttgtaaataaagaaatgtaaagggaggtcccaaacacctctcccctaactcccttccctctctttgcccgtgtcagtatcccacaccaccacacacagtagtataccaaaaccaggaaattgacattggtacagtccatagagcttgttcagatttcaccagttatacatgcattcctgtctgtgtatgtgtgtttagctttacacaatttcacatataggtagcataactaccagcacaataagggtactcaacagtaccgtaaccacaagatttagttacttcccctgtatagctacaccagtcccccttctccacgggaaactcagttttatagtttggctattgtttttaatcatgtgcaaacctggtttgattaaggtttttgcttctgatttggaagcattgttaaataatttttaatgaaatacaggtaatctgaaagcagctgacacatggtaaaaagctagatttgggaacactgaaagacttcttggatgcataggcttagaatgattctcagctgtgatttatttcctccctccctccctccctccctccctccctcccttcctcccttcctcccttcctccctcccttccttcccctccctccctccctccctccttccctccctccttccttccctccttccccctccatcccttcccctctctcaatattctgtaatattgaaatatttcgttaaaaatatacagcatattacatatatatctgaaattttctcctttcttccttttagtataccttctatttattttggtaccaagaatagagtgctgctgtaacaaacacctaaaagtgtggaagtggctttggaacttctgaaagacccagcccaagtcccatcttcatttatttatttatttatttttaagaattttttttccaaggctggatctcggctcactgcaacctccgcctcctaggttcaagtgattctcctgcctcagcctctggagtagctgggactacaggtgcacaccaccatgcccgactaatttttgtggtttttagtagagatagggagggtttcacgatgttggccaggctgctcttgaactccaggcctcaagcgatccatctgcttcatcctcccaaagttctggaattacaggcatgagccactgcacccagcccaagtctcaactttctcatacacttaattgatttctgtagctatcgttgatttccccctttataatcttccgtacttacagtctgaaccatacaatgtactgcttaactattctgtgtttatatcttgttttatgcgaattctactcaactagagcatatgattcttcaaggtagaataaatgtgttaaacttgtatatttcggccgggcgcagtggcttacgcctgtaatcccagcactttgggaggccaaggcgggcggatcacctgaggtcaggagttcgagatcagcctgggcaacacggtgaaaccccgtctctactaaaaatacaaaattagccaggcgtggtggcacatgcctgtaatcccagctactcaggaggctgaggcaggagaaccgcttgaacctgggaggcagaggatgcagtgagccgagatcgtgccattgcactccagcctgggcaacaagagtaaatctccgtcgcaccaaaaaacaaaaaaaacaaaaaaaacacacaaaaacaacttgtatatttcacacattacccatacaatgtgagcatgtagtaggtaccagataaacatttagttatttaactagaatataattactgctctagtattttttccctagcactttcaaacgttactcaaagaatccttctagctctttgatacaaattttagaacttcactattaacaaatatcagctgggctcggtggctcacgcctgtaatcctagcactttgggaggccgaggcaggcggattgcttgaggtcaggaatttgagatcagcctgaccaacatggtgaaaccttgtctctactaagaatacaaaaattagctggccgtggtggttctcaactgtaatcctagctacttgggaggctgagacaggagaattgcttgaacctgagaggcagaggttgcagtgagctgagatcatgccactgcattccagcctgggcaacagagcgagacaccgtctcaaaaaaaataaaaataaaaataaaaataaataaataaaataaagtaaaataaaaatatatatatatcactactagctaggattttaggaaggctacctatagaaacttagatatatttagttatggaatgttttgtttttcagttggtaatgtacactctttcagtgtttcaaaggaggatactggataattcgatttgaattgtaaatctccccaactggtgttggagaaaccagaggagttgatgattttatacacagtctttcctacctcttattattgagaaaagagtgttaattgtggtcaatgaatttcttcaaagtttgctgcttttaaatcaaattaaggaagtcagcaactataagtagaatgatatgaataaaatgtttcattgttatgaagaagtgttagtagcacgtggcattatgtgtttcacatattgaagttgacaccagaaatatacatttgtaattttttttttttttctgagacagagtctagcactgctgcccaggctggagtatagtggtgcagtcatagctcactgcagcctggaactcctgggcccaagtgatcgttccgcctccacctacacctcccaagtagctggaattacaggcacatgccactgtgcccagaccattttagtgatttgttattttttaaatctctattctctttttaatacagagctgcaaatttcttacttttctttagtgcaatccatgtgtgaaatatgtgttataatttgtaactaacaatatttgaagtcctgaagtttttgaatgatcttgtatgtaagattagagtagattcatggttcccactaataaccacttcattattatcactttgttatgtgtgtgtgtgtgtgtgtgtttaaagagataaacttataggtggtttatctagaattgtgtaaaatactttcattttcatgagagagtatcttgcatgtgagtattatttgtcacatgttatgcctacattgttggttggacttaaactttagtgacctctcagagattattttcattctagttcatgtcatattactttgatatatgtattaagaagaagtacaagagattatttaatgctattgtctgaatgtttgtgaccccccagaatttgtatgttgaaatcctaatccccaatgtaatggtattaggaggtatggtcttggggaggtgaagtttttataaatttctaaaagaaagtataggaaaaatctttgtgactttggggtagactattttcttagataggtcatagaaggcatgaaccataaacgctgacaattggacttttgaaaaattgttcttctaaagatgtttaagaaaatgaagaggcaagccacagaatgggagaaaatatctatactgcattagtggagtttactactaaattaagaaaacattagaagattgtctatatagtataactgattataaaataatgtatttacatatttaaaatattaagatatatactgacatcttaacagtagttgtctttggctggtgagattctaagagttttgtttttgtggtggttattgttttttgttttgtgctcttttaaaaaattgttttgcctcaagtgtatagtatctttgatttataaaaatctttaaataaagataggatagtttgaaagattagcagaatgtttacaatcaatacttgatactacatggataatactttcctattctatttttgtaaattctgtgcttgaaaatttcaaagaattttttgtgtgtgagtgtgtgttttgaggtggagtctcgctatgttgcccaggctggtctcaaactcctgtcctcaagtgattttcccatcttggccccctgtagcattgagattacaagcatgagccaccattcccaggccaaaactttcgaaactttaaaaaatagcatgaaaacctttattttagtccaggtgcaatggctcacatctgtaaacctggcactttgggaggctgaggtgggagaactgcttgaagccaggagtttgagaccagcctgggcaacatgatgacacctgtctctacagaaaatttaaaaattagtcaggtgtcatggtgcatatctgaagtcccagctactctggaagctgaggtgagaggattgcttgaggagttcgaggctaccgtgaggcatgatcaagcagctgcacaccatccagcctgagtgacagagtgagagaccctgtgtctaaaaatgaaaaaagaaaatctttactttatttatttattttttgagatagagtcttgctcagttgcccaggctggagtgcagtggtgtgatctcggctcactgcaacctccacctcccaggttcaagtgattctcctgccttagcctcccgagtagctggaactacaggtgtctaccaccatgcccggctaatttttgtgtttttaatagaaacaggatttcaccatattggccaggctggtcacgaactcctgaccttgttatccgcccaccttggcctcccaaagtgctaggattacaggcgtgagccaccgcacccagctgaaaatctttactttatttacagcactttgtgagccatatttagcaaacatagttccacatatgaagtttgtttttaatgataaggggtttttaaacttgatttttagtataaatacacagtataataaaagtttgtttacattagatatgaagctaattaccacccctaactgctggctggttttctagaattgtagaagcaggtggtgaattttcctgtctgctgatatccaaaacactctgattcctgggtaagttccagcagtattggatgttggtaatattactgttggtcgattaatttatgatagtattatatacatctctaaagtctaattctatgtattttttaagtaaatagtagaataacatggcataacattttaaaaggtatgtggtaaaaagtcttcctattcctaactgtcagccaccagtttcctgccatgggactgttaaatctcaccaccaaagaccaccaagaaaacatctgtagtcaaaaataagttacactgatttagcttgctgcaggaaggaataacatacatcagaagagctgtgggacctctcaaaaggatagagttaggaaagaggacatacaggattttaggagctgttagtcacagagtaatgttaggataaaggtagtagtctgggcagggattggctagaatatgtaatttgagtgagttgctggaacagccagtagttttgcctctaggacacataagtccctgaggatttactgttagatcagtttgtggtactagaacatacgggtatgagtgagctgatattaataaaggtttgaggctgggcacagtggctcacacctttaatcccagtgcattgggagtctaggatgggaggatcgcatgaggccaggagtttgagactagcctgtttaacttagtgagacctcagtctttaaaaaaatttttttaaaattaaaattaactgagtgtggtggcacacacctgtagtcttaggtacttgggaggctgagggggaggatcacttgaactcaagagttggagactgcagtgagctatgatcatgccactgcaccccagcctgggtgacagagggagaccctctctcttaaaaagaaaaaaaataaggtttgagcttagatggcctgtgatgcacagtacattgcggtttggtttggttcagtttatctgttttgcaagtactaagtgcttttctgtgcatctgcaagcaatttgtagtgtaatttcagttttgtttcactttttaatctctgtttctgatcattcgtccgctaaactggaacatttaccatttaggggaggtgatcaatcaagatttcaaactgtcgtttgatgggttgtgaatgtttataaagctttgatggtagacattttggcctctacaggcaccaggccattttgttcttttttttcttttttctttttttttttttgagacggagtcttgctctgttgcccaggctggagtgcggtggcacgatctcggctcactgcaagctccgcctcctgagttcacaccattctcctgcctcagcctcctgagtagctgggactacaggcacccgccaccatgccaggctaatttttgtatttttagtagggacggggtttcaccatgttagccaggatggcctcgatgttctttttcttagatgataatttgttgaatcagctggtgtgacagtggctgcacagcagcatttaagactctaaagatcacacacttggcatctgcaacacactgaaactcagacagttattattaaagtttaaaataatgtcccatatatcccataatctatttggattttcctttgggcaaccaaatatattttttttcctttaatttggatatgggtcattcacctttgcaactgtcccatatttggtttatattttgccaaggataagcatcttgatagtgctaacagtaaggaaaagttatctgttagcagcctaaaatcttacaacagtggagagagaagaaaatgccaagagaataaaggacaaaatcatgcaagtctgtagtcatcagtggcttctggcatctgggaggttgtgttctgattatcttggacataaatagtctattcattttatcttctgcttctggaccataacagttctggaaatcttggctcacccactgtttgtccatggcaatgatgtcggcagtatgcatcattaatttattctctgtagtgtcagtaatgggtgcatgatacaaacatttacaaaagttcttttgataagtcttccacaaggctcaattcctatctttagcttatagccaggaactttagatgaatgtaaggaagaagcggaaaccacctgtggatcatgggactataggctttagttgatttattatattaaccagcattatcagaatggaagggagtggaatcttctattgcagaaagtacataatgaattttatgagtagtcactgattatcctagaagtaagaatatctcacaaacagggaggacattgacagtctctaggactttctttcatttatcctataaagtgtattatgagtttcaccattccaagtttactgaaacctagaaataaaatccttttttagatagctattgtggcagtctttgtactcgaatgtatgttttcttttttttttttttgagacgaagtttctctcttgtttcccaggctggagtgcaatggcatgatctcggctcactgcaacctccgcctcctggattcaagcaattctcctgcctcagccttccaagtagctgggattacaggtgtccaccaccaaaccccgctaattttttgtatttttaagagagatggggtttcaccatgttggtcaggctggtctcgaactcctgacctcaggtgatctgcctacctcggcctcctaatattttctttaagccgaaagatacttaaatgttgaagtatatttattttaaccacattttattatacatgattaaattgggaaggcttaactttccttatgatttgtgaggtttttttttccctttaacccaaatttaataaagcaaagagttctcacaaaagttttaagttaattaaaattcagagtatgccaaacaaagctaataatttttataatcctttaaaaaatttttaataaagtaaaggactaaagctttgttttacctagtggccatttattataaacccaaagatgtagtaggtgtaaaagacatcttaacaatttcttattatttacttattttttagagacagggtctcgctcagctgtctaggctggagtgcagtggctggatcatagctcactgcagcctcaatctcctgggctcaagtgattttcctgcctcagcctcctgagcagctgggactataggtgtgcaccaccacactcaactaatttttgtgtttttttggtagagacagagtttcgccatgttgcgcaggctggtctcgaactcctgagctcaagcaatccacccacctcagcctcccagagtgatgagattctttttataggtgtgagtcatcatacctggactactttttgctttttgactgatgattccaagagccttttcagtgtttagcacatagacgtagatagttgtagtctttacttaagtttgaatgaagtgagttatgcgtgggctgagttcactcaaagcttgcctcagctgggattattgaccatatacccactttactggagaatgagtatgccaagagaccgaggcagaatctgcaaaatcacttctgctgcaatgtatttgttaaagcaggtcactaaggccagttcagattctacgggagagacattagactctccctttttttttttttttttgtcacctaggctggaatgcagtggtgctatcttggctcactgcagcctcgacttcctgggctcaagtgatcctcccacctcagccgcccaagtagctgggactccaggcttgtgacaccacattcggctaatttttgttgtgtttttagtagagacggggtttcaccatgttgcccaggctggactcaaactcctgagctcaagcattctgcctggctcagcctgccaaagtgctaggattacaggcatgagccactgggcctggccttagactctacttcttgataggatagggtcaggtcactgctatgctttaaatatgatccccagaaagcatatgttggctgcctgggtgatgggtatactagaagcccaaactttaccattatgcagtatatccatgtaaaaaaggtacacatataccccttgaatctgaaatttaaaaataaaataagtatgtattagaaaatttatcccaaatgcagtagtgtcgggaggtggggcctaatgagaggtgtttaggtcatgaagccacctctaatgaatgcattaatgttgattataaaagggcttaaggctgcaagttctatctcttgctctctcttatccctctttgcccttccactatgggatgatgcagcaagaagacccatgccagatgcctggcccctcaatcttgaacttcttagcctccagaactatgaatgagtaaatttctattcattataaattatccagtctataatattttgtcatagcaacacaaaacagaccaagacagtgagattacagaagagtatgtagagtgagaaatattattgtagccatttttttttagtttttgctttttttaaaaaattattctttaagttctagggtacatgtgctcaacatgcaggtttgctacataggtatacatgtgccatgttggtttgctgcacccaccaactcatcatttacattaggtatttctcctaatgctctccctcccccagccccccatcctccgaccagccccagtgtgtgatgttccccaccctgtgtccatgtgatctcattgttcaattcccacccaagagtgagaacatgtggtgtttggttttctgtccttgtgatagtttgctgagaatgatggtttccagcttcatccatgtccctgcaaaggacatgaactcatcctttttatggctgcatagtattccatggtctatatgtgccacgttttctttatccagtctatcattgatggacatttgggttggttccaagtctttgctattgtgagcagtgctgcaataaacatacgtgcacatgtgtctttatagtagaatgatttataatcctttgagtatatgcctagtaatgggattgctgggtcaaatggtatttctagttctagatccttgaggaatcaccacactgtcttccacagtggttgaactgatttacacacccaccaacggtgtatttctccacatcctctccagcatctgttgtttcctgactttttaatgatcaccattctaactggtgtgagatggtatcttattgtggttttgatttgcatttctctgatgaccagtgatgatgagcatttttgcatatgtctgttggctgcataaatgtcttcttttgagaagtgtctgttcatatcctttgcccactttctgatggggttgtttttttcttgtaaatttgtttaagttctttgtagattctggatattagccctttgtcagatgggtagattgcaaaaattttttctgtttttgctttttgagatggagtctcactctgttgtccaggctgacgactgtagctgactgcagcctcaacctattgggttccagagatccttctgtgtcagcctcctgagtagctgggagtacaggcagatgccaccacacctggataatttaaaaaaaaaattttgtagagatgggggtctcaccatgctgcccaggctggtttcgaactcttggcttcaagcagtctccccaacttggattcccaaagtgctgggattacaggagtgagtcaccatgcctggctggttgcagccagttttggaaaataaaatgtgctacagacattgtaagggcaaaatatttaacaataactgagatttctaaaaattgcagattggctaaatgttaataaattatgatctaagtaaattatatctacctaggagaaaataaaaaaaaatttatggtattttaaggtatttatttatgtacttatgcattgagatatttgccatcaaaatttttactagtgcgtataagtacctaacacatagtagcaattcaataaaattatttgaatgaattaattgaggatacttttcgatcatagtttttatggtgagagttttcattttgttctgtcttatttttatgtgtattttagttagatgttcgcttagtctattcaagatgtgttttttgtttgtttgtttgttttgagacagagcattgctctgtcgcccaggttggagtttcagtggtgcgatctcagctcactgcaacctccacttcctgggttcaagtgattctcctgcttcagcctcctgaggcaagcacgcgccaccacacccggctaattttttatttttagtagagatagggtttcaccatgttggtcaggctggttttgaactcgaccttatgatccacctgcctccgcctcccaatgttctgggattacaggtgtgagccaccgcccccggcctgttcaagatgttataacaaaatgccttagactgggtaatttgtgaacaacagaaatttatttcttacagtcctagaggctgggaagtccaagagtcagcttgccagcagattgtgtgtctggtgagggcctcttccttataagtggcaccttctatgtgtcctcacgtggcagaagggacaaacaagctcctttggacctcttttgtaatggcacaaatgccattcatgagggcagagtccttacgacctaataatttcccagatattccacgtcttaataccaccatgttggggattaggttttacctatgaatttttggaacattcaaatcatagcagctgttaagaaatgttgaatcagaagtttctagtcattcttttttttgtttttttgaggcagagtcttgctctgtcgcccaggctggagtgcagtggtgcaatctcggctcactgcaacctctgcctcccgggttcaagtgactaccctgtctcagcctcccgagtagctgggattacaggcgcccgctaccacgcccagctaacttttgtatttttggtagaggcaagagtgtcaccatgttggccaggctggtctcaaactcctgacctcaggtgatctgcctaccttggcctcccgaagtgctgtgattacaggcgtgagccactgcacctggccagaagttgctagtcattctaaactggaagcttgacataatattttgaatcaagcattttaaaaatgtctgcttttcataaatagtttatttttacatatttatccctttcatttaggaaagaagattcatgagttttttttttaatcagctggcaaattagagaaaatatttatacagcttctaataggcatctcaaattattttgaaacattgggaatatatcttttgtaatgttttgcttgtaataattgaatagattttctcatttggtaataacttggaaaatacaaagtggcccatttaaaatggactctgatttaaaggtactgttggaggcattggtgacgggccatttttccttttaaatagagaaagtatgacaatctattttcaagaaactgccatagcaatatttttagtctcatatgctcgcacagaattttgtcactccccaccagtaggtggaatctatttccactcttcttgaacctgggcaggcttgtgactgttcaaccaattgaatatggtggaaataatgtgatgggatttctgaggccatgatataaataggatacaactgatccagcaatcgcactactgagtatctacccaaaggaaaataaatcaacatgtttattgcagtactattcacaacagcaaagatacagaatcagcgttgagtatctattagtggatgaatggataaagaaaatatggtatatatacacaatggaatattgttcaaccataaaaaaacaaaacaaaataatgtcacttacagcaacatggatggaactgaaggtcattatcttaagttaaataagctaggcacaaaaagacaaatatcatatattctcacttatatgtgggagctaaaaatttgaacacatggaggtagagaatggaaaatagataagagagactgggaagggtgagtgggggaaaggggaaggatgaagagaagtgagttaaagggtacaaacatacattaagataggagtagattcaatgtttgatagcagagcaggatgactatacctaacaaaaatgtattgtacctggtgatgaacatcctgaagaccctggcttaatactatgcataatatacatgtaacataattcctcatgtaatctgtaaatttgcacaaataaaaagagggaaaaaaaaaagctacagcttcttcctggctctctctttgtcttgggatgcttgttgttggaactaagtcatacgaagaggccacatgtgggtattctcttcaaaaacctgagctaagctgcagccaacagccagtattaaccacagtatgagtgagaaagctttcaggtaattccagccccaggttgtcgagtatcctgctgaggccccagaagttgcggagcagagacaagccagccccactgtgccctgtctgaatttatggtccacagaacctgtgatagataataagtgattattgccttaagccactaagttttggggtaatttgttacatggcagtagataattcatataatttctagaaacttatagggaaataaagatttgctcaaagacatatatatatatatatatgtgatatataaatgatccatgtatatatatatgatatgggtgatatatataaaataaatatgggtgatatatatatatacacacacacacacacacacacacacatacatatatatatgttctctgctgtatcatttatttatgttttcttttttttagaggcagaatctcactctgtcacccaggctagagtacagtggctcagtcataggtcactgcagccttgaactcctgggctcaagcgttcctcctgccatagcctcccaaagcactgggattataggtgtgagccacgatgcctggccctgcagtataatttacaattttttgaaatagtctagctatccaacaataagaaaatgtttaaataaattatcataagcacactattttcctaagtaaaatttctacattttctatattcaaaaacaaagtttaaagaattggtatatagtcaattatgtcataatgataaacctaattgaattatatatttacataaataaagatcattaagaacaaaaaaggctttacatctgataaaggacatgtacccagaacatacaagaactttcgtcagtcaataagaaaagatactaaatgttttaaatggacaaaagaattgaacaagcacatccccaaagaagatattcaaatggcccttaagcaagtagaaaggtcctcaacatcactactcatcagggaaatgcaaagtagagaacaaagagataccggtagacgttcactgtactggaataaaatttagcagatgagcaatattgagtgttgacaaggatatgaagtaactggaacccttacaccttgatggtgtgagggtaaatggtatcactttgtgaactgttgggtaaaaccaatgttgaccccataaactttcagtcccattcttgggtatatacctaagagaaaagagtgcttatgtccaccaaagcacacatagaattatattcatagcaactgtattcataatggctcaaattggaaagctgctctagtcatacattgtctgcccttacctttattaacgcagtagtgcttagcatgtagctacctgtgtttagtttaatatgtattattaatgaaaatttatttaggggatttcacccccaattttttaactttatggtttcaaatttcttaaaacctttctctttacatcagtttggttttggaagactaaaagaaagagcttgttgcacagatggcccaaagcacaaattattaaaatgctaacttttatctacatccagctccaaatattcccttactccttgatcattcttttttttttttttttttgagactgagtctgtgtcacctaggctggagtgatagatgtatatatggtcccctattctaaggtaatacagtcatgcatccgagaaatgtgtcatgagatgactttgtcattgtgagaacaccatggaatgtacttacagaaacctggatggtgtaactgctatacacctagatggtgtaactactactatgcatagtctatatgatatagcctattacttctaggccacaaacctgtacagcaggttactgtactggatactgtaggcagttataacacagtgctaagtatttgagtatctgaacatatctaaacatagagaaggtacaataaaaacacagtataaaaggcaaaaactggtacacctgtatagggcacttaaccatgaatggggcttacaggactggaagttgctctgggtgagtcggaggtgaatgatgagtgaatgtgagggcctaggacattattgtacactactggagactttataaactttataaacactgaacacttaggctacactaaatttaaaacaaatttttcttggctgggcatggtggctcactcctgtaatcccagcactttgggatgctgaggtcggcagatcacttgagtccaggagttcaagaccagtctggggagcgtggcaaaaccccatctctacaaaaaatacaaaaattagccaggcatggtggcgcacacctgtagtcccagctgaggactgggaggctgaggtgagaggatcatttgagccaggaggttgaaggtgcagtgagccatggtagtgccattgcactcccatctgggcaataaagcgagatcctatctcaaaaacaaattttttttctttaataatatattaaacttagcttactgttaagtttttactttataaatgtttcagtttttaaaaacttttggacttttttgtaataacacctagcttaaaagacaagtacattgtatagctatagaaaataatttttctttatatctttataggctttttctatttaaaaagtttaaatttttttttaacttttagaatattttggtaaaaatgaacacacacacacacacacacacacacacacacacacacacacactgagcctaggtctacacagggtcaggatcatgaatatccctggcttgcccccctacatctttatccactggcacaccttcaggagcagtaacaggcatggagctgttatctcctaggataacaataccttcttctggaagtcctcctgaaggacctgcctgaggctcttgaggagatgtcactcttttcagaaatttgcccatggtgttttgcttggtttatttctatttttcattgtagatttgtttgtaagcagttaatgcagcatgaacattcctgtgtattaatgaaaacctttctgtttttgggggtccatgttttcacacttcctaaggagtttgttgaggtgtgcaaaagcttctcccaaacccttcactgtgagttttgttgggggttctttttctttctccagcaaacttccttctctcttgctgcttcttcagctttgcattcctattccagttcccactcattagtcaattcctgcgatgttattgtggctataacgttactagatgacaggagtttttcagctccatttaactacagtccattgttgaccaaaacatcattttgtggcacacaactgtatttagctattttagtggttgggtagctgctatcgttttttcagtgaaatttgagtagttaaaatgagtcaagtagtagctgaaagcatgacgaaacttataataggactttctttacttgtaaatgatacaatatggtatggctagattaagtcttttaaaaatactcatagatttcaacttggttccataaagctggaagtggaaacattggacatatatcagaaattcaattgaacgcctccttttaaatttatggtttacagacttgtggctcttagatcccaggggatctaaagtagactgtgttataaagtaggcacataacaagacaacagccaatttaaaaatattaaatgaacttgctaattctccatgatattatatatataaactttgtacctaatgtaaactgaaggtagttattagcatttccaggttagaaaacataactggacttcccttatccactttttttttttttgaaacggagtcttgctctgtcgcccaggctgaagtgcagtgtcacaatctcggctcactgcaacctccatctcccagattcaagcaattcttctgcctcagcctcccaggtagctgggattacaggtgtgtgccatcacacccggctaatttttgtatttttagtaaagacagggtttcaccatgttggccaggctggttttgaactcccgacctcaggtgatccacctaccttggcctcccaaggtgctgggattacaagcgtgagccacaccacacccggccccttatccattcttttatgctctgttactacagcaaattattctcagacatagctccatcttggtagtagtgttcttgttattatcagtaacaaagtacattaagctactgccttttgttttattctgttttgttttgttttattttgagacagtgtcttgctctgttgcccaggctggagttcagtggcgcgatctcagctcactgcaacctctgcctcccacgttcaagcgattcttctgcctcagcttcccgagtagctgggattatgggcacttgtcactacacctggctaatttttgtatttttagtagaggtggagttttgccatgttgcccaggctggtcttgaactcctgacctcaagtgatctgcctgcctcagcctcccaaagtgctgggattacaggcgtgagccatggtgcccggccgagacttctaaaacataggtgtcattaggacagttctataggagaaataaatgccattttagtattatgactacttttctttcattttctttaaccatagtttcatttttaacacctgttctatagatagaaaaacaaagatactcatgtcatctagtgtcttgtctcatttataacttgttccctgaatcagcttcaagtctttcatgtttatgtgtaaaacatagggctgggcgcagtggctcactcctgtaatcccagcactttgggaggccgaggcaggtggatcacctgaggtcaggagttcgagagcaggctggccaacatggtgaaaccctgtgtctactaaaaatgcaaaaattagccaggtgtggtggcatgcttctgtaatcccagctactcagaaggctgagacagaagaatcgcttgaactcaggaggcggaggttgcagtgagctgagatcgtgtcactgcattccagcctgggttgacagagcaagcctccatctcaaaaaaacaaacaacaaaaaccattataatttatgcacacacaaatatttaaaatgactgtcacctttttatacttagaattgatcatttatgatacatagtatcttagaattttttccccacgtactggtgctgtggatgtgaaatcatggtgatttattaggtttaatttgtcatgtaaaagaattgtgttctgtttgttctctatacatttaaatattttaaattattattattatttttttgtagctgtcccctttcctccaacccaacggcttactttcaaggaagtatttgagaatgggaaacctaaagttgatgttttaaaaaaccatttggtaaaggaaggacgactggaagaggaagtagccttaaagataatcaatgatggggctgccatcctgaggcaagagaagactatgatagaagtagatgctccaatcacaggtataaaaagtctttgcatgatacttttttacagtatagatttgcatgagcagttttgagaaataattacaaataaccagctaaaaagtggtgtggtaatttttctagaaattatgagacagtcaggattggttaggatatttgttgttaattgaagaaatacaattttaagtgtctcatatttccagtagaactatttagtatgagtagattgactacagttttacagcagtcctgtcaaaagctggagtgatttaagttagaagttaaactgtgatcccttttggtgtaatgcccttcgtcttctaaggtataatttctcacatcactttatgctttttttcctagtatgtggtgatattcatggacaattctttgacctaatgaagttatttgaagttggaggatcacctagtaacacacgctacctctttctgggtgactatgtggacagaggctatttcagtatagaggtaaaaattaaactggatatgttgggactattatattgtctttcaaaaaagatgatttccattcttcagtagaagaaattaaaatgagaactctggcagaatttataaactttgttactttcaaaattaaagtagtagaaatgttttaattgatagaacagttattccttttttaaaaccagtcgaaaatctgacaaataggctatatattaatattaacccaattttacaaatagttaaatgttcaccaacttttcctcttgaagatagtatacaggattgtataaaaatgacataaattgctgttcaccctaaatggggtttagattagctgaccttaattataagaccataagctgctgagctacaattaacacttagattaactgccagtgctaaataaacactaagctttttgtaggaataatgtctggtactggtacacatagtaagcacttaataaatgttcactgaaggggaaaaatgagttgtagttaattaaaacttatactttccttttatatattttgaaaatggaaagataggaacatgtttagaattaaatagaagctttaatgtgtaaaagataaaactactttagaactttatgcaaggacttgagtacagtggaaccacagcacattcctagttaatgttcattgattcaactctacatgctggcaaataaaagagaaaaaaacttttgaaatagcgtgggtaataggatttgtaatgtgaccaagaataagcatgagctgagaaattgagtctgctttctgtcttgctgtctatagtcctgcctgccctcattgtgtgagaatctcactgtactaagtgtgtttctggtggttaaaggtttattgtcttgcagcctcactcctaaatgcaagtcagctctctcacctgatgcccaagcaaaggagcagcagttgctctattgctgtagaaaaaataagcaaaaaaatggatttttagttttctgttagataggcaatctaaattcatgaatcagaaaagttcaatgttggccaggcacggtggctcacgcctgtaatcccagcactttgggaggccgaggcaggcagattacgaagtcaggagatcaagaccatccttggtaacatggtgaaacgccgtctctactaaaaatacaaaaaattagccgggtgtgtaggcaggcacctgtagtcccagctacttgggaggctgaggcaggagaatggcgtgaacctgggagacggagcttgcagtgagctgagatcacgcctctgcactccagcctgggcgacagagcgagactctgtctcaaaaaaaaaaaaaaaaaagttcaatgttagttgccagtgcacaaaattcatttagtgtcaaatgtgaggacaaaagttaaaggtataaactgacaaaatagtaaagcccatttttccttctgctccgtaaatgtccaaggtctctaaataggtactgggaataggcggagattatccttgcagactgtatcattgaggagcttccctgttgccactcatatcatgcatgtttcagtagacataagtcaaatgtatggatgtggggctgcgcgcaatggctcatgcctgtaatcccagcactttgggaggccgaggtgggtggatcacctgaggtcaggagttcgagaccagcctggccaacatggtgaaaccccatctctactaaaaatacgaaagtttaccaggcatggtggtgggcgcctgtaatcccagctacttgagaggctgaggcaggataatcacttgaacctgggaggcagaggttgcagtgggctattgtgccgctacactccagcctgggtgacagagcaagactctgtctcaaaaaaaaaaaagaaagaaagaaagaaagtatggatgttagaaagacacattgagttcagtttatttctttgtgtttttgctagcatgagaaggtttcagacggtaaagattagaagaatacaaaaattactgaatttctaattaggcattttattttattttatttttttagagatggggtcctgccatgttgcctaggctggagtgcagtggctatacacaggtgcgatcatttcgtacctcagcctccaactcctggattcaagccatcctcctgcctcagcttcctgagtatatggaactatagatgcacaccactgtgcctggctagtcattgtatttaataaaacaacttttaaaatatttatttatttatttatttatttattttttgagacagagtttcgcttttgttgcccaggctagagtgcaatggcacgatctcggcccaccgcaacgtccgcctcccaggttcaaatgattcttctgcctcagcctcccaagtagttgggattacaggcacctgccaccacgtctggctaattttttgtatttttagtagagacggggtttcaccatcttggccaggctggtcttgaactgctgacctcgtggtccacccaccttggcctcccaaagtgctaggattacaggtgtgagccactgcgcctggcaataaaacaacttttttttttgagatggagtcttgctctgttgccctggctggagtgcagtggcacgatcttggctcagtgcaacctatgcctcctgggttttaagcagttctctgcctctgcctcctgagtagctgggattacaggtgcttgccaccacacccggctaatttctgtatttttagtagagatggggtttcaccatcttggccaggctggtcttggactcctgaactcgttatccacccaccttggccttccaaagtgttgggattacaggcatgagccaccgcgcccagcctaaaacaactttttagtgataaattattatgccaaattatcttctgattaactcgtataacttaaaatagctttaaaatagttttaattcattaatacattcaataaagcacatagaaaatatcaacaatgattttgtgcacagacatcatgttcagaatattttgtgttatgcatttttttcctcactcatcaataaagtttcttgagtgccaactttatgggcaggctgtgagaataaaataaagaataaaatttatgctctgtaggagcttccagtctaatagaaaagatgcacttacgaatagacttttgttataatataaaatgtgcttcttgaattaacagcgtttttcatattaggacttagcacagtgcctaacacatagtaggcacatagttaatatttgttgaatgaatgaatgttaataaatcatagtttgtatttagctttattctgttaattagatgtttgctaacttaaagggttttttctgcaataacttcagagataaatgaatcaaaactttaaggtgacaatgacattttataccagtgttaaaaccaaagtatgagatctatcgagtattcattggaagtcacttatttataaaccactaagattataaacctctataggctatagcttactctaacatgttgcaagtatacacttgaaaaataattttttaataaatattcttgatagccatgagtgtgatgtttttgtttaatagatgaaaataaggtcatggaattcttattaaaattttttgttataaataatttatttttaatagaaaagttgggaaatgcagaatctagaaaacaaaaactttctacaaatcagagataatcactgttaatgttttattatactttcttgcagccttttttcttcttttacatttgtatatattttgttttcaagaaaattgagagcattttgtacgctccttttctgatcttctttttccactcaagattgtatggaaagcatttttctgtattgttttctccagaagtgtagtgtcaaagtcaaataaaatagagacaaatctctgaaattaaaacattttatctgagaagaaaaaagaccagcctggcgaacatggtgaaacctcgtctgtactaaaaatacaaaaattagccaggtgtggtggtgggcgcctgtaatctcagctacttgggaggctgaggcgggagaatggcttgagcctgggaggtggaggttgcagtgagcccagatcgccccactgcactccagcctgggtgacttagcaagactctgtctcaaaaaaaaaaaaaaaaagaaaagaaaagaaaaaatgcaatttggggcatacacacagactgagcgggctttggtatgtctgaagaaaagagaaggttaggttttatgagaaagaaaaatgttatgtattgctgtttgagaaagttcattgacactagtaaggttctggagggctgacaagttttacttaatctcatgtaatcaatttatattctgcttgatctccgttaatagtttcatgagtccgtcagtttctttattagagttgtggaaatttttatttagcctattgcacttaatgttatcagcaacctatatttaagagtacttgttgaagtcttttccatgaatctgattgtgcatgtttttagagacaaaacagtaactgtggatgacaaaagcttagaacagccatggttaaaaatctgatgaaagtttacgattgataaggaattttgttatttctattatagatagcattttaggatacaataatcagaattaagactgagttatgagttatacaatttttatgagttatacaatttttgaaacatttatgttaacaacatacccctaaatgcaactaaaataagatctagtatcacttaccatttaacagtttcttatataatttactaaatgagcctgatcatttcatatctctgtaagatgagagatatagatcttttgaggctttccaggggctgaactggaaaatcccaaagttaatttaatttaattttatttttttgagacggagtctcgctctgtcacccaggctggagtgcagtggtgcaatctcagctcactgcatcctccgcctcccaggttcaagtgattctcctgcctcagcctcccaagtagctgggattacagccccccaccaccatgctcagttaatatttgtgtttttaatagagatggagtttcaccatattggccaggctggtctccaactcctgatctcaggtgatccacctgcctcagcctcccaaagtgccaggattacaggtgtgagccactgcagccagccccaaagttaattttaggtcaaaagtacttaattgaggctggtcacagtggcttaagcctgtaatcccactgctttgggaggcctagatgggaggctaacatgtgtccaggagttcaagaccagcctgagcaagaccttgtttctataaaaataaaaaacaaaaaaagacttaattgaggatttgattttggggacgtttgtcaaagatgtcaaaaggctcagaacatctgatcaaaacagaatcacacaggtcactataaaataatggtcatttggctgtgcgcagtggctcatgcctgtaatcccacacttggggaggccgaggcaggtggatcacctgaggtcaggtgtttgagtccagcttggccaacatggtgaaaccccgtctgtactaaaaatacaaaaagttagccgggcgtggtggtgggtgcctgtaattccagctacttgggaggctgaggcaggagaatcacttgaacctgggaggcagaggttgcagtgagccaagatcgcgccactgcactgcagcctgggcaacaagagcgaaactctgtctcaagaaaaataaataataataataataataataataatgataatattcattcagccagtgataaaagatttccaaagtaatacagaaagttacatggatgtaaaaacgttagtttccttaaagtttagttttcctaagttataagatacctaatgagggcaacacagaaattatcttgatgaaatgtggaagttttgtgttctttttttttttttaatgttttaaattctggtatacatgtacagaacatgcaggtttgttacataggtatacatgtgccatggtggtttgctgcatccatcaacctgtcatctacattaggtacttctcctaatgctatccctcccctagccccccacctaccaataggccccagtgtatgatgttcccctccctgtgttctcattgttcaactcccacttatgagtgagaacatgtggtgtttggttttctgttcctgtgttagtttgttgagagtgatggtttccagcttcatccatgtccctgcaaagacatgaactcatccttttttttggctccatagtattccatggtgtatatgtgccacattttctctatccagtctatcactgatggacatttgggttggttccaagtctttactattgtgaatagtgctgcagtagacatacgtgtgcatgtgtctttatagtagaatgatttataatcctttgagtatatacgcgataatgggattgctgggtcagatggtatttctggttctaatccttgaggaatcaccccactgtcttccacagtggttgaactaatttacactcccaccaacagtgtaaaagcattcctatttctccacatcctctccagcatctgttgtttcctgactttttaatgatcgccattctaactggcatgagagggtatctcattgtggttttgatttgcatttctctaatgaccagtgatgatgagctttttttcatatatttgttggccgcataaatgtcttcttttgagaagtgtctgttcatatcctttgcccactttttgatggggttgtttgtttttttcttgtaaatttgtttaagttcattatagattctggatattagccctttgtcagatggatagattgcaaaaattttctcccattctgtaggttacctgttcactctgatgataggttcttttgcagtgcagaagctctttagcttaattagattccatttgtcaatattggcttttgttgccattgcttttggtgttttagtcttgaagtctttgcccatgcctatgtcctgaatgaagcatataaaagttttgttttttaaacaggctaccaaaaaggtgaagaaaaaccttctgtagtatgattgtttcttcttatgtgatgttcacttacataacctggaaatcaaaccggatgaaaagagtacttgaattaatcagacagaggaagaatgtgcccaagattatgaatgtttcaattcagctacgtcaagaaaagccaagatacagtagaggaaaacatagcttttttaggcttttaagataaacctcttagtgtcagatcataacagtcgagttagaataggagaaaaaaagttataggagcagatgaaaaagttggagagagtcaccttctagccaagcaaaaagatacgctttttcaagtggagaaagaacagaagggaataatatatgacttgcaatcatgtacagtgaaggacagcagaatttgaacttctgaggtatacatttgagaagtttcaaaaagaaacagatttcagaattaagtatcaaaacctcttgcagttttactaagagaatgtcaatactttaagaaaagccctgttctacaataggagaccaaattttatagttttgtattagtgtctttttactatcaaagctcaatctttgggaagaccacatgtcattttatttttttatttttcaatttttatttatttatttattttgacacggagtctcgctgtgttgcccaggctggagtgcagtggcgcaatctcgactcactgcaggctccgcctccagggttcacgccattctcctgcctcagcctcctgagtagctgggactacaggcatgtgccgctacgcccggctaattttttgtatttttagtagagactgtgtttcacagtgttagccaggatggtcacgatctcctgaccttgtgatctgcctgcctgggcctcccaaagtgctgggattataggtgtgagccactgcgcccagtcccatatgtcattttattttaattatagccagcttgatcacatacaaaattccatttataaattccgttttcacaaaccctattacaatttcactcagaccattaatgacatgcttggactttctgctttgtcctgtatttcctttcttaaataaccattttattttaggatgaaaatttgccacataagattctttgtcatacaaaattattctatttctcaataaaggacacattttaatgcctatcttgtaattaaaaaaaatttttttaagagacagagtcttgctctgtcacccagactggagtgcagtggtgcaatcatagctcactataaccctgaactcctgggctcaagcagtcctcctgcctcagccaccccaattagctaggactacaggtgtgtgctaccacacttggctaatttttttttttttaatttttttagagttgggtctcactgtgttgttcaggctggccttgaacttctggcctcaggataccctccaacctcagcctcccaaagtgctaggattacaggcatgtgctaccacagccagcttgtatcaacaattttaaaaacaattaatttatcaaagatttacttaagtcacaagaactgaaaaaacatttgggttaattactacatattttatatgagcacttgtttacttaaactaatcagaataaatttttttagggatttctggctgactatatgagattttattatgtagacacagcatacaacatagtatatatatataatataagcatatctacacagatatacatacttataaataaattcttatggcttttgttttagagttttggtcatgaaatagtaaaacactcaccaatttataaaaaacagtaggatccagattatctttctgacaaaatggaataaggccaaacttaatgttcttttttaaaacaggcaatattataagggttgtgaactaaattttgagtaaagtagtttgagtcagttaccaataaactggattcgacacagaatagttaattgtggaaatatgactgaattatcttctaacaaggtctgttcagtattttattggtctcaattctttatccttgaagataaaagtgttgccattccttttactgtgggcaggctatctttacatgggaatttcatttttgcaaaggaaagagcatgaaggtcaaaatgattttctttaatatctgctggttttaagtgttttacttaaatggtcagtatgccagaatagttgaagagttttgaagaaagagtttagaaaaagataagaggaggcagagcgggaggggaaagctctagagaggaaagtgattcagctagctttgaggcagtgttttgtagtgagtcattctttgagtcctgaatccttttttttagcctcaaaatatcaatgagatacgcatatcttatttggagtatattattttctaactgtggtcttttagtttaaggaacaacagactgtttgaatgatccttacgatgtttgaacatgttaccggctggaatcccagaaaatatcttggcatgcctttgaattttgagagcccattttattgtgggtgctctggtttaatcccaaatacacaaaaaccaattaaatataagcactgaatttgcaaaggccaaataaacgcaagcacagatgggaaaataaagtacccacttaccaagaaggacgataagaagccttctccaactgaaagaaaaaagagagatcccaaggcctcaacccaaagggaaaaatcccttccctgagaccccacagccagggtctacaaggaggaaaagagtcttccttaataggagatccctcagccagatcagacgggaaggggaaagacaccatcccatccaaatcccagataaaacagaactcaaccaaaatcgggagttcagtccaagaatgactcactaagggaaaaagaggcaacttgcagaagccgttagaggagggggtgactttcagaggtccccagtgtggctaccttgtactatagttccaatggctgctgatcttctctgagatgagtcagccttagactcatacttgaccaagtatgtcaaagtcaaatgaaacacagagatgaatctctgaaattaagatgttttatttgtgaagaaagaattgcaatttagagcatgcatgcagacagaatggtatgtccgaagaacaaagagaaggttagaggttttatgaaaaagcgaaatgttatgtgttgctctttgagaaagttcattggcactagtaaggttctggagagcttgccagttttgattggtgagtgatggcagtgggtaaaattagccttagaatttcagcagatcatttcagtagccattagataaaactggtttccagtaatagcaggcagtttcggcagacatgcttgcagagaattacatttttgggtcaatgttatatgtcctgagtgcttcccccccgccctcttgactctgttttagttgggtatgacaggaataacccagttcatatgatcaactttcacagtagttaatgatataaataccttaatttatttcaccattcctctactgttggaaaaataggtttatagcaggtcatgctattgcatacattttccctctgtcttccttacaaacaatatctctattttattcagatagatgggattggggttgcagggagaagctttgatctcagggaaggaaggcccttatcccagccccagggaatgaattctgggtggtctgaactactcaagccaatcaatttcctgtcactaatgattggtctaggggtaaacactggattttcttttaaccagtaatatataaagggaactctgctgggtttttgtttgtttgtttgcttttggaaacactctttcttgatgaaaagactattgcaaggttgaagcttttggacccccattctaccatttcacttcatatgtggatgtgtgtactgtagcagccatgctgtgactatgaggaggtgacatgactaaggaggaaaagcagacctgtgaatcgctgatcacagaggtacagagggcttggtttcttggtgaagatgttgaactagtacaccaaacctggacatctcatctccagacttgatgtgttttttgttttgtttttttttttttttgggacggagtctcactctgttgcccaggctggagtacagtggcaccatctcggctcactgcagcctctgcctcccaggtttaagtgatcctcctgcctcaccctcccgagtagctgggattacaggcacccaccaccacgcctggctaatttttgtatttttagtagagatggggtttcaccatgttggccaggctagtctcaaactcctgacctcaggagatctgcctgcctcagccacccaaagtgctgggattacaggcatgagccaccgcgcccagcccagactttgtgttttatgaggtatttaaatatcttacacaacagcaaattggatttgatatcacttgtatttaaatggtacaaagttgtcttccaattatttccactctgcacattgctaaagttaacatctttttgaatatatctgtgatggcatttcagatacttagatcagattctcacacatgaagtaactgatcaaagagtagaacatttttaagacttctgccgctgataaaacaaaatagtaaagttttatttatctttgagacttttggtgttccctcttcatttgtacctattacaaaatgctggctgggcgccctggctcacaccggtaatcctagcactttgggaggccaaggagggtgggtcacctgaggtcaggagttcgagaccagcctggatgacatggtaaaaccctgtctctactaaaaatacaacaaattaaccaggcgtggtggcgtgtgcttgtagtcccagccactcaggaggctgaggcaggagaattgtgtgaaccctggtggcagaggttgcagtgagcctagattatgccactgcattctggcctaggtgactgagtgagactctgtctaaagagaaaaaaaaaataaaaacaaagtgcttcctcttcctctgtgagagaagaagctaaattttagtttctttaattgattttgtgagaaaagaaaagattaaagggaacattttcagcaaagatatactgtattaaaagcacagaagctgccaaagagaaaaatgttatcagatgagcaggtgatataaatgttattagatgaccaattgatgaacaggtattgacacatagaaatgattctggaggcagagtaaaaattctgttcacacagaagtaaaaagtaattgagtggttgaacagatctcttgataatcatgaccttgtaattgaattatacaagacaattgtacagttgcatcctgatgtataaaataaggaaataaaacttgaaattagaggccaagaagcacatcaccaaatgacattatactatgggtggattgtgcctttatatatctcgttacctcaaaaaggtgagttagaaggcacaaatgtatacccagataaatcaaaagatatattgtgttcttggttgggaaaggtaggtatagaaaagagaagtgcattctaaatttgtatattgatttaatataatttttccttggaatattttgtgaaaattgttatcttggtaatgaaatttaacccctcaaaagaataaagccacacaaggttatttatatgtgtctacatgtttaagctttatgattattttgcaatgcctgtttcaaaatgtgtatatgctttaatgcaacaattccatttttcagaacctatgctttagatgcactcataattacgtacaatgatgtttgaattgtttgtcacaatgattgaaagtttcttttggcatttgataaacaggcttcagggatacaaaataccctgcaatgtgtaggagacacctaaacaacaaagaatgaatgattctcagattgtcaacagtgcctgtgttagattctggggatctaacagggagatgcacaagcaaagtcctttactgtattttctagtgagagggacagcatcatgtatttgtttaccatccatgagaaccaaatcagaggaaggagctaaagcgggacaggagcagctaacttagatggagtgatcagggcaggttcttttgaagaggcaattgttgaacagaatgacctgtgggaacaagctgtgcatagatcaggggaactacattccaggcagaggcacaaccagtgtaaaagcttacaggcagaagcaagtctagggcagtccatgtatagtagtgaggctatcgaggctagacagaataatgagtaagggagagatggaagaggtgcagagagtggggcagatagatgatgtcaggcctagtaaaccatgtcagtgcatttgggttttattctgaatgtgctaggaagttattggaggaattttttttttttgagcaggggagtgacgtattcacatttatgttttaaaacaattactttggctgttagaaggtcagttgacttttggagcccaaaagcaggtgcagggagaccagtgaggatttaatctagtaatataggtaagagatgtcagtaattagattaggcatactgagaaacatttggattcaggatttcaaagtctttcctttttgaggaggtgggaaagtctcagttgaattgatcgagctcctcaggtcatggcacatttctcatcagtctttgcaaagtccctcttttttgttttattctttttgtgcttatctgtgatctctgagttccttactccctctccccagtatacacatgcttctactgtatttaatatatgattcagaatacatctaatgtatatatgaatgaatgattctcagattgtcaacagtgcctgtgttagattctagggatctaacatggagatgcacaagcaaagtcctttactgtattttctagtgagaggtacagcatatatatatataacaaatatatattatatataatagtgtatataatatataatatataataagtatatattacatataatatacaataagtatatattatatataagtatatattatatataagtatatattatatattatatataagtatatattatatattatatatataataagtatatattatatataagtatatattttatattatatatatagtaagtatatattatatacatacataacaaataaatatatatatattcaaataatttgagatggagtcttgctctgtttcccaggctggagtgcaatggcacgatctcagctcactgcaacctctgcctcccaggttcaagcaattctcctgcctcagcctctccagtaactgggattagaggcgcatgctaccacgcccagcaatttttttttgtatttttagtagagacgaggtttcaccatgttagccagggtggtctggatctcctgacctcgtgatctacccaccttggcctcccaaagtgctgggattataggcgtgagctgccgtgctgagccaatacatctaatatattaattttttaatgtatagagcttttacagataaaatattttaattttacataaatgatatggtgctgtccagtggtcttgaaatgttaacatacaccattattacctggaaagcttgtgcaaacagaggttgcaggaccctgaccctgtttctgactcatcaggcgtggggtggaacctggcaatctgtattctgtcgggttcccaggtgatgctgtttaccacactttgagatgaatgtgaccatactttgagaaccactgttgtagtgctatttatactgttgacttttttcacttaccactttttttatatttatatatattttattatactttaagttctagtgtacatgtgcacaacgtgcaggtttgttacatatgtatacatgtgccatgttggtgtgctgcacccattaactcgtcatttacattaggtatatctcctaatgctatgcctcccccctccccccaccccacaacaggccccagagtgtgatgttccccttcctgtgtccaagtgttctcattgttcaattcccacctatgagtgagaacatgcggtggttggtttttttgtccttgcgatagtttgctgagaatgatggtttccagcttcatccatgtccctacaaaggacatgaactcattattttttatggctatgtagtattccatggtgtatatgtgccacattttcttaatccagtctatcattgatggacatttggattggttccaagtctttgctattgcgaatagtgccgcaataaacatatgtgtgcatgtgtctttatagcagcatgacttataatcctttgggtatatatccagtaatgggataagatatatccaggttactactatacgtgcctctagttgattgctttctgcctgctgtatagaatttcacagtatttatgtatgacactttagttttctcttttgcttggtggacacctagtttacctccagtttctttctaacatgaacactgctatgatgaacaccctcatataaatctaccatgatttaatgtctctaggttttatgaacaaaatcggattgccaggagaaagggtgtatgcattcatacttgaactgagcattggttgccagatggctcttcagaatggctgtgcaagtctctattcctaccagcagcactgaagaattcctatttcctcacatccctccttccagaatatgattttatctcatattataatacttgccaatataatgggtataaagtagtattctactgttttaattaatgtttctctaattactgatgaaattaagcatctcatatgccagccattcagctcttgcactcactcttaggagtttcttatgtgacctttcagagataggttaaacatatacaagcatatttgcaaatctaatgagaaaatagtgtacttgtcactatacattgccctttaagtgctgctttatctgagtcccacagatttggacatgtattgctttcattatcattcagtattttatattttaagaattctctttaaccctaaaataatgaagtagtatgttttttctttccagtcatatgggatttttttagagctagtattttgttactgattattgatttgatgtaatttgattaaagaaaatgattggaataatactcattctttgaaatttattgagactccttgtggtatagtacagagtagatttttgtgattttcccatatattcttggaaagaacgtatattctctacttgttgagctattctttataactttgactatttttgtctgcttgaactatcagttactttcagcattgtgtcaaaatttccaactaccattacagtgtcatgcatcatttaataaggagggtacgttctgagaaatgggtgccgattttgctgttgtgaaatcatcatagagtgtacttacataaacctaggtggtatagcctgctacacacctaggctatatggtatagcctgttgctcccaggctacaaacctgtacagcatgttattgtgctgaatactgtaggcagttgtaacacaagggtaagtattgtgtgtctaaacatatctagatgtagaaaagatacagtaaaaaaaaaaagagaaaaaatggaatacctgtataaagtacttatcatgaatggattgtacaggactggaagttgctctgggtgaatcagtgaatgatgagtgaatgtgaaggcctaagacattgctgtatactaccagatgctttataaacactgtacacttgtgctatactaaatttattaaaaagtatttttccttcttcaataataaattagccttagcttattgtaactttttactttataagatttttaattttgagctgccatcttgcgtccccatgtgtgtgcacctaatctcagctggtggtccacccgagacccccaagcaccaaccctagccccccacgttggccccttatctgctctgagaagatgaaacaaacagttatgagccaggaaagacttgccaaactgcaggcacaagtgcgcattggtgggaaagaaatggttcacagaaagaagaaggcggttcatagaacagccacagcagatgataaaaaacttcagttctccttaaagaagttagaggtaaacaatgtctctggtattgaagaggtgaatatgtttacaaaccaaggaacagtgatccactttaacagcagagatgccagcaaactctttcaccattacaggccatgctgagacaaagcagctgatggaaatgctacccagcatcttaaaccagcttggtgcacactgtctgactagtttaaggagactggctgaagctctgcccaaacagtctgtgaatggaaaagcaccacttgctactggagaggatgacgatgaagttccagctcttgtggagaattttgatgaggcttccaagatggagaattttgatgaggcttccaagaatgaggcaaactgaattgagtcaacttctgaagataaaacttgaagaagttattgggagctgctattttatattatgactgctttttaagaaatttttgtttatggatctgataaaatctagatctctaatatttttaagcccaagctccttggacactgcagctcttttcagtttttgcttatatacaattcattctttgcagctaattaagctgaagaatcctgggaatcaagtttgaaacaaaggttaataaagttctttgcctagtataccaaaaaaaaaaaaagatttttaatttttttaactttttgactcttttgtaataccacttagcttacaagtggtattatgagtgaatgtgaaggcctaagacttatgcagctgtacaaaaatattttttccttatattcttattctataagctttattaaaacctttttttacttttaaaattttttggtaagaatgaagacacacacacacacatgcacgtgcgcacgcatctaggcctacagagggtcaggatcatcaatatcactgcctttcacctccacatcttgtcccactggaaggccttcaggggcagtaacagtcatggagctgtcatgtcgtataacagtgccttctgctagaatccctcctgaaggacctgcctggggatgttttacaatgagcctttttcttttgtaaatagaaggaacaaacttgaaagtaattattaaaagtatggtatagtaaatacataaaccagtaccatttattattatcaggtattatgtactgtacataattgtatgtgctatacttttatatgactggcagtgcagtaggtttttttacatcagcatcaccacaaacatgtaagtaatgcctgcatgtagacattatgatggctacatcactagggtgtaggaatttttcagttcattttaattttatgggaccattgtcctgtatgtggtgtgttgttgactatagcagcattatgtggtgcatgactatattgatttatctgtttctcaacataggcctctgtattagttctttttcatgctgctgataaagacatacccaaaattgggaacaaaaagaggtttaattggacttaacagatccgcatggctggggaggcctcagaatcatggcaggagacaaaaggcaaaaggtacttcttacatggcggtggcaagaatgaggaagaagcaaaagtggaaacccctgataaacccatcagatctcatgagactttttcactattacaagaatagcacaggaaagaccggcccccatgattcagttactgtcccctgggtgtgggaattctggtagctacaattcaagttgagatttggctggggacactgccaaaccatatcagcctctcagtttttgcttgtgttttgaggctgtgaaatatatacagaatatttcataagtggtgtatacaattgattatcatcattcatgcgttctgtatttgtggatatgcctatgtctccttgctaaaattgatttgtaaactcaaaatcaatacagtgcttttgtggtcactggtagacatgtggagagtgatctactactttgagtctcccaatgcacatgttgccacctcagaccaaataaggccacactctcccttcttgttttagctctcatgctttaaacaagtattcttttcatagtctatttagtgcctgaatgcctgctataggtaaccaatctcttcagtttctggtttatctttcctgcattttttatgtacaaagtagatacatacatatgaatttcatatatcttctttattatatagagggtggcatactacagctactcttgtactttttattttttttaagagacaagagtctcactccgtcacccaggttggagtgcagtggcacgatcatgatcatagctcactacagcctcaaactcctcgcctcaagggatcctcctgcctcagcctcctgaatagctgggactacaggcacgtgaccaccacatctggctaatttttaaatgttttgtagagatggggtcttgctgtattgcccaggttggtcttaaactcctggtctcaagcgatcctcctgccttggcctcctaaagcactgggattgcatttgtgagccattgtgcccagccatactttgcttttttcatctaaaaatatatcttggaaatcactctaaatcagtttatagagatctttctcatccttgtgctttattgtgtgagtgcatcatagcttagcgtctctcctgtgtatggtcatttaggttgttcctaatattttactattacacacatgctacagccttgtgcatatttattttcgtattgttggaagtgtatcttcagggtagattcctagaagtgggtcaaaagttaaatgaatgtgtagttttgtcagtttggccaaattgtttttttactatgcaaattatattattattattattattattgttattatttttgggatggagtttctctccaggctggagtgcaatggcgctatctcggcttacttcaacctctacctcccaggttcaagcgattcttctgcctcagcctcctgagtagctgggattacaggcacctgccaccaggcctagcaaatgtttgtatttttagtagagaagaggttttaccatgttggccaggctggtctcaagctcctgacttcaggtgatctgcctgcctctgcctcccaaagtgctgggattgcaggcgtgagccaccatgcctggcctattttcatttttgtgtggtcaaatttacccatcttttattttattgcctctggatttttagtcattagttacacagttcttacctacaccaaattttcacctacaccaggcttaagaagaactcactcatgttttcttctagaacttgtgtggctttttctttttacatttagattgctcatccttttgttgtttattgtgctttgtgtgagatgtggatctaactttatgtttttttttttaaatggcaaccacttgtcccagagccatttatttaaaagttcatcattattactgtgatttgagatgccacctttattatttaccaaatttttgtaggtacttttatactatatctgtagtataaaattccactggtatgtttatctacataaggaccagtaccactgttttgattatagacattttatagtatgttttaacatctggtagggatagtctgccctcatagtgtctctttttagtgttttcctggttattctttcttgcatgttcatttttccatgttaattttagtgtcaacttgtctaactccataaaatagcttgtttgtatttttcttggaatttcatgacttataagttaaattagggagaactgtaatcttttttttttttttttttttttttttttttgagacagagtctcgctctgtcacccaggctggagtgcagcggtatgatcttggctcactgcaacctctgcctcccaggttccagtgattcttttgcctcagcctcccaggcagctgggattgcaggcacttgccactacgcccagctaatttttgtatttttagtgagacggggtttcaccatattggccaggctggtctcgaactcctgaccttaggtgatccacctgcctcggcctccccaagtgctagtattacaggtgtaagccattgtgcccggctgagaactgtaatcttttcatgttgatttattctatctaagaacaagggatgtctttccattatttcatgtctacttttatgtcttatagggacatttaaattttttccttgtatggattttgcacatttcttgttaaatttattcctgtgtctttaggcctctttgttgctgttacaaatggggatttctccaccgtgatgttctgttgattttttctgtataaaaggtctatttttgtttgtttgttttgagacagagtttcgctcttgttgcccagactggagtgcagtggcatgatcttggcttatggcaacctccgcttcccgggttcaagcgattctcatgcctcagcctcccgagtagctggggttacaggcatgtgccaccacacccagctaattttgtatttttagtagacgcggggtttctccattttggtcagggtagtctcgaactcccgacctccggtgatctgcccgccttggcctcccaaagtgctgagattacaggtatgagccactgcacctggccctattttttttttttttaaagatggagtctccctatgttgcccaggttagccttgaactcctaggctcaagtgagccccctgccttagcctcctgagtagctggaaccatatgtgtgccgctgtgccccagggctattgattttgtatgttaattttatatcctgctagtttactgaattattttattatttgagttagttttatcattgattttggggggttatatctgcaaatagagatagttttattttttctttacccattcttaaccctctaattgaggtgtaatcccattggctgatacccttacaccagttttgaacagtagcagagatagtaaatattcttgccttgttcctggtcttagtgaaaatgccgttagtgttttggaattaagtaaaatacaggttttacgactaatatatatgtgtgagtggctgagagagttctagatatttagatagaacatgggaacagagattagagagagatttctatgaaggcttgtcaaattctagggcaataagtatatcacattcaaaaggtttcatttttcaatttgggagtaacaatgagatatgccattacagcaagtcatttgaattatataaattgtgtttatgcattataatggtcacaaagaaaattttatgcttgaatttgtcttgtagtgtgtgctgtatttatggagtttaaagattaatcatcccaaaacattgtttctgcttcggggaaatcatgaatgcaggcatcttacagactatttcaccttcaaacaggaatgtaagtataatcactcctctagaacctttttagttaccctttaacctgtccgaagtaaatcaaacagaaagaaaaaagaaactaatagaatttaaatgcttcctgtcctgttgttatttttttcacctgcaaagaactaagattctatcttctaaaacatttattttgaaaataacttttgggttcccccttgtttataaaataaataattcgggatatttggaaagcacagagaagtctaaagaagataaaagtgtccataatcaggttgcagtgagccaagatcacgccactctactccagcctgggcgacaaagcaagattccatctcaaaaaataaaataaaataaaagtgtccataatcatgccacttagaggtaatcactgttatcacactatttgaaatatggtcttccattcttttttattattatgaaatagttcaggtatacatatatctgtatatattttacaaataaaattgggctcatatgtactgtttaatacatttctgtttcacctaatgtagtagcattttttccatatcattaagtatttttgacaacatggtttgtaagtgttattttagtttttttaaagtattccatcttacgaacacacaatcatatatgtagccaatttagtaacaatcataggatatttaggttgtttctaactgtgactactgctgtaatagtaaaaataagtttaatataaaagtagaattattggccgggtgcggtggctcacgcctgcaatcccagcactttgggaggccaaggcaggtggaacacaaggtcaggagttcaagaccagcctggccaacatgatgaaacccctgtctctactcaaaatacaaaaattagccgggtgtggtcgtgcgtgcctgtaatcccagctactcaggacgctgaggcaggagaatggcttgaacccgggagatggaggttgtggtgagatcctgccactgtactccagcctgggcaacagagcgagactccgactcaaaaaaaaaagaaatagaattattttgaaagtcaaaacaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcaacagagcaagactccgtctcaaaaaaaaaaagaaaaaaaaaagaaagtcaaaacattactagctgattttaaaaaacagataacatggtgggaggctgaggctagacgatcccttcagcccaggagttctacaccagccttggcaatacagcgagactccatctcaaaaaaacaaactcgtagatttccttgactagcatctagtactcataattggctgctcactaacaaacagtatgatgctgactatgttggggatgtttgggagatcctgccccagggcatttgcatttttagttcttcttttcccagatctctatctgcgtataagacatacattctatttcattcatgtcatttattccgagattttctcctctagttgcttttctaaatcataatctcatcattttaccctcataccctgtttcttttcatagtgtttatcaacacctgagatttatgtgtatttatttgttgactgtctttctctgccaccagaatgtaagctccatgctagcaggggtgtgttttgttcactgttgttttccccaacacccacaacagtattagttgctcatagaagttgcttagtaaatattggttgagttcatttgaatgaatgagcatctgtgatttgtatgtttagaacacactcttgaaaaagaatttctgggttagggggcaggcacattttaaagacttttggcatactctaaagtagtcttccagaaaatatgtatattgggttatacgccaaaaaaattttttatttttgtgatgaaagtactgaaataaaagcaaaattttacctgttttgacttctaaaattttagcatattctctataaaataaggaagctaaactaaatatcttgggtcccatctggctctaaaatctaccccttttaacgaatcctgaatatataaatatactttagtgttcatatggttgatattttgatcatggatttcattttgtatccagatttttctgcagattattatcttagaaaaatatattataaaatatttaaacttttattccaaaaataattttcaaagttaaaaaaacttttacatttgttttcagagactcaaagtttattaatctgccacagatccctttactgataggtagattgctatttatagtgtttcatatgctcatatgaattcttgctaccagtatcttcttacattggagatagtagttgtaatgaaaacatccctcctagtagagcctcaaagaaaaggtctttgttattaaaagaaattttagaggataatcacttcttaaaaagtccctctgtcaaaagtcagctgcaagagggcaagatacaaatccttccagcccttggtgacttactggaataaacactttaaatcagcagctaattaccaggaagttttaaatctactgttggtggatgtttaaattggtgtaagttgagcatggtggctcatgcctgtaatcccagtacttttggaggctcaggtgagtggatcacttgagcccaagagttcaagaccagcctggtcaacatgttgaaatcccatctctacaaaataaaacacaaaaaattagctgtgcatagaggcacttacctatagtcccagctactcaggaggctgattgaggtgggaggatcacctgagctcaggagtttgtggctatagtgagttgtgatcaccactacactccagcctgggagacatagtgagaccctgtctcaacaacaacaacaacaacaacaaagatgtgaggtatttgaagagcaattttgtaatatatttataaattttaagtgcatgtccccttgatctagcaatttcatttgtaggaatttattatgcagattgtgttactttttaaatgctgcataaaaaattatcacaaatttagtggctaaaaagaacacatttattatctcatagttattgtaggtcagaagtccaggccacagtgtggctagattctctgtataggatctcactgaaatcaaggtgttgccagggtttcagttctcatctggggcttagggtctttatccaaggtcacttgttggcagtccttgtaactgtaggattaaggtccctgttgtcctgttagttgttgaccagggatgactcttagcttccagatactgcttgcagttcggtaacatgtcgccaccagtggtagttcccaatatgaatgtttgcttttttccaggccagcctgaatgcatctctctgaccttctcttctgtgatcagctagctggaaaaaaaccctcactcagtttttaaaaggctcaccttaggtcaggcatggtggctcatgcctgtaatttcagcactttgggatgccaaaggggagaggatcacttgaggccaggagttcaagaccagcctgggcaacatagtgagacctcctctctgccaaaaagaaaattaaaaaactagaattcagtcagcctgcatggtggtacaagcctgtagtcccggccagttaagaagctgagactgaaggatagattgagcctgggtgtttgagattacagtgggctatgattgtgccactgcactctagcctgggtgacagagtgagaccctgtccctaaaaataaataaataagtaaataaatgttcacctgattagatcaggccctcccaagataatctttcttttgccatataatgggacaaaataatgggagtctcatcatacttacagttttcatccactgaaagaggagtggattatacatacaaagatgtaggtcaatgcaggtcattttagaattcgtctaccacacagatatactcacaaaaagatagtaaaatatggatgcttaaggatgttcactgcagtgttaattgtaacaacaacaacaacaacaaaaaggtaatctaaatgtcaacaagacagtgatgaaataagtgataatatgcttttgaacaatggaatgctaggcagctattgaaagaccaaggtggccgggtgcagtggctcatgctcataatcctacactttgggaggccgagatgggggcattgcttgagcccaggagttcgagactaacatgggcaacacagtagtaagactctctctctacaaaaaatttaaaaattagctgagtgtggtggcatgtgcctatagttgcagctacttgggaggctgaggcaggaggattgcatgagcccaggaattcaaggctgcagtcagctatgatcaccacactccagcctgggtgacagagcaagactctgtctccaaaaacaaaagacaggcagaccaaggtagacccataatatgtactgatatggagagatgctaagatattttataaggcatttgcagagcatgtaaatggtcatctcctttgtaaattaaaaatatataatgtacagaagaaatcattaacagtgggaggttgggttaggaggacttagagggtttttttgttttgtttttgttttgtttttgtttttttagatgcagtgttgacatgttgcccaggctaatctcaaactcatgcaatcctccagccttagcctcctaaatagctgggactataagtgcatgccatcgcgcatggcttacttttaattttatatcctctctagtattgtttgaattattttttaccaccactatgtactacttttataattattattatttttcaaattggtaatttaaaaattacccagttggggcccaagcatttgaaaagctttgtaagcacccaaggtagttcagctgtgtgctgctggttaagaacgacggctctggagtctttaggaagcttctactatctgtcgtttgggaaccacttcaccaaatacaaaaatgggaaatattttattttatattatttttctaaaccaaattttagggtattccttaacaccttcatttcttacctgggaaaattaaataatgtgtataagttaacaaatgccctggaatgtaatactcgataaaagctaattttatgaattaggagtagatacgtagtgaagaaagctgcctatggctgcctttgttttgaattaagtttcagagggttttttaggtgacatttttcttaattattcttttgtcttatcagattttttttatttttaatttttatgggtatatagtaggtgtatctatttatggaatacatgagatattttgatacagggatgcaatgtgtaataataacatcagggatttttttgacagactatttttagaagatggaacaataggtcctggaaacattttaagtatctccttttgcccagaatttcttaccttaggtttttatttgcttttcacatgatttaactgtagttaaacctgatggctttctttttctcctatctaccaagatattccttcttttttattataatgctgcatctgaaatgtaaataaatcttggaacaagcacacagattcaagtataagtttaaaattttattcttgtataaggagagagcatgtgtgttgctctgcatgggtgtttttactgataagctgatctctcttcagtggccactgtggcttttagaactagcatcttatcattaataagggaggcttagtttcagattgtgcagctgtaatcttgttcatgtttttaagagggaggtgggtgaaggcttttcttgtatcaatcttaaattgctttataatgcagagattttttaaaaaatattcctttctttatggaaaagtaataatgtttttttttaaattgatgtataatagttgtacgtatttttgaggtacatgtgatatttttactatatgtatacaatgtataattattatcaagtcagggtaactgcagtatccatcgcctcaaacatttattttttctttgtctaacagttaaacaaaatttatttttttaagagacagggtctcattctgttgtccaggcttgagtacaattgtgtaatcatagctcactgcaactttgaactcctgggcttaagtgattctcttgcctcagcttcccgagtagctgggactgtaggtgtgtgccaccatgcctggctaatttttaaattttttgtagagactgagtctcgcctatgttgccaaggctgaacttgaactccccaaaggatccttccgccttagcctcccagagtgctgagattacagatgtgagctgccatgcctagcccctaacagttaatttttgacatatcatttgtttttgcaaaaatatttcttcattgttatgtacttagaaagcaagaaacatagtgcctgcctccctccctccttccctccctccctccctccctcccttctttccttccttccgtcttgctctgttccctaggttggaacacactggtaaaatcattgcttactacagcctcaacctcccaggctcaagtggtccctacacctcagcctcctgagtagctgggactacaggcacgagctctcatgcccagcctatttttatgtttttatgtatttatttatttattttctttgaaggaacctcgtgtttatattattccacaaatactctgggtgcaacctcatagctctggatcagagtttctaaagtaaatgaatttcttatttccacgaacctattttttttttttttttttttgatagggagtctcgcttcgtcacccaggctggagtgcagtggcacaatctcggctcactgcaacctccgcctcccaagttcaagtgattctcctgcttcagcctcctgagtagctgggattacaggcacgcaccaccacgcctggctaatttttatatttttagtagagacagggtttcactatgttggtcaggctggtctcaaactcctgacctcgtgatccacctgcctcggcctcccaaagtgctgggattacaggcgtgagccaccatgcccggcccttccatgaaccatttttttaaatgtatagttaaatagcttactgacaagttccagaaactcctgtaattttactaatgaaagcagtattgttatgacaactggattttttaaaaaaataaatactgtttgtcattgctcattgcagcattttttagagtagcaaaagattgatctaattagattgtggtatatccataaagcgaaatactaggtaaatgttaaaaaaattacaaagctctcctgtaggggaggcaaaattttacctttactctcagggtttttcagctgggcctgagaattaaattgacatgagataaattaataggagaagagcatataaatttatttaatataagttctacatgacataggagccgctataaggaaatgaagatccagagactcagagttgaacacttacatgctgaatcggacaaaaagtagtaagttgtgaaaaagtaactaaatgatgtgaggaggctagaagataagagttatttgaattcagtctcaactattaatccttggtgataacaatgttattttccttctagtacagggagggcatcttttcttttttttttttaacttttattttaggttcaggggtacatgtgcaggtttgttatataggcaaacttgtgtcataggggtttgctatacagattattttgtcacccaggcactaagcctagtacccagtagttattttttctgatcctctccctcctcctaccctccatttttaagtaagtctcagtgtctgttgttctgggagggcatctttcaaatgggaatttcatctcctgcttttaaaaagcagcatgagccaggcactgtggcacgtgcctgtaatcacagctacttgggaggctgaagtgggaagatcgcttgagcccaagagtttgagaccatcctgggcatgtaacaagaccccatttcaaaaaaaaagaagaaacagcatgaaggccagagtgatcttcttgtacgtgtggtttttcaagtgcctttaactcaaagttgtcagtgtgccagagtggtgtattttggggtggcatattcttaactccactcttcatctgaagatgtggcatgatagccaaaatacgttcttaagtacgaaaagcaagtaaagaacagtacatatatgctatcatttatgtaaaaaccaaaaggatgttttggaaagagaagaaacatatatgtctgcatgtgtatgcatagaacatctttgtaaagacacccaggaaactggtaatattggttacctgcagagagagggcaggaggcacattatacccttttgtggcttctaaaatttgagctatgttggggccaggcacagtggctcacgcctgtaatcccagcactttgggaggccgaggcgggcagatcacaaggccaggagattgagaccatcctggcgaacacagtgaaaccccgtctctactaaaaataaaaaaaaattagccgggtgtggtggtgggtgcctgtagtcccagctactcgggaggctgaggctggaggatggtgtgatcccgggaggcggagcttgcagtgagccgagattgtgccactgcactccagtctctcaaataaataaattaattaattaattaattaaattaaataaataaaaaataaaaaatttgagctatgtctcacgcctgtaatcccagcacattgggaggctgaggtgggaggatctcttgaggccaggagttctaggttgcagtaagctatgataatgccactgcattccagcctgggtgacagaatgagaccctgtctcaaacaataataataaaaaataaataaagcaaataaaaattgaaacaaatatatcatcagtgactagaccagattgtgatttcttgcaagtagtgctgactctcaaaattgctttcagataattttgttgaaaattttgttttgttaatgttgtattattgatactagttagaacttgtatcagtgtcatcctgtggctgtaatgcattttcccttcactatagaaataactgttttatgggatatatcctaaaatttgtcttgaaaataaagcaattgaatcagctaatttaacctctgggaattatgtatttggctatttagattctcctattcaaaatcttatttaaaaataatgattaggaggaatattagagggtcattaagagcatgaacaggtttaagtctcagttctgccagttacttgcttgcagctttgggcaggtaagcctaatttcctcagtttttaaatgaagacagtaataatacctacttcacagggtttctgtgagtattaaatactttcatcagttaacacagtatgtactaagtgccagcattattctgcatattttacataaatgaattcatttaatcctcacagcaaccctgaatctactgtttagggtgttattattattatgaccatagataaggaaaccaaggcacagagagttaaaatttttatccaaggtcccatagctagtatgtggagggggctgcagttcttcaaatcaggcaacaagttccagactccattctcttcaccaccatgccatgccaaatgcttaactcactgacagacacatcatgagccttcaatacatttaaataataaaggtaatataggccaggtacaagtgcagtacctcatgcctgtaatcccagcactttgggaggctggggcaggaggattgcttgaggccaggaattgaagaccaacctgggcagcatatcgagaccctgtctctacaagtaatttttaaaaattagctgggtgtggtggtgtgcgcttgtagtcccagctacttagaagattagacaggaggaccacttgatcctaggagcttgaggttacagtgagctatgattgcactactgcactccagcctaggcaacagtaagatcctgtctctaaaaaaatttttttaaaaggtggtataataataaatgttattatataaagattacatattcatcataaaaaagaaagaacagctaaactaagaaaaatatagataccattgtcagtctaacccctcagaaaattaaatactggtaattatatatgcaattcatatactttgaaaaaataaacatggtgatatttcatagcctattttattcacatattaatataacatgaacttctttttgcttaatttttgacctcctgttttaatttacaaaatgacaatacacttccttacttgtccagacttggcattcttttttggaagtaggctaaggaattattttgagtcattcttgggattgaaaggcatttatcaatgtaagatgttatggagcataaattaataagtaattgaaattcctacctctattcaagtgtggaactcccatggaggaattccttactgacactggcaacagagggaactctggttcctaggattttcaggagaaaaagtcaatcactgaccacaaattaaagagttttctgtttgttttttacttccaacagactttatggccaatgctggatctactttgaaatgggcaaaatttaaaacaaagcagagtataaggatgtaactgtaaggagaggcaatgatgcataagacatggttcttgtgaactttgagctcctaataaagttagcatatgttgtggaatagattatgctgactgctacaacagcaatacaaaatgttctgaaaacctcaaagaaacccacaggctcccttaatgaactcaaaccctaatcacccagtattggcgttaaagagaaatcttcacactcagggatggaaggccttacaacctcaagcgtggtctactggtttacactttccttagggatctctctcttaatcattcctgccacccatatagtactgcagtctggcccaaatctggacccatcattcttcactttattccccaaaaccttgccaggaccaggctctgatccttaaatatgtctttctaaaggcttagagatcacaaaaaggaaataaacacagaaataattaccaactagatagtctgactcactcgatacagctttggtctcttggtcctgtaggccacctcatcttcccagaatcctggaagaggagaaggagctcacggttctgcagggttgcctgactatatttctcgtcttctctacccacacacatccctgagcacagcttgactttttgaaaccaaggccaaggaagaagaaaatgttcctttttctctttaaacacccattttccagtttcccacctattatttcatgacttttcctttccagagatttgtagagactcctccttccacccactgatgtatttccttattctgtagccccaagttgacagccacatcaaaatataatttattaagccaaacatttattttttattgtttagagacagaggctcactctgttgctcaggctggagtgcagtgacactatcgtagttcactgcagcctcaaactcctgggctcaatctatcctcccacctcagcctcccaagtagcttggacagcaggtgtgtgccaccacagccagctaattttgtttttcaattttctgtaaaaacgaggccttggccaggcgcagtggctcacgcctgtaatcccagcactttgggaggccaaggcaggcggattgcggggtcaggagtttgagaccagcctggccaacatggtgaaaccccgtccctactaaaaatacaaaaattagccgggcgtggtggcgtgtgcctgtagtcccagctacttgggaggctgaggcagaagaattgcaagaacccggaaggcagagctgcagtgagctaagatcccgctactgcactccagcctgggggacagagcaagactccgtctcaaaaaaaaaaaaaaaaaaagaggcctcactgtgttgcccaggctggtctcaaactcctggcctcaagcaatcccccgacctcagccttccaaaacattgggattacaggcgtgagccaccacaccagtttaagccaaatgtttttagagaaaatagaatcaagacataatttgtttacagaccttaaaaattatgagcaaaaacattattgacattttattgatgtctcttaagactccagtttccacttatatatcttcaacacccctaagagatctttaagacccaataaaatattcagactcacaagactaccatggaccctagttgtcatccatatacttaaaaggatataggtcaggaagggcagcactgggcattccttttcagtggagtggtcctcacaggagtgcataccgcagtccagcagctttccatctctcttgccccctcccatcttctcaccagctcaggtacaaggaaatatccacagtgggaagattagggagccatcctggtatagaagcctcgtgcatcaaaaatgtcaatgtgtgttgtaaaactaccttcagaggagcccaaagctatagcttcccaccaggtaactgggtaatttttaccacaagccatgttgcctaataacacagtggacagtcaccttatcacatttccaagcaacagagctggaaagttaatccaaggtcacacttgtctttaagaggagagaggtattgttaacctattatccacaacttttcaaaagtatctttacaaagataattgtgctttcaaatcatctaaaataaatggctctaaagtagcttcatattctcctggcctatatcctttttcaaatgtgatacgttttagttcttccattgactggttttccttttttgttaggtcgaatcaaatattcggaacaggtgtatgatgcctgtatggagacatttgactgtcttcctcttgctgccctcttaaaccagcagtttctctgtgtacatggaggaatgtcacctgaaattacttctttagatgacattaggaaagtaagtaatcttttattattctcacagggaatatttttaaaatgtgttgggtttttttgttgttgttgtttgctttgagacagagtctctctctttcacccgggctgaagtacagtggtgctatctcagctcactgcaacctccgcctccctggttcagcctcccgagtagctggatacaggtgcacaccaccacacctggctaatttttgtatttttagtagagacggggtttcaccatgttggccaggctggtcttgaactcctgacctcaactgatctgcccactttggcctcccaaagtgctgggattacaggtgtgagccaccgcacgcctggcctaaaatttgtttcttattgcagtcaaccaatatatctttagctgaaatctttaaaatatagataatgaaaagtaagaaaatggaagttacctctgatttcatcactataactactgttaacattttgatatgtacctaccacaaattataatttttaatgagctctatgtttttaccaactagaaagctaacattcttgtagtatagtcctgaaactttgaattatatcgcagtgcaaaaggaaggaaaccagggttctaatcacagtcctgccattaactgtgtaaccttaaccaagttattgaacctcttagtcacatttcttctctatgaaatgaggaagttggaagggatggtctgaggacactgccagctccgaaatgcattggctttgacattttagatgataacggtttcattgttttacttgccttccttggtgattattatttccaagattctgtatcttcattatggaaaaagatgaccaatttttattgtacatggttgtcttatcttctctacctttgaattcttctacctgtctctctgtcttttttaatcaaagtgatagatactcatcctctcttacaggtactgagactaaaaatttttctgtttataaaactattttctctgaagaaagtctcctcagggtaagagggtgtacctatatgtactggctttcctcttgccttactgtcttttaagtaaccagcatttctcttttacatagtaaaatatgaattttataattctgaatcaattgtatcaataaaaagctctttcacgcagtagaaattctcttcttggcattcagctattctattacttgttttctcttggtttttatgctttcaactaaagcagcagtgactaaaggcttaagttaataactcatattgaaatacctcaactgcatagactggaaaggataaatgcccttacaaaattagcattctttaaaataaagaaatctccactggaatgaggtttgcaatgaacagaaccattgtaaaacatttctgctgtcatggtaacattggctcacctagacaaataaaattaattttatatagtcatagtctttctaaaatagtatatctctatagtggttgatttcacatttgaattaaattagcactgctttacgattaggatgtaagagggtcttttactacagtatggttagatgacagggatgtttataaaaatttattgcagaccgggcgcggtggttcacgcctgtaatcccagcactttgggaggccgaggagggcggatcacctgaggtcaggagttcgagaccagcctgaccaacatggagaaaccccatctctactaaaaatacaaaattagccgggtgtggtggcacatgcctgtaatcccagctactagggagggtgaggcaggagaatcgcttgaacctgggaggcggagtttgcggtgagccgagatcgtgccattgcactccagcctgggcaataagaacgaaactccgtctcaaaaaaaaaaaaaatttatttcagaaaaataataaaaattatgtatctaaaattgttaagtgttccttttcttgcaggaaagtcctttaggggcacactggcttctctcctaatacattcttgtgggtgaaaggggtttttctttgacacatactagtttccaagaagccttttgctctcctgatttttttcttttggcttttgtgtgtcttctagttagacaggtttacggaacctcccgcctttggacctgtgtgtgacctgctttggtctgatccctcagaggattatggcaatgagaagaccttggagcactatacccacaacactgtccgagggtgctcttatttctacaggtaagctagtccttgaggtcgaaaattatgaaaggaaactgtaattcattttatcagatgatttttcagcattttatatttcaaatctatgtagtataagcactcctgtttaatttttcgattaataggaggcaagaaacttgtttgtttgttggctttttatattttcttaggtatatatcctaagaagtgtaatacaccaaacatgattggacatcctgcagtgctctgatatttttgtctgactctaagtgatctagactatttgttcctaaacattatctatacacttttttaaaaaaaattaaagctttcttggctctttccccagagattctaatacactaggtctgagaggaatcctattgtattttcaaaagctctccaaattttgtaaccactagtatagactaagatataaaaagaacaggacattgtgaactaagcccagtacatttcctggaagttggctgttgttttaaatttcacaggagctttcattatgattagacactcaaaaataggaagacaggcagggcgtggtggctcacgcctataatcccagctctttggggtgcctaggcgggcggatcacttaaggccaggagttcgagaccagcctggccaacatggcaaaaccccatctctgctaaaaataaaaaaattagccagatgtggtggcaacacgcctgtaatcccagctaattgggagacttcaggcaagagaatcacttgaacctgggaggtgtaggttgcagtgagccaagattgtgccactacacaccaacctgtgcaacagagcaagactctgtctccaaaaaaaaaaaaaaaaaaaaaaaggaagacataagagaagttggaaatctaaattatttttaatcccagtattttattgtggcaaataatacatatgtttatttccctaaaaatctctgttaattggctaagataatgtgttcattagaatacacacatgcacacacacatgaaactttgatttcgccattacttttagcattcttctaaacaacctttttttctttaaaaaaatattttttaaaatttttgtgggtacatagtaggtatatatatttatgggttatatgagatattttgatatagtcatacaatgtataataatcacatcaaggtaaatgagttatccatcacctcaagcatttatcctttgtgttacaaacaatccaattattactcttttatttattttattttttgttgttttttttttcacctttttttttttttttccttttttgagacggagtcttgctcggtcacccaggctggtgtgatctcagctcaccgcatcctccacttcccaggttcaagcaattctcctgcctcagcctcctgagtactgggattacaggcacctaccaccatgcctggctaatttttgtgttttttagagatggggtttcaccatgttggccaggctagtttggaactcctaacctcaagtgatccacccacctcagcctcccaaagtgctgggattacaggcatgagccactgtggccggcctcttctagttattttaaaatttacaattaaattattattcactatagtcaccctgttgtttaaatctcacagtatcaaatactaggtcttattcattctttctgactgtttttttcgacccattaactatcccatttcccctcttactacccttcccagcctctggtaaccatcattctactctcatctccatgagttcagttgttttaatttttagctcctacaaataagtgagaacgtgtgaagtttgtcttcctgtgcctggcttatttcagttaacataatgacctccagttccattcatgttgttgcaaatgacaggatctcattcttttcaatggctgaataatattccactgtgtatatgtaccacattttctttgtcctttcatctgttaatagacacttaggttgcttccaaatcttggctattgtgaacagtgctgcaataaacatgaaagtgcagatgtctcttcaatatactgatttcctttcttttatatacatacatagtagtgagattgctgaattacatggtagttctgtttttagtttttttgaggaactccaaactgttctccatagtagtgtactaaacattcccaccaataggatatgagggttcccttttctcgacatcctcaccagcatttgtcattgcctgtcttttggataaaagtcattttaactgggtgagatgatatctcattgaagttttgatttgcatttctctgatgatcggtgatattgaataccttttcatatacctgtttgccattttatgtctccttttaagaaatgtctattcagatattttgctcatttttaaattggattattggatttttcctattgaattgtttgagctccttacatattctggttattaatctcttgtcagatggatagtaaaaagtctttttttctttcttcttcatttattttattttatttatattttattttattttgagacaaggtctctctttgttacccgggctggagtgcagtggcaccataacagctcactacagcctcaaccttctggactcaagcagtcctcttgcctcagcctcctgagtagctggaactatgggcatgtgccaccatgcccagctgctttttttattttctgtagaaacaaggtcttggctgttttgcccaggctggtcttgaagtcctagactcaagtgaccctccctacttggcctcccaaagtgctgggattacagggatgagccccacccagccaacaaccatttttcattcctccatgccaacttttccagtgactaatgtgatgaaatcatttaacttttatttctttttacattgcttaaaataaagagcataatacatattcattgttgtcagaatagaaattggtacaatttctgtggacatcaacttggcaatatctttcaaaggtatttgtacatggcctttgatccagaaattctacttctaaaacttaatcctgtagatatataattgattctcattacttgtggatttcatatttgtgaattcccccacttactaagatgtatttgtaacacccaaatcagtacttacagaggtttcataatcattcatgggaatgtagtgtgcaatgcaacaaaaaatttgagtcacctcactcacatgttcctagctgaggttgaacaaaatgatgccctaccttctttttgcagccctcatattgtaaacaggcattcttttgagttttatttagtgaaagatgttttatgtttttgtgcttttcatgagtgatttcactgtttagaatggccaccaagtgtagtgctgaagtgctgctgtctagggtccctaagcacaaaaaggctgtggtatgtcttacagagaaaatatgcgagtgttagatataagctttgtttaggcatgagttatggtggttttggccatgagttcaatgttaatgaatcaacagtgtaaatgacctaaagtattattacacagaaacacatctgaaacaaggttatatattaattggtgggtgaaaatgttatgaccggagcctcacaggaacttcaccctgtatttcccttagcagtagtgtttcattatttgctaattctgtttttgcagcaacattatagaatgtagctactgggaataatgagataaaaaatttgactcacccagcacacatgttcccagctgaggctgaacaaagtgatactctgccttcttttatcccagggataaatcccatttagccacagtatataatacttttagtatgttgttgagtttggctttctagtgttttatggaggatttaaaaatctatgttcatcagagatactcacctgtacttttctttcttctggtgtctttggctttggtatcagagtgatgctggcctcataatgtgagtttggaagaattctctcttctattttttggaaggtttaagaaagattggtattaattcttttttttaatgattaatagaattcacccatgaaaccatctggtcctgtgcttttctttgttgagagctgtttgattactgattccatctccatatttgctattggtctgtttgggctttctatttcttcatgattcagttttggcaggttgtatatttccagactctatccatttcttctgggttttccagtgttttggtgtgtgattattcgtaatagtccgttatgatcccttttatttctgaggcatctattgtaatgtctcctctttcattttttgttttatttatttgagtatctctttttttcttagtcttgctaagggtttgtcaattttgtttagtttttcaaaaaccaactcttagttttgttgacttttttctgttgtttttctattctctatttgattcatttctgccctaaactttcctttcttctgcttactttgggcttatttgattctcctttttctagtttcttgaagtgtaaaataaggttgtttaattcagatcttttttgttttttaaatcggcatttattactataaactttcctgtaggtactgcttttgctgcatcccatacattttgatatgtatatttttgttttcatttatcttgaggtttttttttttttagataggatgttttgctctgtcacccaggctcaatgcagtggcacaatgatacctcactgcaaccttgaactcctgggctcaagcagtcctcctgcctcagcctcctgagtagctgggactacaggatgtaccgccatgcccagctaattgtttttaaaatttttagaggagatgaggtcttgctgtgttgcttaggctggtctcgaactcctgacctatctagagataattttaaaattcctttttgatttcctctttgacacaatagttgttcaaaagtgtggtgtgtagtttctatgtatttgtgaattttcctgttttcttaagttattgatttctagtttcattccattatggtgggaaaagatacttaggacgatttacatcttcttaagtttgttgatacttctttgtgattatatagcctaaagaatattctgtgtacacttgggaagaattctattcttctgttatttggcaaaaagttttgtatatgcgtattaggtccattgggttcatagtgttgttcagttctgttgtttgcttattgatttctgactggatgatttatccattacagagaatgatgtattgaagttacttgctattattattattattttgagatggagtctcgctctgtcgcccaggctggagtatagtggcgcgacctcggctcactgcaacctccgcttcctgggttcaagcaattctcctgcctcagcctcccaagtagctgggattacaggcatgcaccatcacgcccagctaatttttgtatttttagtagagacggagtttcaccatgttggccaggctggtttcgaactcctgacctcaggtgatccacccacctcagcctcccaaagtgctgggattacaggtgtgagccactgtgcccgtcctacttgctattattttattactgtcaatgtttgccttcagatctgttgttgctttatatatttaggtgctttgatgttgggcacatatatatttataattgttacatctttctgttgtattgacccttttatcattatataatgacttttgttccctcttgtgatgatttctgacttaaagtttattttgtctgataaaagtttagccactcatgttctcttccggttacttacttgcatggaatacctttctctacccttttactttcagcttatgtgtgtctttaaatctaaagtgagtcttttgtagacagcatgtagttgggtcttgttttcatccattcactcatactatatcttttgatttgagagttaaagtaatgattgataggtaaggacttactattaccattttgttggttgctttctgttttgtggttctactattcctctctttttctctttgtgatttgatttttatttttgtagtggggtattttggttctttttatcttttgtgtatctactgtgcttttttgttcatcgggtttgcatcaaacattttatagttatagcactctgtcttacgctgagaagaaattactttcaatgacgtatagaaactctacactttagtccccattcacacacctaatgtaattaatttcaggttttactttatttttgagacagggtcttgctctgtcacctaggctggagtgcagtggtgcgatcttggctcactgcagcctctgcctcccgggttcaagtgattctcctacctcagcctcctgagtagctgggactacaggcacacaccaccacacctggctaattttttatatttttagtagagatggggtttcaccatgttggccaggctggtctctaactcctggcctcaagtgatctgccttcctcagcttcccagagtgctgggattacaggcacgagccactgtggccagctgcatcttttagtttctacttgaacttcctttagttgctctcataaggctggtgtagtcatgacaaactccagtttttgtttgtctggaaaagtctttatctctccttcattcttaaagggcaattttgatgagtaaagtattcctggttggcaggtttttttttctttcttttagtactttgaatatattatctcccgctttcctggcctgcaaggtttcagctgagaaattcactgatagtcttatagaagcttccttgtatattatatgacaagtaggttttctcttgctgctttcagattttttctttttgagttttaacaacttaattataatgagtcttggtgtttaacttatttggagacctttgggcttcatgaattgaaatgtcccttttcctccctagatttgttaaactgttagcctttagtttttaaaaataagaagctttctgcccctttttcttctccttaactcccatatgcctgtattattttcacttgatgttgtcccataagtcctgtatactttccacattcttttttattcttttttctttttgtccctctaatgctatcatttcaaatgacctgtcttttaagtttcccagttcttttcttctgcctgagtctgctgttgaagctgtctcttgagcttttcagttgagtcattgtattcttcagctccaggatttctatttgcttcttttttatggtttctgtttctttattaaacatctctctttattcatttatttgctttcctgattttgtttagttgtagttcattgagcttctttaagatgattattttggattctttgtcatgcaattcatacatctctatttatttagggccagttactagaggtttattagtttcctttggtggtgtcatttttgcctggttctttataattcatatagccttgcaatggagtctatgcatttgaaggagcaggggccttccagtttttatggactcgttcgccaagtaaataccttctcctattgagtccctgggttgatgggattgcctgtggtattgtgattaagcagggctgaagctagattatggggctacattagggttcacagtcagtgggcgtaccactaggggcatggacaagtatgtcccatggatggggagagctgtctctggaactcaatagggtgggacccaagctgggtcccaggctggtttgggtttatgtttgggtccaatcagcagcccttttaccagaggaatggacaggcatgatttccacaaggcccctgttaaggcaggacttcctcttggccacagtagagcagggctggagccaggtcagagtgctgctttgagtctgcagttgggtctggttggtggatctgttactaggggcatcaacagacatggttccttcccaggatggatgaggctggtggtaggactgcagacaagtgggactggagccgggtttacaagggacaggctgattctgggtctgtagctgaaaggtcagtgggcctgccttctccaagcagcccttcctagtcttgggctccaccaaggtttcataaccacctacctcaatcctaaggttcttacaatggcacttatggccatggatggcttccaaactattgtttctgtaggaggaccagggctggggacattctcttttgctatcttgcttacgtcacctacaacctactttaaaagtaaatttgttctaatgagcataatgagaaacaaagattttaaaaataaactaaataattaatgcctaagtaattccaggttaattttgtatactccagttcttcctatcaggtatttgtcattcagagaggtaatagtatgaaaagaatattttaggagtatatgagaatattgtatctttttttagaatatggttggctaaaatatttacatctgctcctaaaatattcctgcataagcttgcagtgagccgagattgcaccactgcactccagcctgggcgacagagcaagactccgtctcaaaaaaaaaaacaaacctatatatatacatatatatgtatatatgtattcctgcataatattatcttggtgtttatattacctgtgaagctgtaagtatattcttttatttctgtaacaatttgacaattgaagaaaagtatgtgttgaatttttagcatctactacacacacacgcacacacacacacacacacacactactgttgtactttgtaatatcaagacactgataaaagttttggtgttgtattgttatggattaagacaaaaaaattaaaagatgagatggaggagctctttctattgtaggattatctattgttttcatgtttgatctgtagtgaagtatattagtgaaatagagaaacagaatgatgagtactaagctattcataaaatttcagtagtgtgtaatacttgtagttttgaaacaaaatcagctaatatcaccttgacttttccccatcttcctattaaaaaaaattgttttaattctggatttatgttttctaattttcttttccagttaccctgcagtttgtgaatttttgcagaacaataatttactatcaattatcagagcccatgaagcccaagatgctgggtaagttacattaaaattgtaccaaatatcgctgcagagtctttgcatttaatatgcagacagatggactttcatctctttttcaggtatcgaatgtacaggaagagccaagccacaggctttccatcacttattacaattttctctgcccccaattacctagatgtctataacaataaaggtaaaggaatccagcaatatttgagtttgaatttatgagtaaacgtgagctctggtttaattgtatgtacgtatgtgtgtttgtgtcattttaaaacataaattttaaataagaaaaaaaggggtcttagttgaaacaaaggccaagaaatttagaatttatgctgctgcttggtctttatctcctaaggattactggcttctttgtgagtataaataatgatcataataggtcagattgatactacagaatcaaagtataagaagaataaattgcttcaggctcatgccagaatagttagcataaattattggttttggtgaatttaatgtgtttataacagtatctcaaagtcaccattggtattttaatctttgtgaattattaaactatttttgtttttcttgagatatggtctaggtagagtgacctagtgtacaaagtcaaaaaaaaaccttcatttttagtttaaaccctgccagaaacgaatactgtgactttgagtgagtcacattatctttctaatcttcagtttcccatatgaaaaaagaagaatggatatatacatgccttttgttccagaaattttacttctaagactttatcctgttaaagtcttttttttaatttaaaacttttatgattaatagtttataagttttctatcgaggcagtggtcctactaaaaacttcatatttctgtaactattttgttgtttataaagtatgactataaattaataggactttgaaaataaacatgccagaacaaacatatccaaatgagtattgtcccttcaaagtagttaccttgggaggctacacacctattccaacaatgctgtccttgttcaaaaacatttttggaactcctcttttggcattgccttcagagtctgcgacacattcttttgattatcctcaatgatgggaaatcttcgtcctttgagggtggatttgatttttggacagccaaaagtcattcggagtcaagactgataaataaggtgagtgatcaagctagatgataccatttggggtcagaaacaaggtatgattataaggtaatgagactggtttttctcgtgttgctgatacagtggctctggaggcacttccaaaagaggagttccaaaaacgttttgagtaatggcagcatctctggattaattatatggtaaggcaacaagttgtgctgaaaagaacacaaagcaaggagtcagtctagtcctgcttcacttttaagtgtgtcacatttaacaagatacttctctgagcctcatctttaaaatatctgtcatatggggttgttgaagataagttggaataaggaaaatggatattaaagtgttgttcaaaatataaattactataataatacagattttactgttattgtacctgatgtgataatatcaaaggaccacactcatctgataaaaaggtctggtgtgtttgtagctggtggtttcttaagtctcattactttatagttataccttgtatatgcagttggggagataagtttcaaagatggccaaaatataattaatatttactctatttaaaagtaaaccatggaatggcacatctcatttaaatccgatttgggtcagtcattttagtgtgtcctccagtgacttgtctattttaaaaagcatgtctttaacttaagttctgtcctagtcttatgttttcatttaacttagcattcttctctgagccttatctgtcctacaatgctctgcttctccctaagttcatttgttatttcctttttcctgatatttccagtatattagcaacttaggttttattcttatttattctcttatcaatggtgtggactgtttgtgttgttaaacgtcttcaaggactcttgtggccctagatctcctatttgtaatgaaggtgtttctttctcactttcttttttaacttcatcaaaaagagtatctattgattgctcaatggatttatcagtgtgccaagctgaaacacgccacctaagtcagcaggcactatacagctcactcactgctagcttgttttttgtctcaatctaacctggttttgttcttgattatttctttagcaaacttttaacatcacagtcctggccaggcacagtggctcatgcctgtaatctcagcactttgggaggccaaggggaggatcacttgaggcctagaattcaagaccagcctgggcagcaaaatgtgaccccatctttacaaagaaaaatttaaaagttagccaggcaaggtggagcatgcctatagtcctagctactcaggaggctgaggcagtaggatcctttgagtccagtagttcgaggctgcagtgagctgtgatcacaccactgcattccagccaggcaatagagcaagaccctgtctaaaaaataaaaaaaaaagtaaaagccacagttcattctacctgagtattctgtcggctttgacataattagtaacttttatctcaaaacagtcttattttcattggttgtttcttaagcattttagaaggaaaaaggcagaaaatgtggcatttgaaacagtccctgggggtactcagttactccccatacaagtgccttcttttctgaaaaagggaactctattattctttttcttcttccttttcttctactgttgctcttctttctctttctctcttttcttttctctctctttctctctctctttcttttctttctttttctttctgcttccttttcttctttctttctttctttctttctttctttctttctttctttctctctctctctctttctttctctctctctctctttctctcggtctctgtcacttaggttggagcacagtggcaggaacttgattcactgcagcctcgacttcctgggctcaagtgatcctcccacctcagcctcccaactagctgggaccacaggtgcatgccgctacacctggctaattttaaaatattttttatagagatagggtctcgttatgttgcccagactggtctcaaactcctgagcttaagcagtcctcctgcctcggcctcccaaagtgctggtattacaagtgtgtgccaccacacctggcctctttcatattattttttttttttcagagacagagtctcactgtgttgcccaggctggagtgcagtggtgcggtcttggctcactacaacctctgcctcccgggttcaagcaattctcccgcctcagcctcccgagtagctgggactacaggtgcacgtcgccacgcctggctaattttttttattttagtagagacggggttttaccatgttgcccaggctggtctcaatctcctgagctcaggcaatctgcccacctcggcctcccaaagtgctaggagtgctctttcatattctttagacttcttggtatctacaggtatttcctagttccactagttacacgaaagacctttaatcatgatttttaaagattcttattcttgttttcttctgtccactgggaacacacccaaaagcagttttataagctcttgtttccagtcattcactgttgagactcacctcccacttctttttcctgggtagaaattgagggagttgttgaataatgatatatgacatatttacctaaactaaataaaatacatacacgtgaaaataatggaacatgtacatcatagccagtgttaggctttttaagtgctagaaactatattttaatttattttcttaataatatatggtgtacattttagacattcaataacttaaattttaagaacactagattatcctgtagcaaagaaacaggaatgaggacgtgacctatatctgtcatttctggagaactgttacaccctgttttattttatgaccacagaataattaagagaatagtgcaaacaacattgctggtgataaaggctaaggaattggattttaagactttcaaaatataaagaaaatcagtttggcatcaaagtatgtgtgcgactatctgaatggttaatattaaacatagcatgctggcaatacactgctgtgtattggagaaatcggcaattttaaaatccgctatattgaatacagagatgacttaatctaattttgaacatttaattgtaaattgctccaagtttgccatttgtatcttccagtatgagttgataactgcaatatataaactcccagagagtgtatacaatctttgactctggctaatgactagcaaaacaggctgtgtccatttaatgagtaatttttgccttcaaaggagagttgtaattataaccatttggcctataaaaggaaattatggggaaattttcctcacgtggatcttgaggtttatatagatagttactgtgcagtgactccaaagtttcagtttcttttgtacttttattatatgagctcttcaggtaactttgttccttggaataattcttaagagaatgaactgaataaaaggctttaaaattttccatctgccctttacctagtcaagtcctgactttacaaatggaaagttctcgaattctgtgtagcaggtacacagctgtacaaagcataccacttgccatgccatgttcctctgtgccagattttcttgcttttttcctttttagctgctgtgttgaaatatgaaaacaatgtcatgaatatcaggcagtttaactgttctccacacccctactggcttccaaactttatggatgttttcacatggtctttgccttttgttggggaaaaaggtaagagaactaaagcacatgtctcatcagttgtttggtgactgagcataccttatatttgcatgagcccctccatgattcagaaatgttttctaattttgtttgttctctacatagattttttttttttttttctgagatggagtctcgctctgtcacccaggctggagtgcagtggcacgatctcagctaactacaacctccgcctcccaggttcaagcaattctcctgcctcagccttctgaggagctgggattataggcacgtgccactgcacccggctaatttttgcattttagtagagacagggtttcaccatattggccaggctggtctcaaactcctgaccttaagtgatccgccctcctcagcctcccaaagtgctgggattacaggtgtgagccaccgtgcccagcctctacatagatttgtaaatggcatgtaattggttcttaaattttaatatattatggtttttttattgtaaatatcaatttaaagtagctgacctactatgatcaagatgttaaaataacatagttacttgtcattccctcagatttcttcagtactgaagagatttaaacagaatttattgtccttacaattttatttgtacagctactcaaattagctaagcctgttggacgtaggcctgttggcttaactttgtaaagtgggaaaaaaattttctcacgtgtgtatcagtgtgggaagaagctctgaacagcaatccggtaaaatcaagtaattaggcaatagatcttcaaagactccagacttttactggagcaagtaatctacccaaattctttttaaacctgaaagtttacatttatgctactttttatagctattcttactaacataatgataaataatttttgcttatgcttacttaacatgtgtgtttatttagatatccacattattttagagaaagtacctcattaatcgcgtaaattttggattattttgtcttacttagtcacagagatgctggtaaatgtgctcaacatatgctctgatgacgaactgatttctgatgatgaagcagaaggtaaacttttcctcctttgaactaaaactagaaagaggtttggttttggttttagttgttttagtttattttgaatgattttctttgtcttattaaaaataaagttagttcattgtagaaaaataaaatttgaaaaatacgagaaaccataaataaggaaaaaaagtcacccataatcccatcatcttatagatatccacagttaacatcttaatgtatactgtgttaattgtcttttatctttgcacatagctttcctctgtagtacactatttttgtggagtttctttgtagactagtttctaatggatctgtagttgtccatgttgatcagtgttgtaactaatcccggtggtgttggttattggagtttttcccaagtttttgctgacaaaacccatatagttttgaacatttgtttagataaaaatgtgcacattctcttaaccaatatttattacatgcttgatatataccaagtactgtattgtttaggtccttgctctcaataagcttatttgctagtgtagggaggaaaaacagtaaataaatatgtcagatgaaaggaagtaaagcaatattagaaaatcaggaataacacttcttgattatttccataggatgaatttgtagaaattgaatatctgtgtcaattagtacttaaaattacaattctgatacagatagaaatttctgatacagcctctagaaaggctgtaccactttacattttgcaggatgcatagtcacagtgctgtctccaatactgtttatgatacttgttatagtctggtgttactaagtttttaattaaatttttagtttatatttttatgagactaatggacaattttttcttgtgtttgttggcaatgtttatctctcttttgtgacttgtcaattcatatcttctatcctttttttgagacagagtgttgttctgtcacccaggctggagtgcagtggcgcgatctctgctcactgcaaccttcacctcccgagttcaagcgattctcctgccttagcctcacgagtagctgggattataggcgcgtgccaccatgaccagctaatttttgtatttttagtatagatggggtttcgccatgttgcccaggctagtctggaactcctgagctcaaagtggtctgcctgcctcggtctcccaaagagctgggattaacaagcatgagccaccatgcccagccccattttgatttttttcttattggtgtgtgagggatctttttatacagtaacattttattatatatgtagccaagtactttttttcctagtgtgctgtgggaggtttgattataaaggtaggtcctgacttgtctgacaatgcaagagattctggaaaagtggtggtcatccaagcacaaaccggcctcatcctatccaggctctgtgctaaggtggttcccttaactgtgaggataaaccatctccatcgtggagaaaacacaactccctttgggaatctagaggaaattaccatacactctcatgcttcaggttctgcactcatgcttcaggttccgcactgaagatcaacagcatatgcaagatagcttgcgagtgtttttatttatggtataggagatgactacaaggaaccagttcttcttgaggaaatagtgcagccaagtgaaaaacaaaagaaaaaccgaatatccccctgggcaacatggtgaaaccccatctctactaaaaatgcagaaatcaaccagatgtgatggcgagtgcttctggtcccagctacttgggggcctgaggtgggaggattacttgaacctgggaggcagaggttgcaatgagcggagatcttgccactacactctagcctggccaacagagggagaccctgtctcaaacaaacaaacagaaacacatatatttcctattctttcccaccacaaacataaaaataaataaataaataaataaataaataaaaaggaagaatgggccgggcatagtggctcacgcctgtaatctcagcactttgggaggctgaggcaggtggatcatgaggtcaggagatcgacaccatgctggccaacatggtgaaaccccatctctactaaaaatacaaaaattagctggggtgtggtggcacacacctgtagtcccagctactcgggaggctgaggcaggagaattgcttgaacctgagaggcggaggttgcagtgagccaagatcgcactactgcactccagcctggcgacagagcgagactcatctcaaaaaaaaaaaaaaaaaaaaaaaaaaggaagaacaattatatcccctgaaagagaagctatagaatccattaaacaaaaaaacatactattcctgtgaagagatttgtaaactgttctgtcctccgtttttgttccttgtttttggcatcatttattctgcaaataatatctttgtttaatgttattttcatgatctgtggggttagaaaatattggatgctcatagatgtgaattaatgtaaaaccataaacttttaagaaatggaagaaactactgacaaaataaatttgcaatttaatgttgtatcatgattccaaggatatctcttatgagctggtaaagataatagcctgtttctctcattgcatttcactttgatttttttttctcttttccatgtaaacataaatttctcttctcatatttctgtcttcatctccttgtttcttggtgtttcttctccctgaagatcactacattccaagctatcagaaaggtatccgactaaactgtgctaagagcttaatgcttactctctgtcccaccatagtctattggttagacttaaaattggtagttgaataatttcagaaaggctctccatccgccccttcagttttaatgtatatgttttctctggacctgttgcgtgatctggcagggtgctgagggttggatgtgaggaaggagaggccatgtttctttttctgacttttgactgtagtcacctggtgcatgctggaccttggcttctcatgtgtgggctattttcagaatcttagataagaaaaagccataaagtcttaagttaactttttctgttgttgctttttaaaatagtgcacagttgtaagtagtatcgtgaggcaataactcactaatataagtgaagcttatagaatgaaagcagccctcactaagttcaggagagctagctgggtgttgtgtttacatacagaagacagctgctggaatgatcacttgccatttggcaggccgaaccctgcaccctaaggtggcccacagcattatcaaaagacatctttgctgtagcagctttctttgtgaggtttgtttatgtatgtgtgtgttttattctttgctgtgctctacgtttcacaaccacaaataagttcctacctctcatagatccacccagtctgtcttttttgtggcctctcattttttacttcatctttttatcttctgagtcattttttctcttgctccttagaacttcctgagatttttgtttgtttaaacaaacttaagccttcatttctgttttttaaaaacaattgtttctttaacttaagacacttcatcctgaattttttaaaggcagcctattaacacatccctttaacttacttattctttgtattctctaaggaagcactacagttcgtaaggagatcatcaggaataagatcagagccattgggaagatggcacgggtcttttcaattcttcggtaaggatgtctgtcattacagtgcggattaaaggcattttgagagtaaattagacgtcgaattcagaacagtttttttataattggaatgtagtattgaaactgcaggtctttaggttgagtgcaaattcaatgaacatgtttaagcgactaaaaatgttccagcaaacattgatttgttagtagcttagatgtagtgaatgtagtggtttagtgtggactttccaacccgattgcctgtgttcaaattctggctctacctcttcttacctgtgtgatcttgggtttcatctctgtgccttagtttccttgcctgtaaagtaataataggccctagcgcacaggttgttaggtgtattaaatgggatacaatatgggaaatgttagaacagtgcctggctgttaaacacttctaattgaaaaacaagaactggctgattgtttaaaatgaaaatatttgtggaaaacatccctttctttgagtcagggaaggcgtaggaggtaggagaacctatcttccatctctgctgtctttcttcacttccttcaatatctttaagttgctgaatggagagttctcgggcattaacccagggtttggtctccctttgcaggcaagaaagtgagagtgtgctgactctcaagggcctgactcccacaggcacactccctctgggcgtcctctcaggaggcaagcagactatcgagacaggtgagtatgagagtgctcctccatggaaggtgtgctcccgttacctaacagtcagcacacacttacaaatgggggctttcctcagaaaatgccacgagagcagttggttataccataagcggggaaatgaatcttcacccctacttccctccatacagaaaacctaaatcagaatggcttattataacttcagtgtaaaaagcaaaacagtaaaacaagaagaaagtatggagagtagacactggggtagacagagtccttaagtaggacacaaaaagtactaaccttaaaaagccagttgaatttcattaaaataaagaacttctcttcttaaaaatacatgattaagagaggaaaaaggcaagacacaaaatggaagaaaattttttgcaatacacgtctcacaaagcccttgtatccagaatatataaagaactataaatcaataggaaaaaacaaatttcaaaaatggtcaaaagatttaaacaggcacttcacaaatgaggatatcaaagtggccaataggcctggcacagtggctcacgcctgtaatcccagcactttgggaggccgaggcgggcggatcacctgaggtcaggagttcgagaccagcctggccaacatggtgaaactccgtctctactaaaaatagaaaaattagccaggtgtggtggtgggcacctgtgatcccagctactcggttgcctgagacaggagaattgcttgaatccgggaggcggaggttgcagtgaaccgagatcgcgccactgcactccagcctgggcgacagagtgagactccatctcaaaaaaaaccaaagtgaccaataaacatatgaaaagatcttaatattattatagtttttcatctaggaaatagatattaaaaccacactgagggccgggagcggtggctcacgcctgtaatcccagcactttgggaggctgaggcaggcagatctcttgaggccacgagttcaagaacagcctggccaatacagcaaaaccccacctctactaaaaatacaaaaattagctgagcatggtggcatactcctgtaatcctagctactcaggaggctgaagcactagaatcactggaacccgggaggtggaggttgcagcgagccaagatcacaccactgcactccagcccggatcacagaccaagactgtttcaaaaaaaaaaaaaaaaacaaacaccacagtgaggtaccattacatacccactagaatggctaaaaattaaaagtttgggccagggcatggtgacttacacctgttatcccagcactttgggaggctgaggtgggaggatcacttgaggccaggagtttgaggctgtagtaagttatgattgtgccactgcactccagtctgggcaacagggcgagaccctgtctccaaaaaaaaaaaaaagagtctgacaataccaagtattggtgtgtttgtggagaactagtactaggtatgttgctaaagggcttgtaaattgattcaagcgctttagaaaactactgggcagtaaagctaaacatatgtctaccctgtaacccagcagttccacacctggtgtatatccaagagaaactggatgtgttcaccaaaggttatgcatgggaatgttcactgtagctttattcataatagctcaaagctggaaacaacccagatgtccatcagtagcagactacataaataaattgtattccgaaatataaataaataaactgtattctatttatacaatggaataatactcagcaataaaaaataacacattatggacacatgctacaacatggttgaatctcatagacattacagaaaactgcaaaagccagacataaaagagcacagactgtctgatttatataatatttaagaaccattggactaatcagtgataataaagtcagaatgtcacttcctctggtgggagaatattgtcccagaagggcacagggaacatctagagtgttaggaatgttctgtatcattatcatggtggtagttagacatgcgtatacttatgtaagaatgtgttgagctgtacacttcagatttgtgcacctgctgtgcctcgtgtatattttgtaccttaaagaaaacagtttgagggggttgcagtttctcaatcagagagggagtttgcctctttccctgcagccatattctattccagtgccaaaatcacctcttcaatcagagtaccaattctgaaatttacccaggagctgacttcttaggaaagggctttctggaatcccggaatgaaaaggttgatgttcgtgagaataaacatgcaaggggaagagacaggagatcatattactgggtgactaacactaggtatgaaaattggtattgaagcattaatatcttaaactaaagtttaactgctttttttgctccccttgttttgttgaattgtttctatttagtttttttcccacctcatcgttcatctggccttttttctttttctttttttttcccaagagacagagttgcccaggctagaatgtaatggctaggtactgtcatagctcatggcagcgcccggttgctgggctccagcaatccccctgcctcagctactcgagtggctgggactacaggcatgtgccactgtgcctggccatcctgccatttataggagtcctttttcttttgtagaaatttcattgctattgactaacagggacaaacccattttttttcttttcttggagacagagtcttggtctgttgcccacgctggagtgcagtggcacgatcttgcctcactgcaatctccgcctcccaggttcaagcaattctcctgcctcagcctcccaagtagttggaactacaggcgtacaccgccatgcccggataattttttatattttagtagagatggggtttcaccatgttgcccaggctggtctcgaactcctgaggtcaggcaatatgcccgcctcagcctcccaaagtgctaggattacaggcgtgagccaccgtgcccagcccttttttctttttataagattgaattcctccttctctttcaaatagaatactgagatattagagttcagctatttagaaggaagtctgaacattttctctttggaagtatagtttattttcctagttcctttagtttcacagaaagtatcagtaaactatttccgattgaatatttttctcaaataaatgtgcagttttttgtgagcagaatatgttcccaccattgctttgcttggtaattagtcatctgagatattccgagagcaactctgacaacaaagatagagtaataggcagtaacatgagttaagagaaaaaaaggaatgtcctatagcatccttaggtaaacattatgaaaatttgctgatccacaaaattgttttaattgaaaccaactttgtctaaaccttgagaaagcaaatctgcaaatcagggctgagcaacagaattatatagctatgttatttggaaatttgtttctaattcttggtcaccttttgggctcagccccaaagtatgagttgaatatgagtgttttaatcaagataggaccattgattgatacttccaaagttgatagaaatcttcagtaatgtgtgagaacaaaggtaaagttggagccaactttttagagtttcttattcttattgattcacaggaagtgagtttattttgttattttcacattggagtctcagttccaccagctcattggctaactggagcattaactaaaaaagaccttttattgttcatataacttaacttggagagctttcaaccaacagtatcccatatggccatgtaacatacattcatgtatgtctcaccttgatctaagagggattggcgtgagttacagtatacatgaaacatagtggagtaaaataaatatgcttggaaattgaagcacaaaggtaaataaaaataaagccaatagccacaaatttgactctaagcatcccagtagccaaaatagtggggaaagccaaggacaggacaagattcacaaagaccatcagattaaaacagatcagttataaattggactacatcaaaattaaaaactctgtactgcaaatggtactatcaagaaaatgaaaagacatcccacagaatggttgaaaatgttttcaaatcatatatctcctaagagattggtatctagaaaatatactcttacaactgaataagaagacaacccagttaaaaatgggtaaagaattgaattgacatttttcccatgaagacatacaaatggcacatgaaatgatgtttgacatcattagacattcagaaaatgctaatcaaaaccacaatgggataccacttcacagtcagtaggatggctgtgaaaagacagcagttaataaggagtgttgatgagaatgtggagaaattgggaccttcttaacactgctggtggaaatgtaaaatggtacagctgctttggaaaacattctgacaggtcttcaaatgattaaacatagaattgacttattactcagcaattccagtcatagctacataccccacaaagaaatgaaaatatgtcctcgcaaaaacttgtacacaaatgttcataaatggcattcaacataatagccaaaaagcagaaaaaagcaattgtccataaactggataaacaaaatgtggtaaacgcaatggaatactattcagccataaaaaggaattaaatgcaggtatacatgtcaacatgactgaaccttgaaaacattatgctaagtgaaagaagtcagtcactacagaccacatattatatgatgccactcatttgaaatgtccagaacagaccaatctagagagaaagtagattcgtgttcaaccaggattaaggggaagaggtgagggaaggaaatgggaagtgagtgctaataagtgggggatttctcattggggcaatgaaaatattctaagcacagattgtggtgatggttgcacagctctactatattaaaaccattgacttgtatactttaaacaagtgagttttgtggtatatgaattctatttcagttaagatgttaaaaaggaaaacaaaagttcgggtcatttgatatgactgtttcttataatggcccttactgcaggctgctatctttatacccaatgtgaatagcaattctgggagggccccaaacaaggtaatatcatacacattttaccgtgtagcttttaagctctaattagaccaacactcagtgtagagtttcagcaatgctttgttctcccacttcctaacagttacatcagtgatgtgctgtgagaaggcactgtagctttcttgtcaagggtatttgttctacttaaggagattagagagggtgtgacagtgatttaatacatgcctgcctatggttgacaaatgaaagcacttcataagtagatttcagttatccatttttcacattccattaggtagttaatgtagttctttcagtttctcttctcatattgatatataaagccttgggaatagcagcaaactgttactgctcattattcttcactgccttcttttggcaaattggtactggagtaactgacagggttctcctaataggatctttcttgtggcaccctgtaccttttcatatattagcgtttttactgtctgagaaaggagatgcaaggaagtttacctgttggtactaatttttaagttgcttccttttccattgctaagaaagaagagggctttcttagttactggccaactctcttgaacactgtatggaagccatatggattggaaacattagcctctgctatatttttatagcagatgggtacacacatttgcattaggaattcaatagttctatgcttttgttagctttgtactccactcctggacaagaaataacccttcacatggaacctatttttctctccttccaaatgccagtctgctgttcaaaggccactcttttttttttaaatgaagtaattaatagggcagttggactccaaataagtcacttgagagcagtaagatgtagttgtaaataagctttttgaataggacccagcagtagctcatttaatatcacctgagatattttacaaactaaggattgttgtgatgtcaaactatttgattctacatgttgtttcgatacgtggatatcaagatataaagtagcagttggctacctaaaatgaaaagagcaatgttccatggcacctgaaatgttaaaaatattagaaactctccccaccccatattcctcccaccccaattgagtctctcgcaataatcttctcgcttctctaactagttgactttcattatggatggggataggctaaaaaacgggcccctgggatggctgtgctgccatcagtgctgttggtttactcactctttttctgtcttcgtttttgcatgctactgctcctgccctcttacagccacagtagaagcggtagaggcccgggaaggtatggccatattactctgatagatgtgatccatgtgtctgtgtactggtttttcgaagctttatcaacatttcaaatattttattattgcatcaccagaactataacagtgagaaaaggtatagttgtttctaggcatgttaacgaagcaggtgtttcctttgtgtcctatctttgcattaattttaaataaccttcaccacagctacagttttttttctgggctctatcagctttaatgcaacggcagaagcttaagcaactggtcatgagaggtcaagtggtttacttctgtatcccttccatgtacaagagacatccatttgattctcaagagagccaaataggtcagcctcttcagcgattctaaaagatttcaagagcagaggcagaagtagactggaatttagttcaattcatttctgaggttgccctaaggtaggcaagttaaattaactttgtttctatgaaaaccattggaactgataaacttgtattatacttgtaattgttttattaggtaagatggttcaaaatgcgaatgccttaacttggtgttataaaagttgaatcggaaggaaaatatgtagaagctatttttaagtttttaacttatgtacagctcctggttgtgcaagatagaaagctgtcctaaacgaaaagattagctcttttgttacttttttttgtggtctatgtggcctttgtgcgaaaagcaactaccctgggtttaacttgttcaattattctagtgttgcctttgttctagcattgagtatgtttctggtgcataagacactctttcttaaaggtactggggcccagtaagtacttgttagctttttgttaggtatatgtctaccatgattatgcatatagagcttttatgaaaattactttcacaatttcagctgccctttgggctttaaggaagcagtagctgcagccaagactgattcagtcagacattgcccatgactttcactagacgtgtgctccatagccacctttctgtgtgtttctctaggaggttgctgtgtgctaagaaactttttttaagcctgttgctttgctgcctaattgagctctctccacctgcttcctgtttttctgtagccatcagagggttctcgcttcagcacaagatccggagttttgaagaagcgcgaggtctggaccgaattaatgagcgaatgccaccccgaaaggatagcatacacgctggtgggccaatgaaatctgtaacctcagcacactcacatgctgcgcacaggagcgaccaagggaagaaagcccattcatgacttagagtcctgccgtggctcaggtggatctaaaactcaagaacaaattctatttatttattattggaaaatgaaaagcaactcaaaacaacttcaacgtggaggtgcatttataattcagtctgcatttattctgtaaaaaggtggctgttttataaattcttttaatttatgttcaatatatataaaaagtgcatctgttttgtttttcccttttttctccataattttaagaaatgaatctgattgttgtcaacacatttgtgaagtcttgtgctataaaggggaacttcccctaataaaagggccttggaaacctcaaacctgggtttctgacttgaactagtcagtcttcattattgttttttggaaggtaatgtctttcatgtaagactaataacgtttcaaatgcaagaagattttttccttttcatttttttccttttctgctgggtgccattgaagaaagtcctcttagatttcagtggctaaaagtgcttcccttttgatgggaaactggatcatagtagaacttcaaagtgaataacccaaatccagtgattttaagggcgaagggaaatgttttctataataacctactttctctggactctcagttcgtttaaatatgttctagtaaacaaaataaaaaataataagggatgttcttagatttacttaaaatgtgttcatctgaccatgggcatgattggtttaaatttccttaggactttggaggagaaagattttcagaaagctttcacaattgccagattattttactttcatttttgaaccccaggtgacttctgtaaaggaagtcactttctaaatatttgataaatgccctcagcagcaccttctacaacaagatgtatatatgcccttctaggctgttggcatcagctctcgcatgtgccttcccatcatccttctgttgttccctgtcagtattactgaaaccagctggggtagtagaaactgacaagagttcaatggtccccttgtgaattgaaggtcttgctaaagaacattggataagtgaggatttcctgtcttctatatcagttactctttaggttgaatggtatttcagccttcattagcatattttggaatgcgaaaagcaagtgttcagatgtagtgtgtgaattatcttcccttagtttgattttcaagtcacaaccaactagtgaaggaaattttggggctacttaggctcccattttaactagcctcatcgcaggagccgtgtcataatagtcattggtcagctctgcagtgaatgtacatgcctgggaacattacatcagagcatggaacgtgcacatttatggcattccttagtgtcatttgtgatgcggcagtctagcactaaagcaagtatttcagacagtaatacttcatattgggagtttccaggaaaccagaaaaacaaagaacaacataattttggtggtgtttttttttttccccaaaaaaccatacttctcattagaagaatgaagacttagcccatctatctctgttttcctatacctttttttctaacagtttctgatttgtttatggcagaaatcaaggcactcttagggaatggaatctgcctgcatagattgctccattaataaaaagataggaaggagataaaggatctctgaatgggttgtgagtaaaacctgtgaaagaaggggggaaaagtctctagtaactgtcttttcctgattgttgttgaactcaaatcgggtattaagcacctagatatccttatgctcctttcttttccaatcccaggattagaaaagatcctgtctttggaaatttcactgatgaaagtcattccatgtgacagactgcagagctgctagtaccttatcccttttctccttttcattaaggctgttacatatatacaatccacaggtagaaaccactcttaggggcctccataagcaggcagtagtagaaatagttactgtaaatccttataagcaaaaaataatattttattacggatgattatttaggaatggcttcactattgtctcaaaaagcagaatgataaagcaagtttccttgacagaaccatcacaaaattatatacagtatttcactggttccctctgagctgtggaggaatcagccagagtagagaggtaggtggtcctggttcaagaaaacctgagtaagttttagagcagcactaactcttagaggaggttaagtttgaaaattcggttgaattctaaagataaagttatcccttccgttctgtagctgttttaatgtaaacaacaacttccaagatggctggaccctgccctgggtttgctcgaa

SEQ ID NO: 12514 - DNA, 33639 bp, Human
  misc_feature (1)...(33639): n = A,T,C or G
tctcgcaaagtgctgggattataagtgtgagccaccgcaaacggcctataatattttaaaattgtttttaagtgagagaaggggatatgctaggaggtatgccagctccagaaagcacattgcctagaatactatggtaaataagtagattttacagagaggacaatgagaaattaatgaaagattttaagcagataaataaaagtcagatttgtgctccccaaaccacagctacctttagggatgacagcttaacgtttaatatagaatttaagagacaaagataggttatgtgatttgcctaaagtcactaagcgaataaatggcaaaaccagctgggcactgcagcgcgggctatgatcgctccattgcactccagcctggacgacagagcgagaccccatctctaaaacacacacacacacacacacacacacacacacacacttttttttttttttgagacagagtttcgctcgttgcccaggctggagtgcaatggggcgatctcggctcaccgcaacctccgcctcccgggttcaagcgattctcctgcctcagtctcccgagtagctgggattacagacatgctccaccacgcccagctaattttgtatttttagtagagacggggtttttccatgttggtcaggctgatctcgaacttccgacctcaggtgatccgcccgcctcggcctcccaaagtgctgggatcacaggcctcagccaccgagcccggcctaaaataatcatttttaaaaatcacaatcataaatggcaaaaccaggttttttgctaatatgatcgaggtgaaacatcaagttagaaatcccctaattagctttccgagtcctctaacctcgcacactctaatctcaccgttgggaaatacatgggggtaacaaccctgcaaacgcctgaaaatatggttatctttagaatttacgaagataaatgtgattaggcacatgtggaagaagttcaagagactgtaaatgagggaggccaggtttcgcgactattaaaccaggtggctttttccttcagcatccccaggagaagtacgaacgcgactacaacagccggcacaaatgggatcatgcctgaagtacccatggggcacagtagaaagagcagcaggaagccgcgggtaaggagaggggatgcctgtgtgcttacatgtaaagagagaagtaagccacctactcacactcgtacttcctattgactggcggatacttggccttgatcgccttctgttcttcagtcaaattgtaatctctaacatcttcctcttcctgcgccatgactgcaggattagacactctacttccgcccttcatccaccggacttcggcccggagttactacttccgctctagactccgccccttggcgcacacccttaaaggaccacactcctttctcggagttggctgttgacctactttagtccctaccctgccgcttggatcgcatatttaaaaagccaaaaccccatcttctgcgattccttcattactagttctttccaaagactaaggaaaaacgttgaagggcaccttgaatgaaacccgtctgggtctgactggcgaggttctttcccccgcttcacccccaaaattgataactagacccgaaggcattctagatttttcatctcagtactctgaaagggtcgtaagcttaatagccttcaagaaaatggctgccctcttgctgcgggagtgtgcggaccaaacctctctcacgtgaccctgaccgggcgcagtcccgtcaacgccggcgcgcgcaatcgcgggaagtcggctcggggaggcgtggggggaggggcggagcgcgcgcctcggtccccgcggaaagctactccgcgcgtctggattggtcgcgaacgcggcttccccgcccatcccgccattaggagcgctcccattggctgatgttggcgcgaaggtgcgcgagtcagccctcgcgctgggggcgcaggaaacaatagaggccgcgcgcacagagcgagctcttgcagcctccccgcccctcccgcaacgctcgaccccaggattcccccggctcgcctgcccgccatggccgacaaggaaggtgagggtgccggggccgacccaggagggcagtgggtgcctgggctgagccgcggcctcgacatggcctaacagtgagggcaggcccgagtttgccgagtgcagtccccggtactgaaggcgtgaagagggaactccccgcggggcgggctaacggctcgccagttccctgggaccgatttcggtcgcagctggcgaagccagcggtggggcccccggccagtgtttgtttctcttcctgcctccgatatcggtttctcggcctctgtcccgagcgtggggacaccgcttcctacccacaaggctcgaagctcgggcctcctcgtcgggcttgtgagtttcggcgcgcacgagcgtgctccgaaggcctggctggccccttggcctggaacgggtaacggagtgtttggcggggatggcccgaggagtttcggcgccgcgaaagtggagagtgtggatgcctctgccgtggggatttagacaaatcacctccatttcatggttaggctgtaggagtcatgcaggtggctttgcagaggattactcggtttccgtttgtttgctaacttaaatttgtttttaaaaattttagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccaggtgacatgactctcccgaacgttattttgatgtattttcagtgtagatttctcatattgattttcttttttccgctcttcagtcacccggagaaggcatgtgatcaaaacctcttggtgacattttttctaggccacaaagtaaggcaaaataacaaaatgattttgtaacttacctgacaagagaaaacatattggcgtttttttctcaatactgaattaaatagctgtagctgatgataatacctgtaataatagtggctgtaccaaataatagtacaaaacttgtcaactttcaaaaagtattatggccaggagcagtggctcacacttggaatccgagcactttgggaggcccaggcaggagacttacttgaggccaggagttggagaccagccctgggaataccctcgtctctactgccccccacacaaaaaaagaaaaaagtattacaatgagtctagtccttacaacaaaaattttttgtttttctttttgagacggtgtctcactctgttgtccaggctggagtgcagtggcgcgagctcgactcactgcaacctctgcctcccagattcgagcgattctcctgcctaagccctcccaagtagctgggattacaggcacctgccaccacgcctggctaaatttttttgtatttttagtagagacggggttttaccatgtgggacaggctggtctccaaccccctgacctctggtgatccgcccgcctctgcctcccaaagtgccgggattacaggcgtgagccactgcacctggcctcaacaaaacttaatttgaattctcgtagtatgtcatggtacctgccttcaaggagcacattgtctagttgaagtggcagatataaactaataattatagttatatatggtgacagcagttgtagagagataattagggtacctagaaaacacctgaaggtggaatggctttcttataaggggtttgggcatagtgagggctaaaagattaatcctatgtttcttacgtgtaggtagcttatctctagtagaggggataaaatagtttgcatttattggggctgtatttggtgctacatatcggggatccaaattagttataattagcataaaagtggtacagataaaattatcagaggaaggaaaatttgcctcaatttgcctcatttcttaggaagaaatgacaatgcaaaaaacaaagaggagggtaaatttagatgatattaacatagttttaacaagaccattgtgccatttggaataatggattttctggtacaaaagtaagttttctgaattacattcaaaagcgattgtatgctaagtaaattccttcaaaacttggatctttaaaagttaagataattgcaaaatgttattagactatgatgtagctcaacaaatgatagaaatttggcagaaattatactagtaacttaagaatgaggctgctacctttacagtggcataaggaaaaatagggaaatgtgtcctagggatgttacacaaaaccatagtaaaaacctagaaattgggagttagaagctgctttgtgtgttttttgttttctggttttttttgtttttttttttttttttttttttttttgagacggagtctcctctcttgcccaggctggagtgcagtcacgtgatctccgctgactgcaagctccgcctcccgggttcacgccattttcctgcctcagcttcccaagtagctgggactacaggcgccggccactacccctggctaattttttgtatttttagtagagccggggtttcaccgtgttagccaggatggtctcaatctcctgacctcatgatccacccgcctcggccttccaaagtgctgggattacaggcgtgagccaccgcgcccggcctagaagcttctttatcatgaccaggagttcccacgtgcaattgatcatcagaattgcttggggaattcaggataattggaatcatttctgtcaagagttttcagtggtaattcaaaccatttaggaacttgtgggctggtcatggtggctcacacgtgtaatcccagcactttgggaggctgaggcaggcagattgcttgaggccaggagttccagaccagcctgggcaacatggtgaaaagcccgtctctactaaaattacaaatattatccgggcatggtggtgcgtacctgttagtcccagctcctcagtgggggctgaggcaggaggatcacctgagccttgggaggtcaaggctgcattgagctgtgatcctgctactgcactccagcctgagctagggattgccaccctgtctcaaagaaaaagaacttgtggcagagtacttaatgagaagtgtactggaatggtgattccacatttactatagtcatatgctaaattgtgcttattggactagtggatcacaaatattggccatcccatacctactaaacattctagaacccctacttttcagaaacttcccaagtaatataatagaatgactagctaggtttcgaaagcaagaattaaagacttaattccccaaggctgaaatctgtactgtcatcttagtagttttctgcattagcaaatctagataaataatgtgagaattgttttttgttgttgttgttgttttgagacggaggacggagtttcactcttgttactcatactggagtgcagtggcatgatctgagctcactgcaacctccgcctcctgggttcaatcgattctcctgccccagcctcccaagtagctgggattacaggcacccgccaccacgcccagctaattttttgtatttttagtagagatggggtttcaccatgttgtccaggctggtcttgaactcctgacctcaggtaatccacccgcttcggcctcccaaagtgctgggattacaggcgtgagctagtgcacctggctgaaaattgtttttgagacaggatcttgctctgttgcccagactgtgttgcagtggcacgatcagagttccctgcagccttgacctcctgggccaaggaatcctcctgcctcagcctctggaatagttggggctacaggcacacgctaccatacctggctaatttttgaaaaatttttttgctatgttgtccagactgttctttaacttctgggctccagtgatcctcccactttgacctcccaaagtgctgggattacagacatgagccaccgtgcctggccctgtttttgttttttaagatgaggattacttacaagcaagcagccctgatgcagtgtttacttttgtgtgtgttctttttctggtgtttacccagatccgtttcccccctttaaaaagaaagaaaaaccacggttgtagttctgtaacactgtcctctccttcgttctttttctggttcttgtctaaccttctacatacaggtaattccaattttctgttcatatctctcttcatttcttttcagtgtaatgtagaagctctcagagctttgcctgtgacatctgtgcagaagaattcctattgatatctttagacctcacttctccagagcttttcctgatttttcttctgcctgcccgtgtcttccctggtatatcttactggcttccccagtttgacatgttgtaaatggaattattccttacgtgaaggccttaccccaactttctctcctgttgttcctatttcttttcatcataattggctttagtttgacattttctctttctccattttataggcagtcaatttataaaccccaatgaattctggttgtgtagcatctttcccatctaggccaggggttctcaaaattttatatgcatcataatcagctggaggtactgtgaaacagttagttgtgccccaccttctagagtttctgattcaatgggtctggagtagatgtgagaatttgtgtttctaacaagttcccagatgatgtggatgcccttgacccagtatggagtacagaatgccttaagacggcattcagaacactaaatagtcagttttaatcggccttctctcccactgtgctttcccatatcagaagtcagatttggacttcagcatacttgttacttagtagctgtgtgatcttaggcaaattgtttaattttctttcttttatttatttttttcttttttgagacaggaagtagtctttctctgtcacccaggctggagtgcagtaacacgatctctgctcactgcagcctccgcctttcgggttcaagcgattcttgtgcctcagcctcccaagtagctgggattagccagccgccggttttttttgttttgtttgttttttgagacagagtcttgctctttcgcccaggctggagtgcagtggcaccgtcttggctcactgcaacctctgcctcctgggttcaagcagttctcctgtcgcagcctcctgagtagctaggactacaggcaccgccaccacacccggctaatttttgtatttttagtagagaccgggtttcatcatgttggtcaggctggtctcgaattcctgacctcaattaatccaccctcttcggcctcccaaagtgctgggattacaggtgtgagccaccatgcctggcccagctgcaggttttttgaggtcaggaatcatgtcttaattgtctttgtacttcatcgcgtttggagcgatgtgtccattgataggcggttagtaaatgtttgaaaaattggtttatgttatttactcttctttcccttttttcattcttttcaatttctttgcaccctttccccttctttcctttttaatgaaagttttagtaagcaaaattattagcatacccaacaatggtttgctttccctccaacctgttggtagtgagtgagtagttaattcacattttattccataaaacgttttactttttctccagagtaattaagtagaaaatatggctcttggccaggcacggtggctcttgcctgtaatctctgcacgttgggaggctgaggtgggtggataatttgaggccaggcgttcgagaccagcctggccaacatggtgaaatcccgtctctactaaaaatacgaaaatcagccaggcatggtggcaggttcttgtagtcccagctactcgggaggctgaggcatgagaatcgcttgaatccgagagccagaggttgcagtgagccaagatcgcaccactccattctagcctgggcgaaagagtgagactctatttataaaaaaagaaagaaagaaaagacccttaatgactttttcccctctcttaaaacctggttgtattagtgactttgacatacatgtatattgttgacttcgccgtctcctgatgttactaatttgaacagtgactatatattgccgttacagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggaggtaggaatcttaaaggtgaaagaagtaaagatgtgtgggtcatatctgttatgtgcactttgataaagtaaactctgactttagaaacaatatttaaggttgagggaaagcctgagtttgcaatggtaggtatttatatttatattagagttttaggtatcagaagaaatacttaacacatccttggttctgtaccttcacaataaacttttctcagctggtgctggtggggaggatttctgcaattgaaagaagcaaaaatatatattattgctgtacattcttgattttttatttttttactcagtctcgctctattgcctaggttggagtgtagtggcacgatcttctctcactgcaacctccgcctcccgggttcaagcgattcttctgcctcatcctcctgagtagctgggattacaggcgcccgccaccacgcctagttaatttttgtatttttagtggagacagggtttcaccaagttggccaggctggtcttgaactcctgacctcaggtgatccacccacctcagcctctcagagtgctggaattacaggcgtgagccactgcacccatccatattgctatacattcttaacacgggagataactacccctaaggaggtgaaaattggtttgtgtatgtgagtaggtgtaaataatcttactggttgattgtttaaagcacagatatgcacagaggacataggatatctatggtattaaaatttcatgggactggtggggagggaatagttcttaaaagagttcttagaggagcaatagtaaaaaaaaaaaaaaaggttgagaaacactaacttaaattaccctttctaggtttaaagtggtagaaatgacttaaccatggcactctctatgtgtatagaaactaagttccaatgagttgtttaattatatcctgtttttaggccataacctaagggtataactgctcatgaaatgcttaaacgctttccttttttttttttttggagatggagtctcgctctgctgcccaggctggagtgcagtggcgcaatctcagttcactgcaacctccacctcccaggttcaagcgattctcctgcctcagcctcccaagcagctgggactacaggcatgcaccaccacgcctggctaattttttgtatttttagtagagacagggtttcatcatgttggtcaggctggtctcgaactccggacctcaaatgatcctcctgccttttgttcttgttactgaggcacaaatactctgattggtagtgtgataaattgtaaaactacatatatgtgtgtgtatatatttatattgtgtgtgtaaaattatatgtgtaattttacacaatataaatgttatatttatatataaacacgtatatatgtatgtatatgtaaaactacatgcgtgtatatattgtgtgtaaaatataattatatataattttagataatataaatgtattatatttatatataaatatataaattattatgtaaaactacatgtgtatatatttatattgtgtgtaatatatataatttatatatacatataaattttatatatataaaatatatgtaattttacacacacacaatataaatgtatacacacacatatatgtggttttacatatatatgtaattttacacacaatgtaaaaaacgcaccccttctcccatataataaacctttccctggccaggtgcggtgagtcactcctgtaatcccagcactttgggaggctgagaccagtggatcacttgaggtcaggagttcaagaccagcctggccaacatagtgaaaccctgtctctactaaaaatacaaaattagccatgtgcagtggcacgcacctgtaatcccagctactcaggaggctgaggcaagagcatcacttgaacccgggaggcagagattgcagtgagccgagatctcaccattgcactccagcctgggcaaaaaaaaaaaagggaaactccgtctcaaaaacaaaagaaaaacctttcccctggatatcacttaaatggatgtattgtgatgtattgttttctgaaggatttatcctgtgtattggatcactcattcaacaaatatgttgagtaattttgtatgccaggtatagaatatgcaatataggttcataatttgcttttatggcctaatatatctggggcatgtatctttgttagtagatggagacctgcctccttttgatggctgtatagtagaccataattaactattccttactgatagacatttagatggtttctaattttttgacttcaaaagcatagttttgctatagaaatactttctaagtagaatgttgtatcaaagggcaggaccgttttttaatataattgatactgctaagttgcactccagaaaaagatttgaagtcccacaacagcgtatgtatttatgtctgtttctccatgcctttgccaacactggactcagtagagttcattctcaagtttacattgctttttttatttgtgatgttgagcttacatctcctgtttatttatgttttttgcccgtatttccttttgagttacctcttcatataaggtaaattacaccctctccacccaataaataggtgcagatcattttcttgtttaacttaaaatcttaagtcctgttattggttagaagctgtaagttgcttttttaatggagccttgctctgtcacccagactggagtgcactggcatgatcttagctgactgcagcctccttatgggctcaaacgatcctcccacctatgcctcccaagtagctctggctacagacatacaccaccatacctggatttttattttatttatttatttttatttatttatttttttgagtcggagtctggctctgtcgcccaggctgtagtgcagtggcgcaatctctgctcactgcaacctccgtctcccagattcaagctattctcctgattcagcctcccaagtagctgggattacaggcgcccaccaccacacccagataacttaattttttttttttttttaagagatggcatgtcactatgttgctcaggctgatctggaactctggcctcaatcttcccacctcagacctcccattcaatgatttcataaagtatgtgttcatctattgttgtcttctgggacttttatgtttgggccattaaaacttttgtcattctggtatttggtatggaatcagaatccagcctttttttcctaaatgattgagtttttgttgttattttgaggcggagtcttgctttgtcacccaggctggagtgcagtcacacaatccccgcttactgcaacctctgcctcctgggctcaagcagtcctcctgcctcagcgtcctgagtagctgggattgcaggcatgcgccaccatgcccagctgatttccattgtattttttgtagagagtaggtctcaccacgttgcccaggctggtctgaaaactcctgggctcttgcaattcacccactttggcttcccaaagttctgggcttataggcatgagccactatactcagccaaaaaaatttttttattcagtcaaccattgatggacacttgggttgatttccgtatctttggtattgtgaataatgctacagtgaacatacaagtgcacgtgtcttttttgtagaacaatttcttttcttttgggtatattcccggtaatgggattgctgggttgaatggtagttctatttttagttcttttttttttttttttttgagatggagtttcactgttgttgctggagtaaagtggcgctatctcaactcactgcactctccgcctcccaggttcaagcagttcttctgcctcagcttcccgagtatctgggattacagtcatgcgccaccatgcccagctaattttgtatttttagtagagatggggtttctccatgttggtcaggctggtctcgaactcccaacctcaggtgatccacctgcgtcagcctcccaaagtgctgggattacaggcgtgaccaccatgcctggccctgtttttagttctttgagaaatctccacagactgcttttcacagttgttgaactaatttgcattcccaccagcagtgtctaagtgttcccttttctctgcagcctcaccatgttatttttcaactttttaataatagccattctgactggtgtgagaggcatctatctgttttgatttgcatttttctgatgattggtgatgttgatcttttttttttccacattcgttgtctgcttatatgtgttttgagaagtgtctgttcatgtcctttgcccacttttttttttttttttttttttttttttttttgagacagtcttgctctatcaccaggctggagtgcagtgtggcaatctcggctcactgcaacttccgcctcttgggttcaagcgattctcctgcctcagcctcccaagtagctgggactacaggtctgtgccaccacacccagctaatttttgtggttgtagtagagatgaggttttactatgttggccaggatgatctccatctcctgacattgcgatctgccagccttggcctcccagagtgctgggattacaggcttgagccaccgcgcccgggtttttttgtttttttggggttttgttttatttttttaacaaacagtctctctctgtcgtccaggctgagtgcagtggtgcgatctcactgcagcctccgcctcctgggttcaagtgattctcctgcctcagcctcctgagtagctgggattacaggtacccgccaccacaccagctaatttttgttgttgttgttgttgttgttgctttttgagacagaatttcactcttgttacccaggctggagtgcaatggtgcaatctcggctcactgcaacctccacctcccaggttcaagcgattctcctgtctcagcctcccgagtagctgggattacaggcatgcaccaccacacccggctaattttgtattttttgtagagatggggtttcactacgttggccaggttggtctcgaactcctgacctcgtgatccacctgcctcagcaaaaggattttttggaattaaggctccaccaccatgcccagccannnnnnnnnnnnnnnnnnnnnnnnnnnncccctgcctcacctgccaagcgctgtgattataggcgtgagccaccatgcccagcctagttttgttttttaaggaagtgatatctcagcccaggcgcagtggctggcgactgtaattccagcacttgggaggccgaggcttatggatcacgaagtcaggagttgaagaccagcttggccaacgtggtgaaaccccatctctactaaaaatacaaaaattagctgggcgtggcggtgtgtgcctgtagtcccagctacttggaaggctgatgcagtagaatcgcttgaacccaggaggcggaggttgcagcgagccgagatcgtgctactactgcactccagcctgggtgacgagcaagactcgtctcaaaaaaacataaaaataaataaaaattaaaaagtgatgtctctagtctttagtccaaatttataataaattattatatattttactcaagctggtagattcttagttgtaaggttcatggactcaaaaagtggctcagtggtaaaaatcactatggtggttaccttgtttgaggacatagtattgactgggaagacacagttcataccttctggtaagatgggaatgttttatattttgacctggtgcatacatatataaaaattcatcaagctacgacgatttgtgcacctttactatatcatgttatacctcacgtttgttttaataatatttatatggagagaagccaacaaaataggaaagcaagttgatacttcagcctttcttttctacttcagattggccttttcgcataacagcttcaacacctatttatttattttgtattatattactatatatgtattttttcagacagggtcttgctctgttgcccaggctggagtgcagtggtgtgatcacagctcactgcagccgcagcctcccaagcagctaggacttataggcatgtgccaccacagtcagcccctgaaatatttttttttttttgagacagagtctcgctttatcgcccaggctggagtgtagtggcatgatctccgcttactgcaagctctgcctcccaggttcacgccattctcctgcctcaggctcccgagtagctgggactacaggcgcctgccaccatgcccagctaattttttgtatttttagtagtgacggggtttcacggtgttagccaggatggtctcaatctcctgacctcgtgatccgcctgcctcggcctctcaaagtgctgcgattacaggcttgagccaccacgcctggccttgaaatgttttttaaatgcaattttccatttctttttttaacctgtcaatttttttttttcttttttgagatggagtctcgctctgttgcccaggctggtatgcagtggcgcgatctcggctcactgcaagctccgcctcctgggttcatgccattctcctgcctcagcctcccaagtagctgggactacaggcgcccgccaccacgcccggctaattttttttgtatttttattagagacggggttttaccgtgttagccagcatagtcttgatctcctgaaccctgtcaaatttaacagtgagggatgtgtgcaactttgataacactgatgttaataagttctgataacccagtaacattgggccggcccaattttcaattttgaatacgctaagttcttactactgtggttttctttatggtttaggaggcctacgtttaatatctactcaatactgaaataaccaatgttatgtagtggttaccccttgctctgtgggctctgtgccaactgtggcttctcctcctttgttattggtgcctcttttctggcagctatgcttctttttttgtttgtttgtttgttttttgagacagagtctcactctgtcgcccagactggagtgtagtcgtgcaatcttggttcagtgcaacctctgcctcccgggttcaagcaattctcttgcctcagtctcctgagcagctgggactacaggcacgtgccaccatgcccagctaatttttgtatttttagtagagatgaggtttcaccatattggccatgctgatctcaaactcctgaccttgtgatccacccgtctcgggctcccaaagtgctgggattacaggtgtgagccaccgtgcccagccacttttttgggggtggtggtcattggcctttgcagttgtatatgtgcatatctcagagatatgatgggggttcagttcccaatcactgcagtaaagcaaatatataaagcaaaccacacaaattttttgtatgtttacactatactatagtctcctaaacgtgcaatagcattatgtctaaaaaacaatgtacataccttaatttgaaaatacttcattgctaaaaaaaataataataataatgcagacacagaggcaccaactgaacacatgttgggaaaatgccactaatagacttagtgcagggttgctgtaaccttcaattggggaaaaaaacttatgtgtgacgcacaataaaacgagctatgcctgtacttagactgaagtttcttgaggtacgtaccatatatgccttgttttttcatagattgtagatgcttgtgggctggagttatggaaaaaattagggattttttctcctttagaatctatcttgaatttttatttttaggtttttagcctgtgtgaaacattttgcttttcaaaagttattttgaagttgaaagttatctaatacgccagccataccacccatgtatatctttgctttctgaaaagatgtttgtccttcaaagaataacactaggcccggcccagtggcgctctcctgtaatcccagcactttgggaggctgaagcgggtagattatctgatgtcaggagttcaagaccagtctggccaacatgatgaaaccccgtctctactaaaaatgcaaaaattagctgggcgtcatggcacatggctgcagtcccagctactcagggggctgaggcaggagaatcgcttgaacccaggaggcagaggttgcagtgagccgagatcgtgccattacactccagtctgggtgacagagcaagaccctgtctttaaaaaaaaaaaaaaaaaagcactatatagcaatgcaattgacagaatatttttatttatttttaagttactctcacaacttctttgctttgtggataaggtatttgatgctcagagaaactgaaggctttccctgaatcaccaaactaagtaagtgacagagccacttaggggcctgggtctgactcttactttggaacttttgcaaccgtaccatgctgccttctattattctttgatcattaactacctttatttatatattgctttgccaagatttacataatcacacattatattgttatatatactgtaatgatacttgagagaactctctaagtgcacatagtagtcatgtgtgaataaaaaatgttttcatctagttgttgcctacctggtttatttcaaccagggacttttgttggcatgtgtaagtgggtgtagcaaaatggaactggctgctgtggctctgtttttcctcactgaaataaaagaaacactgtaaggagaagataaacggcatgatggtatttcagaacattcatcccaagctagagcttcatacaagcaatgcaagaagggcactttagtgtttagcacactgtgtacttaatattcattatagtagtagcattggttttatttattcagcatacttatttacactttgaaatttgaaaactttatttttttttttttgagacggagtcttgctctgtgacccaggctggagtgcagtggcacgatctcggctcactgcaacctccgcctcccaggttcaagcaattctgtctcagcctccccagtagctggggactacaggcgcctgccacgacgcccagctaatttttgtatttttagtagagacggggttttaccatatcggtcaggctggtctcgaactcctgacctcaggtgatctgcccgcttcagcctcccaaagtgctgggattacaggcgtgagccactgcgcctggctgaaaactttattaagatctgtttttgaagtatgtgggcgaaggattacccaggtgccgaggcaagagactgaaggcacaaactgtttcagtataataaagaaaatagttagaataagaatagttaaaatacaaagtagatatagagatgatcatggacattatcaatcattagtataaacattattaatcatcaacttttaatattactctttgttgtattactaatataaccaaggaataaccggcaggtataggatgaggtgctgaagggacattgtgagaagtgacctagaaggcaagaggtgagccctctgtcacgcccgcataagggccacttgagggctccttggcaagcggtaacaccattgcctgggaaggtacccattacttagcagactgtgaaagggagcctcccttcccttggagtcagggaacactctgctccaccaaccagcttcttgtgggagattggatattatccaggcctgcccacagtcatccggaggcctaaacccctccttgtggtgctgtgcttcagtggtcatgctccttgtccactttcatgttcctcccgtactcctgattcctctttgaagttcctagaggatagcagtagaaaaaatagtgaaagtcttaaagtctttgatccttctgataagtgcatagaagaaaacgctgacgtatgctgccttacctctctgcttcagctgcctgaaagggaagggcccctgtcccatgatcatgtgacttgcttgaccttatcaatcacttggacgactcatcctccttacctcgcccccttgtcttgtatgcaataaatatcagcgcacccagccatttggggccactgccggtctctgcgtcttggtggtagtggtcccccaggctcaggtgttttctctttatctcttttgtcttgtgtctttatttcttatgatctctcatctccgcacacggggagaacacccgctaagccccgtagggctggaccctacatcagtagaattctagttttccttaatttcagatagtaatataatacagccatccctcagaatccgtggggaattgtttccaagacctcctttggataccaaaattcacagatgctgaagtctctgatacagcatggcataatgtttacacataacctatgcagatcttctcatatactttaaaatgtctctagattacctataatacctaatataatgtaaatgttatataaatagactatattgttcggggataatgatgagggggaaatctgtacatgttcaatacatatgcaatgtttttctgaatattttcaattaatggctagttgaattcatggataaagaacccactgatatggagagctgactgtatttcttattagttatttaactacctggagtcacgggggtaggaaagcactttatagtgctagcaaatgtatagattacatctagtattatgccagtttgttgctaaggaaaaaaaatcctttcctgtgttcttatactctgggtaacctctagagtagctcttgttttgtcctcatttgcaattaatttattcacagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtctttgactatacaaaacatccttctaaaccaggtatgtgcccttttctattcaaatacaaatgagtcactatagaaatacatggttccactcactgtgagtttaattgcatgttactctgtgtaatttaacatcttgtgatttgtattgatatgtgtatatttttcttcattttgcctccatgaaaaaataatgcttttttacatagaacaaaatactggtgctgtttaagcattatctatttgatcataacggttcctatatcatttataaatgttaagagctttagacatcttgaccaaaattccattatgctcagtaggcccagagagccagtggactgggtagtcttgatgtgtctgtcactttgcagatccttctggagagtgcaacccagacttgcgtctccgtggacatcagaaggaaggctatgggctttcttggaacccaaatctcagtgggcacttacttagtgcttcagatgaccatgtgtgtatccttcccattttgaagcaaatctgggctagttaccagttggtttcttttttggggtgtgtggggaggtgagaatcttccttttatataatggttaattttacatttaagaccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatgtgagtagaatccattcagagtttctaaatatcttgtctacgttttatgtttagtcaccatttcaaggtttttttcctttgtttttttttcactgaagttgggatactcgttcaaacaatacttccaaaccaagccactcagttgatgctcacactgctgaagtgaactgcctttctttcaatccttatagtgagttcattcttgccacaggatcagctgacaaggtcagtttcgtttattttaatagaaaacatgatttctctaggtttttttgaattgcagagatattttacttacagtattttttttttcttaaaaaattgattactcttgcttttctttttgtacatagactgttgccttgtgggatctgagaaatctgaaacttaagttgcattcctttgagtcacataaggatgaaatattccaggtaagagaaactaatgctactattttgtttgttttaagaaaaacctgctgggcgcggtcgctcacgcctgtaatcccagcactttgggaggctgaagcgggcggatcacaaggtcaggagatcgagaccatcctggctaacacggtgaaaccctgtctctactaaaaatataaaaaattagccgggcatggtggcggatgcccgtagtcccagctactcgggaggctgaggcaggagaatggcatgaaacccgggaggcagaggttgcagtgagccgagattgtgccactgcactctagcctgggcgacagaacgagagtccgtctcaaaaaaaagaaaaaagaaaaacctggatgtgtgagtgggcacacatgtgctttatgccgttgctaaaaatagaaatctatatgcctatgctactttctgtgggaattgttttttctttgttatttctatactttctcaaactggttattgaccacttacattcttcagatattaagaaaactaggccaggtatggtagcttatgcctgtaatcccagcactttaggaggctgagatgggtggattgcttgaggccaggagtttgagaccagcctggccaaccctgtctattttttaataaaaatttacaaagaaaggaaaactagtgcctgattattttttcagccttgtttctgacacttagtgatctcttcccttcttccaatatattcttcatccttcattacttgccacatgtgttgatttctcaacccaagcctcaacctctggctccatattttctacctcatcagtttaaacccatttatgcctagtgttccattattggaacgctaagcatgtgggagtttatatcctgctcaaggttatcgcccaggtctgattgcaaaaattaaaaaaagaaataatcactgcactatgttcaaagcttgttgctacggcactatgagagattacgttatgtagcctttgctatcaaggagcccccaatttttttattttttttttaattaatttttttgagacggcattttgctcttgttggccaggctggagtgcaatggtgcaatctcggctcactgcaacctccacttcccaggctaaagggattctcctgcctcagccccccaaagtgctgggattacaggcgtaagccaccacgcccagccgagcccaaaattttatagtgagggagggcttgtttagaaattactataataaaagattttgtcaagtgttatgaacctgagggtggtaaagattaattctggtgtgtgaaggtggcgtctgaactgggctttaggtgagccatactcctacatacttagtctcttattttctacttttcagcccaccttggtgaacattttatccttaccctatctctttgctttgcttgtgacggtattcttgcctggacagaatccaaattcttccttaattgctggtcactaatgccctctttttctgtaccttaaggctaggtagcacttttaccatatttggtaacaaactctgattgttggatatatagtagtaaattttttgtctgactctttaataaaattattgcatggagtcatttttaatcagacttatatgtaatacagaactcatagtaaatacttggggacatagttattgtatatgtcatctgtactttagttcttaggtcagaattggattgcatttgggtagaggccagaattagcaaataagaatagacaagatgtaggccgggcacgatggcccatgcctgtaatctcagcgctttgggaggccgaggcgggtggatcatgaggtcaggagtttgagaccaccctgaccaacatggtgaaacctcgtctctaataaaaatacaaaaattagccaggcatggtggtgcacgcctgtaatcccagctacttaagaggctgaggcaggagaatcgcttgaacatgggaggaggagattgcagtgaactgagatcaccccacaagaacagacaagatgtgatgtttccaaagataaaatgatgctgggcacatggcacacacctccagctacgcaggaggttgaggcagcgagatcccttgagcccaagagttcaagtccagcctagaagcaatatagcgaggcctcatctcttttttttttttgataccagcctaaccccatctctacacaaatacaaaaattagctggccgtggtggcggacacctgtaatcccagctacctgggaggctaaggtgggagagtcgcttgaacctgggaggtggaggtttcagtgagctgagatcctgccattgtactccagcctgggtgacagagcaagacttccgtctcaagaaaaagtgtgccaaaggggtgctgtgggaatggaacaaaagcttatatcctgggtctagaaatgtctagtaatgggttgtttttgtaaacattttttttttgtttttctttttgtttgtttttgagagagtctgtcacccaggctggagtgcagtggcacgatctcagctccaacctctgcttcctgggttcaagcaatcctcctgcctcagcctcccgagtagctgggattacaggcgcctgccaccacacccagctaatttttgtatttttagtagagacagtgtttcaccatgttggttaggctgatcttgaactcctgacctcatgtgatccacccgcctcccaaagtgctgggattacaggtgtgagccaaccgcgcctgcccataaaataaattctttagctcttaattttaactgtaacgtgtgtaataccttgacttcctcttcccttttatttacaaaatttttaaattgttaaatattttgtgaattttttccctttattttctaattcatggctttgctcttttcttcattcctatgtgtaggttcagtggtcacctcacaatgagactattttagcttccagtggtactgatcgcagactgaatgtctgggatttaaggtaattcttgtattcattcctctctctacataattatttcctttatttacactttgcaaaggtagttactaagggtaaatctgttttaacttttaaaattatgcttttgtactagtaaaattggagaggaacaatccccagaagatgcagaagacgggccaccagagttgttggtatgttaaaagcattggacagtactgaaatagtctgtaatttaatgtcctctatctgcatttcacctctttgttttcttccctctttcagtttattcatggtggtcatactgccaagatatctgatttctcctggaatcccaatgaaccttgggtgatttgttctgtatcagaagacaatatcatgcaagtgtggcaaatggtaagggtttagtcatttattttggggaggtgaaataagtgagacatagaatcaatttacatttgtatattttatgattacagctaccatctctgttcatttcactcccaggtgtgattttaagacttgtctatacattatcattttcagctgcctgctcttgactgtatttggtcataccactggtattttaaactctgctaaacaaaactgaccctctctcccacttctccttttccctctcctccttctttctttctttttgtatgactccaacattttcctagctaaccagacttgaaaactcaagaattttccatgtctgtttacctctagttctagttcacttccagatttcataccatctatctgcggtgtttctcccatcttatcatcttacaagtacaaatttacatacccaaaggaggtatatcatatcacagcatcaaatactactatttctccatgaaagctgtctagatttcaaaaatgttccctatctctatctcaaagaatgtgaacaccctccttaaattttctttcttttttttttttgagatggtctctcactttttcacccaggctggagtgcaatggtgcaatctcggctcactgcaacttccacctcccaggttcgatcgattctcctgcctcagccttctgagtagctgggactataggtgcgtaccaccatgcctggctaatttttttgtattttcagtagagacggtttcactatgttggccaggctggtctcaaactcctgaccttgtgatccgcccacctggacctcccggagtgctgggattgcaggcatgagccaccgcgcctggcctcttaaattttcaaagcacttcaatttaataaaaataactgtggtgtctcatacattaatatttttaaaatagttatattcggccgagcacgttggctcacgcctgtaatcccagtactctgggaggccgaggcgggtggatcacgaggtcaggagatcgagaccatcctggctaacacagtgaaaccccatctgtactaaaaatacaaaaaaaaattagccgggcgtggtggcgggcgcctgtagtcccagctcctcaggaggctgaggcaggaaaatggcgtgaacacgggaggcggagcttgcattgagccaagattgcgtcactgcactctggcctgggcgacagagcgagactccgtctcaattaaaatatatatatgtatatattccggagataggtggtggttatggttaatgcagtgtgagtgtacttaatgccactgaactgtacacttaaaatggctaagctgataaattttatgttgtatggagtttgcgacaatttggaggtggaagacagtttcttgctctgttgttcaggctacagtgcagtggtgcgattacagctcactgcacctccaattcccgggctcaagacatcctcctacctcagcctccctagtaactgggaccacaggtgtgcatcaccagccctggttaatttttaaaattttttgtagagatggggtttgccatgttggccagtctggtcttgaacttgtgagctcaagcgatttgcccacctcccagagtgctgggagtacatgtgtgaggctgcccacccgccccccgcttttttttgtttttaaagaagtgcgtaacttggtggttgtctggtaaaggaaaagaattcagaagaaacttggtgtctctcagagtagatctagtaccaggaattaagttccagggaatagtttttgactcatcatgaggagagggaggatgttttcatcagtactttcttattttttatttctttattttttttttaattttttttttttctgagacagagtctcactgcctcacccaggctggagttcagtagagcaatctcagctcactgcaacctctgcctcccaggttcaagcaattctcctgcctcagcctgctgattagctaggattacaggcatgcaccaccatgcccggctagtttttttgttgttgttttttatttagtagagacggggtttcaccatgttggtcagggtggtctcgatctcctgacctcatgatccgccctctttggcctcccaaagtactggaattacagacgtgagccaccgtgcccggcatttttatttttgagacggagttttgttcttgttttccagcctggagtgcaatggtgcgatcttggctctctgcaacctccgcctcctgggttcaagcgattctcctgcctcagcctcccgagtagctgagattacaggcatgcgccaccacgcctggctaaatttttgtaattttttttagtagagactgggtttctccatgttggtcaggctggcctcgaactcctgacctcaggtgatctgcctgcctcggcctcccaaagtgctggaattacaggcgtgagccaccacacctggccagttatcagttttttaaatatagactagattcacaaaattttaatatgaggaataccattatgctagtcttcaatctgcgcttaccctttaacagcatgggatgattatcttataaccctaacccgactcccttctttattttcctttaaagacagggtcnnnnnnnnnnnnnnnnnnnngccagactaacagattgtactacatccatactttttttttattttacctccaaataccatcacaacattcatactttgtaatattacttatcaaaaagaaggatgggccaggtgcggtggctcacgcctgtactcccagcactttgggaggccgaggcgggtggatcacaagatcaggagattgagaccatcctggctaacatggtgaaaccccgactctactaaaaatacaaaaaattagccgggcgtggtggcgggcgcctgtagtcccagctactcgggaggctgaggcaggagaatggcgtgaacccgggaggcaggacttgcagtgagccgagatcgtgccactgcactctagcctgggtgacagggcgagactctgtctcaaaaaaaataataaaaataaatttaaaaagtatgattaggggctgtgctcagtggctcacacctgtaatccaaatactttgggaggccaaagccggaggatcacttgagcccagaagttctagactagcctgggcaataaagtgagaccgtgtctctaccaaaaaaaaattagccaggcttggtggtacgtgcctgtgatcccagctacttgggaggccgaggcaggaggataccttgaatccagcgggtagaggctgctgtgagacatggtggcatgtgcctttagtccctgctctttgggaggccgtgacagaaggatcccttgaggccaggagtttgaggctacagtgggctgtgatcacaccactgcactccagcctagatgacatagcgagaccctgtctctaaaggaagaaaagaaagaagtacggttagggttataagatattcatgacatgctgttaaaggggaagcgcagactgaagaatagcataatggtattcctcatattaaaattttgtgtatctagtctatatttagaaagctgattactggccaggtgtggtggctcacgcctgtaattccaacactttgggaggccgaggtgggcagatcacctgaggtcagtagtttgagaccagcctggtcaacatagtgaaaccccatctctactaaaaaataaatacaaaaattagccaggcatggtgacgggcgcctgtaatcccagctacttgggaggctgaggcaggagacttgtttgaacccaggaggcggaggagttgcggtgagccaagatcgcaccattgcactcgaacatgggcaacaagagcaaaactccatctcaaaaaaaaaaaaaaaagaaaaaagctgtttgctaaaatgtgcttggtacctagttcttggtttctttagacctttctgtattataatttttttacaaaaaagatgtgtaacttgaaaacagaaaattcacctcactctctttgtaataaatcccttcaatattaatacagaaacttaatagctgggcgtgatggcacgtacctgtagtcccagttccttgggaggctgaagtgggaggctagcgtgatcccaggaggcagaggttgcagtgagctaagatggcgccactgcactccagcctgggtgacagagcgagaccctgtctcaaaaaaaaaatactgaagaattcaaggttaaactagatccctgcaaggccatcacctccattccaagttgttactttatttggtgtttttagcattgtaatagagtaagtaaatatttggtctttgtcccagttcttggcacagagctctccaaaaacactcggagtttgcagagtgctaggagtgtctttgtcgttcctagtgatccactttggaccacacctgagtttgttctactgtgaggtgattttggtggggcccctagatagcctcatagttggtttagtcagaaaggccaatcacttgatttgagggttaaaacttgtcagcccacttgccaaccttggggttgcagggccagagattgaactctataaaaactcctaatttgatgtgcttctggattggtgaacaactcgacatactgggtgggtagcatgcccagagacttgatggaaactctgcagcccctccccaccttgccgtatgcatctcttccatgtggttcctcagttgtatcctttatttaaaaaaaaaaacaaaacaaaaaacaaacaaaaaacagtaatagtaaaaagctttcttgggttctgtgagtcattccatcaaattatcagacctgaggaggcagtagtgggaaccctgaaatttgtagtcaagtgggatagaagtgtgcaggtagcctgggaccagggaattgcaactggcttctgaagtaaggacagtcttctccaaagctaacttcagatagtgtcagaataggattgagttgttgtacacccagttggtgtcctaagaaagggtaccccacatttggtgttagaagtaacgtcagaaagcatcacacaattgtatgtattcttttctctggggtcagatcacaagctctttgaaggtaagactatcctgtcctctgcagtacctatcatagtgatatgtgcatggtaggtgctaagagcagtaaattttgctcctgtgaaagtggttcctgtattttaagattatgccgttggatacaggtattctgtcaagcagtagaagtagagtttattctatacaagaacagtttttctcttcaatatatagagattcggaacatattgttttggaagttttaagtgtgcagttcagcagtcttcagtgtatttacagttgtgcaaccatcaaccacagtcaatttgagaacattttcatcatctgaaaaagaaaccctgtacccattagccatcatttcctatttttctcatagtcccccagccctaggcagccaccaagctatggatttgcctgttttggacccctgttttttttagacgaagtcttgccccccaggctggagtgcagtggtgtgatctcggctcactgaaacctccgcctcctgggttcaagcgattctcctgccttagcctcccaaatagctgggattacaggcgcctgtcaccacgcctggctaatttttatatttttagtagagacagcgtttcaccatgttggccaggctggtctcgaactcctgacctcaggtgataagcctgccttggcctcccaaaatgctgggattacaggcgtgtgccaccacacctggcctggacaccttatataaataaaatcctaaagtatgtgacagcttttttttttttttttttttttttttttttggcacacagtcttgctttgccacccaggctggagtgcagtggtgcaatcttggctcactacaaccaccacctcccaggttcaatcaattcttatgcctcagcctcccaagtagctgggaccacaggggtgcacccccacacatggctgatttttgtatttgtagtagagatgcagtttcgccttgttggtcaggctagtctcaaactcatgacctcaagtgatctgtctgcctcagcctcccaagtgctgggattacaggtatgagccaccacacctggcctgactggcttttttatgccaaataatattccatcatatggattggatataccatgtatccattttagtagttgatggatatttgggttgtttttactttttggctattattaataatgtctggttaggctgggcacagtggcttactcctataatcctagcactttgagaggccgaggtgggcagatcacctgagatcaggagttcgagaccagcctggccaacatggtgaaaccccatctctattaaaaatacaaaaattagccaggcgtagtggcatgtgcctgtaatcctagctactctggaggctgaggcaggagaattgcttgaacctgggaggcataggttgcagtgagccgagatggtgccactgcactccagcctgggagacagagcaaggctccatctcaaaaggaaagaaaaataataatgcctggttaaagaactcaagaatgttggctatcaagacaaatagtatccacactgcagttttgtgggaatgtcctaatcaggcgtctggggatcagctgcttatttttattggaacatgatcatgctaattaatatttcattacccattataggttgtctccggatactttcatccaagagttgaatagttgtaacacagattgtgtggcccaaaagctataaagtatttactctctggcttcctggcctaatctgttgttgaaaccttgagttttagaagaagtcttcatgtttaaattctttttcttgtttttgggcaggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcatatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataaccccatgctgatgggttttatttagtataaaacatccatcaaacaccagtctctggcttctagaagagtccttcagatgacagttgttgtccatggtctttgactatcaagagcagaattaaatgtaatagtcccagagctgtagaaaagaactttactccttcccagggaaagtgaaagacataaaacactgaatcagaggtggcacagattagtctttgataaggtaacgtttctttgaagtctgtctgtagagaactacatggacttccaagagtgtcaaaggcagtgtggtagagagaatttaaggcaagatttaaatttggaaaaggtgcttgaaccttttctcagaggttttatttccccagtatgtttttcactggggcctttacttaggttagaaataataggctttgaaggcctctatcaccagatgcaataaccagataaaattcctgttttttcccaatcgcttagttttttgttgttgttgttttttaactgagtagatcattctgacccagaactactttcatgaggtaagatctttgggaaaatctgaatagcgttaaccattagattcaaatctcaaatggtttcttttcaagtctagttgttttagagtatagtgagaaataccttgacacaattttaagagtaaactatatgggtcagcatatccttgaacaaaaagtagactttgtaaaagtattcatttaaattctaacactcgtggcacaaaagaatggaaattgtaaacccatgtaatggaaattggctatctttttgaccccacatgtgcccctcaaaaatgtttttggtttgggtcaacacaaggcaagatacattctttaaaatactcccagatgtgtccatacattcatcctttactcagtgcatatgtgagggttgttgctggaagacaggaggctcatctttcctttccttggtgcattgagatcagtatcaacagcagatgaaatagaatccagcaaagagttgacatgttctgcctccggccaactctagaatctttttaagcaggtcagccagtatttgcaacttccacaggatgaattgcttgccaagtttctggcactcttgtctggttggaagagtacatccaaagggtacttagtgatcctttgctaagaagttttttgctgtttccgggttacagatttggccatatatttctaaacagcccctgtaaagttgaaagaaaaagtttataacagtgaacttctgaggtttagttactgcaggctttgttgagaagagattgttacagtgtgatttatggatgatcagggatgactttcccctagcaaatatttggatgcctcctgtttgtcaaatagaatgaatggtgatggtgatgggagggatagttaaacgttttctctgctaggttaacttcttacaggtataattacaatgcctgaaattctgtagtttcatttctttggattagtcgttgtcttttccagattgtacacaatctgatcaacacaaaggtagttagtagatcattaacctcaattgcaaggttataatttctcaaacattaagcatattatcagtcatgtggattcaaacacagtataagaaaatcctcaaggctgggtgtgatggcttatgcctgtaatcccagctacttagcaggctgaggcaggagtattgtttgaacccaggaggcagagttgcagtgagccaagatcgtgccactactccagcctgggcaaaatagcaagacccgaccccccatctctactaaaaagaaatttaaaaaaatgaaataaaatcctagaaaattagaaaaagcaacaatagttacttgtgggccaggcgcggtggttcacgcctgtaatcccagcactttgagaggctgaggcacgtggatcacaaggtcaggagttcaagaccagcctggccaagatggtgaaaccccgtttctactaaaaatacaaaaactagctggccgtggtggcatgctcc

SEQ ID NO: 12515 - DNA, 28843 bp, Human
cctggttaatttttgtatttttagtagagacgtggtttcaccatcttagccaggctggtcttgaactcctgacctcatgatccacctgcctcagcctcccaaagtgctgggattacaggccactgtgcccggccagaactgttctatattgtgattatggtggtcattaaacaaacatatacgtgtgataaaatccatagaactgtacatgaaaacaaagtctgttataattaaaaaccccaggctgggcacacggtggctcacacctgcagtcctagcactttgggaggccaactcaggaagatcgcttgagcacaggggtttgagaccagcctgggaaatatagtgagaccttgtttctacaaaaaattaaaaaattagttgagtgcggtggcgtgtgcctgtagtccagctacttgggtggctgacatggaaggattgcttgagcctgggaggtgggtgccatagtgagctgagactgtgtcactgcactctagcctgggtgacagagtgagaacctttttcaaaataaaacaacgaagccccacatgagttctggagatagagtgcctgggtttgtttgaatcacagctccatcacttattagttagatcctgggtaagttatttgtgcctcagtttcctcatctgtaaatgtgggtaataatagtatttctgcatggggttgctgtaaggattcagttaatatatgtaaagcacttgaaagagtgcctggctcattttattactatataagtgatagctattattattattatataagtataaaggagtaaaaagatatatgggctatcatatgattatagcaactacgagtaatctgaagtctgaaatacaacaaccatgaggtactggctttatgcaggaaaggaagaaactctataagaggttagtgtaaatgctactaagcaaatttaagtttgctctttccctattttccagggaaggcaaaaaccaagcaaacaaaaaaatcctctcactctattgatccattcattgaatgtctgctattttctttttcttttcttctttttttctgagacggagtctcacgctgtcgcctggggctggtgtgcagtggcacgatctcggctcgctgcaacttctgcctcccaggttcaagcaattctcctgcctcagcctcccgagtagctaggattacaggcatgtgccacctttgtatttttagttgagacggggtttcactatgttggccaggctggtctcaaactcctgacctcgtgatccacctgcctcggcctcccaaaatgctgggattaccggggtgagccaccacgcccagccatgcctgctattttctagggcttactgaaaggttagaaaggatcttggcagtctttcacttccatatatttcacttccaatatcacctgacacatgatgatgtattctctaacgtgtctgcttgttttgtgtatgtgtgacctcagttttttccaatttaccacagctaccaggtagaggtactgacggtgtctgtgattaagcatcatactattacagcatctaccaataagaatattaagaccaaataaattctcccactagattgactacacagtaggtaaattcggagaattatttgcgaagccaaaagcagcttttgaaagcaggaacctgggaatccaagcagtgggtgttttgaggatgatccagatacacttaggagtattcagatcatgaaactccatgacatgaagggaaaaggtgaggcatcactgcaatatgatgttaaaatagtaatcttggcctggtgtggtggctcacacctgtaatcccagcactttgggaggctgaggtgggaggattggtgaagctaggagtttgagaccagcctgggcaacaaagtgagaccctgtctctacaaaaataaaaaatttagctgggtgtggtggcacctgcctatagttccagctactcgggtggctgaggcgggagtatcacttgagcccaggaggtcaaggctgcgttgagctgtgattacaccactacactccagcctgggcagccgagtgagaccctgtctctgaaaaaataaaacaacaacaacaaaacaaaaaacaaaaaaacctatcttgaaccattcccctctcacgacaaggtcttaatgggggcagataatatgacagagagacattcagagcaggcagaggtgtcatcgatttgattcacgagtctgaaatcttgtttttaatgtttaagcattactctttgacaattgagagaaaacaatccccctgggaggaggaaagtggccaaaagaaaatggaacagctgagaaagaatggaaatgattctaatgctccacgacacagagccaagtgggagggaagccagggtaaatgatccgagcccgtctatgaaacagcccgcctcagcttgcgcgctgggtgcttactcagtgaagcaataacaactctgtcatggctgacacagctggagctcctccatgttagtcagctgcaggaaaccagcctatgtccattgtgcaagaagagtctgaacactagagacacaggcacacaagattgcatctctactccgcttctccttggttgttatgggaagtgagtgtctcaagttaaataaactagactctggggaactatacagtaaagacttagtgatcggcacagcttggcatttatggtgattaaagatacaaaacatattacaactttaatttgtcttagtaactttgaagaagatgttgttattttagtttaattagaggggggaaaagcagagggattacgtgtaactttttaaaataaaactttgaacctaatatcacataaaagtcaaaaagtactttgatggaatttattttacttcttttgggtgtcatgaatacaaaagaggtgacatgctcaacaccacagtgctgcagagccaggtaaacaatctagaataaacttgcttcattgttttctagcaacccctaaccacctctgtgatctgtggaagtgaggagttggtactttgcccttaatttctcctcccgttcctggccagaagagcccactaattcttgtaccctgtcatagtgtaagtgactaccgattcaaaagatgtcgttatattcagattaatggataaagaagtacagtcatgtatcgcataatgacttcttggtcagcaatgggccacatatacagccgtagtctggtaaaattataatggagtcagaaaatacctattgcctaatgatttgtgttacaattgcctacagaattcagtacagcaacatgttgtacaggtttgtagcctaggagccataggctataccatacagcctaggtgtagagtaggctataccatctaggtttgtgtaaatacactttatgatgtttgtccaaagatgaaattgcctaacgatgcatttcttagaacacatccctgttgctaagcaatgcactactgcaccaatacagtaatggaactttcttaaaggaaaatctactaggaaacacttgatcctagcagtgatcctaggctgcattaaattggaggcacaatatggaataaattaataccagatcccagtagaagtcctcaactaattctaggcatagagcatctttctcactctttttgctggctttctttcctgctttttttttttttgagatggagtcttgctctgtcacccaggctggagtgcagtggtgcaatcatggcttactgcagcctcaacctcccaggctcaagggatcttcccacctcagcctcctgaatagctgagactacaggtgggtgtcaccatgcccagctaaattaaatttttttttttgtagagacagggtcttaactatgttgccagggctggtcttgaatgcctggcttcaagggatcctcctgccttggcctcccaaagtgtttggattatgggtgtgagccctgttttctgaaatacattttcttaagttgtcagggtgatagtagtcagtttttagattgtttctccacaaaggcccagttcaccctttgctggctttctttcctgcctgttttttgttttaattctacctaaatatcctggcctaagctctgaactgtgaactcctgttttcaaccataggtagaaatataatgaccataatttttttttttttttttgagatggagttttgctcttgtgcccaggctggagtgcaatggcacggtcttagctcatcgcaacctctgcctcccgggttcaagcgattctcctgcctcagcctcccaagtagctgggattacaggcatgtgccaccacacctggctaattttgtatttttttttagtagagatggggtttctccatgttggtcaggctgctctcgaactcccgacctcaggtgatccacccaccttggcctcccaaagtgttggattacaggtgtgagccaccgcacccagacacaattttaacttataaaataaatggtatttcattccctccaaaataaaaactagaaatcaactgccaatcaattttctccatttgggaagctgccgccctctagaggtaatatgatgttgggggcactttccagttgtcaccaggactgacagcagagggagttgctactgcatttagtgtctgggatgagagataccagacataatgaaatgcagtttttttgtttttttttgagacggagtcttgctctgttgcccaggctggactgcagtggcgcgatcttggctcactgcagcttccgcctaccaggttccagggattttcctgccccagtctccggagtagctgggactacaggcacgcgccagcgcagtcagctaatttttgtatttttagtagagacggggtttcaccttgttggccaggatggtctcaatctcctgatctcatgatccgcccgcctcggtcttccaaagtgctgggattacaggcgtgagccaccgcgcccggctgaaatgcagttttatatataaagaaagaaccaccttgcccaagataccagtagtactcactttgaaacactatgaaaggtctacaacaagttgcatcatcttaaaaaattctccattatatttaatctaagaggacttagaagaggactgaggagtggggagaagacaggagagtgtgaaatacatgggggctcccatatgttgggacagaacatggtcctctcaggaatttcatggctctaactgcgtttcagcctagcttatcttaccagcatttatttcaacattaggatctgggacttgacttgccaattcttcatgacacagctgtggtactacttactcagctaggaataacaaaaggtgtagactttttcttttttccttttttcagacagggtctcgctctgttgcccaggctggagtgcagtaatgtgatcatagctcactgcagcctccatatcccaggctcaagtgatcctcctgactcagcctctccagtagctgagattacaggcacacagcgccacacctggctaatttttttgggttttagtagagatgaggtcttgctgtgttgcccaggctggtcttgaactcctaaactcaagcaatcctcctgccttggcatcccaaaatgttgggattacaggcatgagccactgcgcctggccaataaagacttctgattgatgtaatgttattcagtcatataaagatgaaatgtaaataaaatggttaaagtgtcctctcagttgcagaatagacctcagttgctagaaatacatagctttttaaaaatctttatttatttagtttttttgggatgaagttttgctcttgttgcccaggctggagtgcagtggtgtgatctcggctcactgcaacttccttctcctgggttcgtgcaattctcctgcctcagcctcccgagtagctgggattacaggtgcccaccacgcctggctaatttttgtgtttttagtagagatggggtttcaccatgttgtccaggctagtctctaactcctgacctcaggtgatccacttgccttggcctcccagagtgctgggattacaggcgttgagccactgtgtccagccgacaattcatttttattaaaaaaaataatagagatggggtctcactatgttgaccaggctgatcttgaactcctggcctcaagcgattctcctgccttggcttcccaaagtgctgggattacaggtgtgagccactacatctggccttgaatccttttttatctaagattttcaggcattgtcaaattgtgtaaggtaaatttctacttgttctctagtatccattctccccatttttccttaataaaaaccccaaatggttcccatttcctcctccatttcccagcttccttatgggtgggtgtggccatgtgacttgacctgtggactatgtaaactgatgtgtgcaacatccagcttttcttcccttcttttaaatagggaagttgcttgctctccatactttccccctttttacccttgctggaaaaggatgacaacttgggcagccaccttagacctacagatggccatggaatgttccaccagctggatccttggagcagagccacctactcacttctatcttatttaagccaatgaattttggagaaattaattttcctgccattttttcatatactgactgctaactccaaataagagaaatgacatctggtctcaatataaaaaacagtagtgaggcggggcatggtggctcacacttgtaatcccagaactttaggagaccgaggtgggtggacaacatggtgagaccttgtctctactaaaaatacaaaaattagccaggggtggtggtgcatacctgttatcctagctactcaggaagctgaggcatgagaattgcttgaatccaggaggtggaatttgcagtgagccgagattgcaccactgtacttcagcctgggtgacagagcaagaccctgtctcaaaaaaaaaaaaaaaaaaaaaaaagaaacaacagtagtgggagaaacttgaatatagcaggcttccaattttatatatatgtgggtcacagatacataccatatacatactatacaaaaaaaaaaactttttataagctgaatacattatgaacataagtcttgaatagtttaaaaaagttaactgttaagagctttgaaaagggtgaggctggccgcggtggctcacgcctgtattcccagcactttgggaggctgaggcggatggatcacctgaggtcaggagttcgagaccagcctggccaacatggtgaaaccccatctctactaaaaatacaaaacttagctgggcatagtggcgcatgcctgtaatcccagctactggggggctgaggcaggaggattgcttgaacctgggaggtagaggttacagtgagccaagatcgtgccactgcactccaacctgggcaacagagcagggctcagtctcagaaaaaaaaaaaaagaaaaaagaaaaaaagggtaagaatgggagctttatttatgcgttatatgtttaatacaaattcaatgtattttgttgtgttcaatacagttaatatctggagtgaacaaggtcggtctcatacatttatctttcctttcttcttcctcacgttgtacataagggaaggaggcttcttggttttataggccacacttttcttgatgcgctgtcctttgatgttaacaatatatggcaagagagggggccggacggtcaaaactgttccttcaggtgtatagcctcggagatgcagtctgtccttaaaattaggtgttactgaaacccaacctatgcaggcatgtgacacaacacaaaaggctgttagcaatcatcttattaaaaataccaaaccaaagctgaaaatggactatcagagaacgctgtcactctctttcactctcttattattttattattttttaagaaactgcgtcttgctatgttacccaggctgaactcaagttcctgggctcaagcgatcgtactgcctcggcgtcccgagaagctgggggcacaggtggacacaccttagttttaaaaaagcatacaatgcgtttgtgcaaagtacaaatttattttcagaataggttgtattttatgaataaactagtatgtacaccttaaaataatcagctttcatcagttaaggcacttttctataaaaaaaattgtcggtaaggctgctttattcactttttgttttttttttttgagatggagtttggctcttgttgcccaggctggagtgcaatggcatgatctaggctcaccgcaacctccgcctcctgggttcaagcgattctcctgcctcagcctcccgagtagctggaattacaggcatgcgccaccatgcccggctaattttgtacttttagtagagacggggtttctccatgttggtcaggttggtctcaaactcccgacctcaggtgatccgcccacctcggcctcacaaagtgctgggattacaggtgtgagccaccgtgcctgcccttttattcactttttaaaaagtgcttggcataaaattacctgcagaggaaaacttgatgtcggccactgcttcagatgcccccagtccttcttttaacataatgtcttcagcaacaagaggaggaaatcctgccattcgttcttttccacccattggaatcttccaatgaaataaagatatttacaagttcaaattaaatttcttggaactctaacattaagcaaatcactgataagataattctgtacagggatcaagaataaaatcctttcaaatattcaactgttgaaaagaacttgcaatcacttctggggtcaaatgaaaagcaagggaactctgtgatgggatgaagcttacaaatctcagggctctgggccacacattgggcaagcacctggcagaagcctctggacaggagaattgtgcttcactgacactgtttttagaatcctccacagggcctcacatagattaatgttgggcaattaaggcacggtccttctaagtaccttagttcttataggtgtggccatcaggattaatgcctggtctttatgagttaagggtccatatataatggataagatttagcttttatgtttacaggtgtttccacgattagaagtaattgagtaattttttttttttgagatggagttttgctcttgctgcccaagctggagtgtaatggcacgatatcagctcactgcaacctccgcctccaaggctcaagtgattctcttgtctcagcctcccgagtaactgggattacaggcgcgcaccaccataccaggccaatttttttgtatttttagtagaaacagggtttcaccatgttagccaggctggtctcaaactcctgacctcaaggtgatctgcccacctcggcctcccaaagtgctgggattacaggtgtgagccactgcgcttggctgtaactgggtaatttattcatctattcattagcaaatctctcctgtgtttagcactaagaacacaaagatagattttgcagtatggtttctgcccccaaggaaatcaaaggggtagataatatgtaagctaatacaaggtcagaaatgtaatgtgaggcatctataagtactatggttgtgaaggaaggagtaatgaatgtgttcagtcaaggaaaacattagtaaagaagctatatatatataacaaaaacaagcaatatatgagcaatattttgagaaatgagtcaaagttatttggtggaaagatattttcggtcgccacaggtacagataaaaactggaaaaaggatgatgagttcggggaactatagcttaattgtccaaagtatggtgtgtgtgtgtgtgtgtgtgtgtgtgtgtgtgtattggtgatgaggctgtcaggagtttatacaactttttgcaacaatgtcactattgggcactcaaaatgtggctggtgacactaagcaaccatattttaaattttcccttttttttttttttttttagagacagggtttcactctgtcacccaggctagagtgcagtggcataatcatggctcaccacagcctcatactcctgggctcaagtggtcctcctgccttaacctctcgaggagctgggattacaggtgcatgccaccatacctggctaacttgagcaaattttcttttttttttttttttttttttgagatggagtctctgttgcccaggctggagtgcagtagcgcagtagcgcgatcttggctcactgcaacctctgccgctctggttcaagtgattctcctgcctcagccttctgagtggctgggattacaggcacccatcaccacgcctggctaatttttgtatttttagtagagatggggtttcaccatcttggccaggctggtcttgaactcctgaccttgtgatccatctgccttggcctcccaaagtgctgggattataggcgtgagccaccacacctggccactgagcaaattttaattgtcactaatatatttaaacttagccacatgtgggctaatggctaccaaattggacagtgtagtctagagaaaaaaatagctgtgtggctattctaggatcagtctatatagagcaattttgctttatagccagaattctcaaagagaatgaggtgagggaaagctagctcaagatattgtataacagttctgtacaacaaaggctttcttaacagagctatgggaccatcccagtgtatactaaccataaccatgcaatcaaggcatgttgccttacctggagtaacgtatgacctgcatgcttctgatacagagcgtctgccctgtccaaggaggtgatatgcacagggaggatgttggaagccacgactgtaaaccaagctgactgatttcccttaagaaaggaagaagttatctgacctggtgaaaaacttggaaaacctgcatattcaaggtacaatcaactaaaaaaaaaacaaaccaaaaaacaaaaacccaatcagactccctttataagtactggtatggcagtagctgtaaatcaaattattactaagaacaggggcacaatactgaagcagtgcatttcagcaattcatgtgaaactatgacttctttgacagacccaatactatttttgaaaaaagtctattattaaaaattaaaaggaaatactatctgctttaattgtctctgtgtaaagttaggtttaaaatattaacattttatgtgttctgatgaaatatataagggtgcaagcctggtgtggtggctcatgcctataatcccagcattttggaaggccgaggtgggtgaatcccttgagctcaagtttgagaccagcctgggaaacatggcaaaaccctgtctctataaaaaatacaaaaattagctgggtgtggtgatgtgtgcctgtagtcccgactacttgcggggctggggtgggatgatcattggagcccaggaggttgaggccacagtgagccgtgactgtaccactgcactccagtctgggcaacagagagagatgctgtttcaaaaaaaaaaaacaaaaaaacaaaaaaacaaaaaaccaaccccaaaagcaaaaaaccaacaacctcccaaaacgaaatatataagggttctaagtgtgtaaggcaaaatttctaacaaagtatgagcaaacacaaaacccaagaaatgtgctatagtaatggcacacagttgtattgtgttgttggacatatccatatccatgtttcattttcctttttctcttcactttagcaaaatggagagcaattctatagacactccaaaatccctagatgctatataaacgaataccaaacaaaaacgtgtatgcataaaaacacacatatcatggtatacaaagtgtggaattaatttaacgcctataaccctgtacctaaaggtttgactttatcccataggtttgactctatcccatagaatagggatagtatcttgtcttaaatgccaagctgtgtagggtactcaattgaaaacgtaagttttcaagacctagcacttttttggggggatgagggagtagggcatttcttttccccaagttttttttttttttttgatatggagtctcgccccatcacccaggctggagtgcagtggtgcaatttcagctcactgcagcctccgcctcccaggtttaagtgatcttcctgcctcagcctctctagtagctgggattacaagtgtgtgccaccacgcccagctaatttttgtatttttagtagagatggggtttcaccacgttgaccaggcgggtcttgatctcctggcctcaagtgatcagcctgcctcagcctcccacagtgctggaattacaggtgtgagccactgtgcccagccatccccaagtttttattacagaaatttttaaacataaaaacaaattaaacccaatacaatcatggcttagttatcaacattttgtcagtcgtgttcatacatctgcttccttaaagtgaatcccaatattttaaaatcattttttaatagtacagacttttcttacctgcaggaaatctatgcggcctatagcacccaaaaacagaaccattcctggtttaagcacaaaagttcttggaacaatggactgtgttggcaaaacaatatttacttctttttctgttagaagatttaaaatctgtgaagcaaatggcagatttttaagaaaatacttttattgaaaatatgatatattatgatttacccgtaaaataaaaagtgatgaaaaatatgccagacttcaaaataaaccaaattatgtcagagtttgctatgcatcaaatttatatagattcttcctgtctaaattaatttcaatctgatggctctacccttgttttacaacttaatctacagtaatggcaaaataactttataggtgtatgagactttcctatgtcagcagcattccctaaatgtcaaaattaatgtgaacctgaaaacatgttgattcaataccaagatagaaaatatatgctctccttatcaaggcttgtgggcagtagcaatttccgcttaaagtaatggtatacgtgaccttatgtcctagtggtaagtatgcatgcattaaatgcaaaatggtcaccccattctaggagcaagtaaagtggctgaagaacctctttctaaattctggtcttcaatttccttatttctcccaaatattcagcagagaatgagaaaaagttataaatcccctatgcttataacacagaggatttataatttatccctatgatttataataaatcccttctaaggatgacaagttcctagagagactagagaaaaatagaaaaggaaagacagaagtacaagattctgcaaagatttaaggaatcaaaatctggttaaaaaagaataaagaaggtacaaattggacacaaaacttgtaaacttctttcttaacaagaggctgggcgtggtggctcacgcctgtaatcccagcactttgggaggctaaggcgggcagatcacctgaggtcaggagtttgagaccagcctgaacaacatggagaaagcccatctctattaaaaatacaaaattagccgggcgtggtggcgtgcacctgtaatcccagctactcgggaggctgaggcaggagaatcacttgaatccgggaggcggaggttgtggtgagccgagattgcaccactgccctccagcctgggccatagagcaagactccgtctcaaaggaaaaaaagagaataacaagaaaataaaaaatagaaatgatacatagcagctcacaaaaaaataataagggggctgcagatagttttcttcattatttgtgtttgaaaaggcacattaaaagccatttgcaggtcagccatggtggctcatgcctgtaatcccaggactttcagaggcagcggcaggcagatcacttgagctcaggagtttttttctttttttgagacggagtcttgctctgtcacccagggctggagtgcaatggtgtgatcttggctcactgcaacttctgcctcccgggttcaagcaattctcctgtctcagtctcccaagtagctgagattacagacgtgcgccaccatgcttggctaatttttttggtatttttagtagagacggggttttgtcatgttggccaggctggtctcgaactcctgacctcaagtgatccacttaccttggtcttccaaagtgctgggattacaggtatgcaccattgtgcccagctgagctcaggagtttgagaccagtctgggcaacacggcaaaacctcacctctatgaaaaatacaaaaattagctggggtggcgtgtgtctgtagttcccagctaccctggaggctgaggtggaggattgcttgagccagggaggcagaagttacagtgggccaagattccaccactgcactccagcctagaccagactgggcaacatagcgaggtcctgtctctacaaaaactaaacaattagttgggcatggtggtatgtacctgtggccctagctacttgggaggctgaagtgggagaattggttgagcccaggactttgaagttacttgatcacgccactgcattccagcctgggcaacaggggaaaccttgtctctcttttttgttgagacagggtttcactctgttgcccaggctgggctgcagtggcatgatctcggctcactgcaacctctgcctcccaataagtgtatcaagtgattcttgtgcctcagcctcctcaatagctgggattacaggcatgtaccaccatgcccagctaattttttgtatttttagtagagatacagttttggcatgttgcccaagctggtctcaaactcctgggctcaagcaatcctcccacctcggcctcccaaagtgctgggactacaggtgtgaggcactgtgcacagcctgagtcttaatactttcatttcacaacagagatccttggttcagtctgggaaaccctggtttaagacatcaaataagtttatctgtaaactaacagagaagcaaactaccagtgctgacagacgtttatatctaaaaatttggggttctcattctgctgtctagagtattttgcaaattcttgcctttctgacacaactatttaatagaggatatatgactgaagtaactgctatgcctgatctaatagcatctgaaagggaagaattagtctgggcgtagtggctcccatccacaatcctagcactttgggaggctgaagtgggtggattacctgaggtgaggggtttgagaccagcctggccaacatggcgaaaccctgtctctattaaaaatacaaaaagtagctgggtgtggtggcacatgcctctaataccagctactcgagaggctgaggcaggacaatcgcttgaacccaggcggcagaggttgcagtgagccaagatcattgcgccactgcactccagcctgggcaagagagtcagactccatctcaaaaaaaaaaaaaaaaaaaaaaaaaagtatggtgggggaagaattagttcattaagctaaagtgacagaatattattagaaagcagctctgaacttttggactgctaaggaagaaaagatggcatgagcaattattccaggagagcaataaaatttaaaaggtgtgtatgattcaatgacaggggacaccaaatagaatacaattctgagaatgtaactataagtgttcctgatgaggccaagaaaagtacctaagaaaccaatgtggttttgtagggagatacagagataattagaaaatcggaaactggtcagtaaccagattcgaaggaaatgattaatgaatctgttgtgaggctgtatcctggatgcacatttgagtcaatcaatgatctgaatgaagatccaaactgcaaatataaaaagtaatgagattgaatgaatatttaacagagtaagatataggctgaatttaacaagacaaagtcaaagttacctatgaggcccaaagttgtccatgagcaattggataaaagagaggcatagggacaagacaggtggagttaatgctattcttttttttttttttttgagacagagtcttgctctgtcacccagactggagtgcagtggcacgatctcagctcactgcaagctccgcctcccgggttcacaccattctcctgcctcagcctcccgagtagctgggactacaggtgcccactacctcctggctaattttttgtatttttagtacagacagggtttcaccgtgttagcccagatggtctcgatctcctgaccttgtgatctgcccgcctgggcctcccaaagtgctgggattacaggcgtgagccactgcgcccggtcggagttaatgctattctaaatcatgctcacctgagagcactgagttctcagtgtcacactttaagaacaaacatagaaaacattctgaagaggcctgggccaatgaatagcctgtttcctacagcacagctgtaggaaatgaagacaaataatccagattgtgggcacagtgaatgctcaacgtttgctggatgaagtaatgaaagagaagaaaagggagggataggtgaagaagagatgggacgttacattttaaaatatttgtctggcaagggaaataggtattaccttagtcccagatggctttggggaacaatggatacatgttacagggagactattcagctcagtacactcaatacaaagagaaggtcaaagacccaaatgagttaccttggaaggtgacatgacagtttcagctttggtgagtcactcctttcagttcaagatggaggaccccttgatggatatgttacagaggtaattcaagcagggactagggagttggactccagtgatatttatgtgtttttccaacctcaaaacctaggcttctgtaaacgtttccctaaccaaggtaacaatcacaatgataaaataagttggttgtcagcaatgaagtctatcaaatggaacacagaacttgacggcatacagattcacccctaaacagctttcatgaatgaatcagaactgagtctaaaatggaagtatacttcttttcctgttttctgccaattaagacagcagtacttgtgcaattgaaagtaaatgtttctgaggctgatatgactagtaataaaactccagtttcccatttagctggctctacatgcattacactctttctctattgcaattcccctgtcttgataaattggctgtatctgggcagcaggcaatataaacccattaaaaaagaaaaagaaagtaaatgtttctaaaagaaaccaaatacatacacaattttcttttgtaattccaggggtgtcataaaaccagtgggcatctttcacatcttgtgcagtcaattctacttgtttggtggatttgtgtgtacccataacagggtcattttccatgtcaaaggcaagtgaatcagcatcaaactcaaagggaatgttatccttctgttcttctgaatacaagaatgtccttccaactcttcctagaacaagttatagtaaggttattagtcactcctttaatacttttaactccagacataatttttatgtttccctcaaacaagttactaagattacagtgtagggaagtgagaccataatgatacttttgcttttttttttttccaaaaagcagtgggagtcaactcttgcaataatcaagcgtgtggctggctgtgtacatggagtggcgggggcaagggtgtgtggaaatcagactgttttaaagaaaggctgaaaagatataccaaggaaagacagacaacctaatctaaagctgctgcatggagtaaaaacttttactacctgtactgctctgggtttccaaacagtagccttatcgctaaagggcctctttgttgcagaataaggaaggcagtctctccccacaaaaactggctagcctcggacagctgtatttcaggttgcttaacaaagaattttagcatagtaccaacgagggttttcccatagaggatgcttacctacgacataaccatgctttttgaggacattaagctgattttgttcttgctcactaagatcttcttcagcttgagttgaatcttttttaagtctttgatgccttttaaacattctgtaaggagttgggttgcaaataggaaacttcagaaggtttaatgtagtacctgaaatacacagaataaatacatctttacaaaagggaataagggggaagaaaatgaacatttttgaggatctacactgtgttggttactgtaataaaatataaaattactgccactttacaaatgaggaaataggttaagagattagttcacaggggaaaccagaattggaatccaaaatctgtaggcccgatttctttccatttttatcacattaccattcagtataaaagtaatttttctgtaaaattcaaagtgcaagacagagaagagcagcttactaaatgaaactttggtttcaagggaacaaatggggcagtcagttttgtcaacttaaatttaagcctggctgagcgtagtggctcacacctgtaatcccagcactttgggaggacgaggtgggcagatcacgtgaggtcaggagttggagacctgcctggccaacatggtgaaaccctgtctctaccaaagatacaaaaattagctgggcatggtggtgcttgcctgtaatcccagcgctttgggaggccaagagttccagaccagcctggccaacaaggtgaaaccccatctctactgaaaatacaaaaattaggccaggcgcggtggctcacacctgtaatcccagcactttgggatgctgaggcgggcggatcacgaggtcaggggtttgagaccagcctgaccaacatagtgaaaccccgtctctactaaaaatataaaaattagctgggcatagtggcgtgcgcctgtaatcccagctactcaggaggctgagggaggagaatcactggaacccgggaggcggaggttacagtgagccactgcactctagcctgggcaacagagcaagacaagactccgtctcaaaaaacaaaacaaaacaaacacaaaaattagcttggtgtggtggcgcatgcctcgaatcccagctactagggaggctgaggcaggagaatcacttgaacccgggaggcggaggttgcagtgagccgagatcacgccactgcactccagcctgggcgacagagtgagactctgtctccaaaacaaaacaaacaaacaaaacacaaagttcattaggttcagacagtaaaaaggacgcacactttctggaacaatatacaaagaagttacaaagcaaatctccagaacaggaactttgctttgttccctggtctatctccagtgcttagtgactgggaacagagacgtgctccataaacacttccattgaaaattactacaacacatcctcaattttccctagcagtaagctgacacagaagagaggtgtgaccagagtggggagagaatttgtaaagggaagggtacaggcagcccgcagtggacattaagggaggatgtactcggtgcctcggccaggaccagacgtccaccttgccaggaaacgaagagggcgagcctcctaaaactcacctggccaaggggagatggtggctctgtcgatggcctcggagcccttggcagtgcagtaatcggactccaggagcgtgttaaagagagtggatttgccggcgttggtggcgcccactaagtagacgtccccacggtagcgccaggagcgctgaagggcagagatcaactcttccactccatagccggtcttggcgctgatcagccgcacgtccctgaccactgtgcgggaccagttcggcggattcggattctccccgtcctgtggctcgtccttgacggggcgctgtggcccttggtggccaggggccagcaggagcccggcgcgggcacagtcctcccacagtcgctcccgcagcctctgccggtagccaggagcatcctggggcaggaggtccactttgtttcccagcacgatcagctgcttggggcccaccagcgcgggcaagtcgggcagcagggcgtcgggcaggtccagcaggtccaccatgtagagcaccagggaggggccgggccgccgcaacgcggcgctcaccagctccaggtactgctcgcggctcacctgcaggcgtagagcgcgccggtggtgcgacagcagccagcagcgctggcacacggtccgtgccagcccgccgtctgcctccgccgtgcggaggaacttctctcggggcaggtagccgggcactccggcgtcctggcagtgcagctctgccccgcagcccgagcagttcacgccgctgggcggcaatgccgggtccgggtgccccacgaccgggtgctcccgggacctggcccgtaggttttgctgtcgccgctcctcccgccgctgctgcctctgtcgctcctcctcctcctgctgttgctggagctcctgcagctgcttttcgcgggtgggttgcggctccggatccaggatgtactccgggaacagaaaacgctcctgcatgtcaccaccttctccaaagccctccgtgtccacggggtcataaggaagctcgcgtcccagactcgatgagtgctggaaggaggaggcggcagcgcacctcctctccaggagcggctcccggaggccatggcgcgctgccgtgggagcggatccacgaaggaaaaggctcagcagcctgaacggtaggcgagcgggcagcatgaggaagtagctccaaaggggcggagccaccagcgcgcacgcgcactagggtccgaggcgcgcatttgacccgagacgaaagcgcgtgggtacttgggagctgtcctggttggttttgcgtctaatcccgtcagttctcgcgatttaagctctgagactgagaacctacttaaagctatggcaaaggcactggaggattgagctaggtgggcagaaaagagcagtgagtgttttgggttttttcactttcagggcttaacgcctcactgctagcacaagccgcccttaataaatcacacttaaaaaggagcttccggggtcgggcgcggtggctcacgcctgtaatcccagcaatttgggaggccgaggcgggcggatcatgaggtcaggagatcgagaccatcctggcttacacggtgaaacccccatctctgctaaaaatacaaaaaattagccaggcgtggtggcgggcgcctgtagtcccagctactcgggaggctgaggcaggagaatggcttgaacgcgggaggcggaggttgcagtgagccgagatcgcgccactgcactccagcctgggcgacagagcgagcctgtctcaaaaaaacaaaacaaaacaaaaacagaaaggagcttccggccgggcgcgtggctcacgcctgtaatcccagcactttgggaggccgaggcgggtggatcacctgaggtcagcagttcgagaccagcctggccaacgtggtgaaaccccgtctctactaaaaatacaaaaattacccgggcgtggtgacccttgcctgtaatcccagctatttgggaggccgaggcaggagaatcgcttgaacccgggagacggaggttgcagtgagccgagatcgctccactgcactccagcctgggcgacagagcgagactccatttcaaaaaataataaataaataaaaataaaaaatagcttcgtgttttggtccttataaaggcaaataaattgagcatcccaatgttgcggattcacaggacgaacactttttaataataagtatacctggttttgttttcaggtgtcgttatttgtgcaacaacattgaaaaacaagcagaaataaaacattgacggaacggatacgaccgcagattgcgggagctgtcctctcaatcagcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggtttttgtcttttgatttcaagagttaggagctcgagaaccgtttggcaatatgtacgacgcggatgagggtaggtgaacgctcaaaacacacgccgtggcggtccatttaagcaggaaagcgttgggaactgattggattgaggatttggggccttcccatgcgccggctgcacagtccccagccttgttcccacacttaccaggccgggaacgaaactggggtagggagaggcggagggtgcagggaacatagtgttaatgttccaggttacgttcactgctgctctctgcactttctcgttccgttagatctgatcctcgtttcctgtggtgaagtagcgtgcagaatcgtaagataaattacgttttgaatttgaagcaaagggcaccctttaaaaattttccttaaagccacagtcgacttaacgaatagctcaattgttgagtgtcagcctgtgtcaggcagtgtggaaggtcctggaaatattccgggacagagaatatcggggggtgggggtggcgggggggactcggtttagtctgacatttcttcatactgtttgtaagtcaaagtaaattgtcttaaaggatgacttttaacttcctcttctcacaatgtcacagttctcagatgatatgtattctgctgcactgggccaatgtataatacctgtttgtttgcgcatatggaattcttagtagtggccgagcgcggtggctcccgtcagcactttgggaggccgagatgtgcagatcgcttgagaccaacctgacaaacatggggaaatcctgtatctactaaaaatacaaaaattagcctagtgtgatggcgtgcgcctgtaatcccagctactcgggaggctgaggccggacgatcgcttgagcccaggaggcggagtttgcagtgagctgagatcgcaccactacaccacagcctgagtgacagagttagactgtctcaaaaaaaaaaaaaaaaaattcttagttgagtctagtgtattttcgtagccgccttttccattctccatatctgctaattcaaaccttattttcttatagctctcaattccttggccaccccctacatctcctctctctattccctcaggtacttctgataaatcagatggaaaaaattgaagcaaaagcttaatttttttttttttttttttaagagatggggtctggccatgttgcccaggctggtctcaaactcctgaggtcaaaccatctgcctgtctcggcctcccaaagtgctgggattacaagcatgagccaatgtgcccagccaaaagcttaaacttttaaagctgtttaaacttctgtctcatttatatcttgtgttgtagaaatttattagcatcattatattccttgttcttttttaactactatctcagtagaagaaaaattcgaaaaaaaagatttttaaagcataatttttggctgggtaatatattctcatagctcacaagccagaaaatttaaaaatgttaaagtggggtggctggtgcagtggctcacgcctgttatcccagcattttgggagtctgaggcgggtggattacttgagctcaggagttcgagagcagcctgggcaacatgggagacccctctctataagaaatagaaaaattagctgggcgtggtcttgctcacctatagtcccagctacttgtggggctgaggctggaggatcgcttgagcctgggaagttgacactgctatgagctgagaacaaagtgagaccttgtctcaaaaaaaacaagttaaagtgtcacgtctccttcttacccaccatctgcccagtttgaactctccacagtgggtaactacagttataacagttataagaggttcttatcactccacagtttctttttttttttttgatggtcttgctctgttgcccaggcttgagtgtggtggcgcaatctcggctcactgtaacctccatctcccaggttcaagcagttctcctgcctcagcctcccgagtagctgagattacaggcgtacaccaccgtgcccagctaattttagtatttttagtagagatggtttctccacgttggccaggctgatctcaaactcctgacctcaggtgattcacctgcctcggcctccgaaagtgctgggattgcaggtgtgaacctccaagcccagcctccacagtttccttatgcatatttaagcaaatataaatgggattttctctttttttaaagacagtaatattcacacttttctccacttttagattttgtttaatgtgtccaggagattttcgtatcagtacacagaaagcatcgcgccccccctcccgtgtccccacccccagttacttagtttgtgtggatgtaccataacttaagtagtctcttgatggatattcggtttatttctagtcattttcgggttcaaacagtgctgtaaatgaataatcttgtacgtataatttgcccaagtatgtctgtgggatacatttctacatataaaattgtcaggtcaaatgatatgcacgtttaacattttgctagatgatgccaagtgaccaccatagtggtgattgtactaattttgcattcttattagcaatgtataatgatcctgtggaaaaagagtttatcagggttgctttagcagtgaacctacattttattgcccatgtcctctgaaatgtttattagataatgtcctcatcagttttcagtcactatgtgaaaatgtcagatttctgtcatccacatggaaacaagttaaattcttttcattgttacctttttcttctagtattttacctttcttctttcactcacagccaaacttataaaaataataagctgtccttgtttctaattttcatctttcatgtgcttttcaactgattacaatatgtttctactcatgctactacattaagatagctctaagattgacagcgacttctcaattgataaatgagatggatatttaaaacttatctaaaccctgtggtcttcaaaactgttgatgacatcttcccggaaactcactcagctttctagcgacatcactttcacttgatttttcttatctgacttttctcattttctttcctgttcacattctccttgggtgatctcatccattttccattgtttcagttaccatctgtatgcggataacttctgaatgtgtatacttctagtttaaaatctggggtatctaactgccactagccaactaggatatctcccaggctgcttaaccttgtcaactgcccaaactgagctaattattttcttttgctattcccctcccaaagccactgcctcctgtcttctctgtctcggtgaagggcacatttggccctctgtatctgtaggtttcacatctgtatattcaattaaccttggattgaaaatattaaaaagcttgaggccaggaatttgagaccagcctgggcaacatagggagacctcatctctacaaaaaaatttaaaaaattagctgggcatggtggcatgtgcctgtgatcccagctcctcgggatactgaggtgggaggactgcttgagccctaagaatttgaggctacagtgagctgtgatcacaccactgcacttcagcctgggtaacagcaaggccctgtctcaaaaaacaaaaaagagaatattaaaaaaaaattgcgtccttgtaaaaatgtacagactttttttttcttgccattattccataaacattacaagtaaataattatttatatagcatttacattgtattaggtattataaataatctagagataatttaaaagatacaggaggatgtgtgcctagggtatataacagtgccatttcatgtcagggacttaagcatctgtgtttggtatctatgggaggtcctgaaaccagtctccaatggacactgaggtacaactgttgtaccctctgttgttgaaaccgaaagcctgggcatcatttttgactcctctctttcacctctatatctaatcagtcaccaagccctgttggttctgtctcctaaatatgtcaaatctggccacttctctatcccctccaccatcattctagttcatgttgctgccatcccttgcctagattactcctaactgatttgtatacttccaatccactctccacactggccatagggatctttcagaaatgaaaatctgacctagccacaaccctgctaaactcatatctcttggtaaaggccaaactcttcttattccacttccaacttcacaatctgtgcttccgctacattggccttctatcattctttgaatatgccatcctgtcttgcattatggggtcttttgcacaatttgtttttttctatttggtaggattctttcttgactcctacctttgtcccttccttttgcctgattactcctgtttataacacgagatctctgctcaggttttttttttttttttttttttgagatggagtttccctttgtcccccaggctggagtgcagtggtgtgatatcggctcactgcaacctctgcctcccaggttcaagtgattcttcgcctcagcctcctgagtagctgggatttcagggatgcgccaccatgcccttctaatttttgtatttttagtagagacggggttttaccatgctggccaggctgctctcaaactcctggccttgtgatccacctgccttgggttcccaaactgctgggattacaagcgtgagccactgcgcccggccagctttttaaagaaaattttagagacgggggtctcgctttgtggctcaggctggtctcgaactcctgggttcaagtgatcctgctgccttggccttccagtggtgggattactgacatgagccactgcacctggcctctgcccagcttttgggaagtcttccctaaccttttcagatctttgtcaggaatattcatatcactttttttttttttttagacagggtcgcactctcacccaggctggagtgcagtggcgtgatctcggctcattgcaacctccaccttctgggttcaagcgattctcctgcctcagccttcctagtagctgggactacaggcaggtgccaccatgcctggctaatttttgtatttttagtagagatgggttttctccatgttggccaggctggtctcgaactcctggtctcaagtgatctgcctgcctcggcctcctaaagtgttgggattataggtgtgagccagtgcgcccagcctgaaaaaaaatctgataaatggatgagtaaatgagtctccttcatgagttcattttcctttgtatgacttttaaagttgttcccagatatcctgccttcagccttccttgtctgtgtataatctcatttttctcccacccatttgttaatgattccaactatgtacttttttttttcaaattttaaaacgtttattttattgacacataatagatacacatttgttatatgccaatgtatatctattatgtgtcacatgttctttgtctataatgtagactcttcatttgagtttatattcatatatgtgtgcctactagaagtatttgaaggtattgtgatctatagatatctctaaagccgatctcatcattacctctcctttttccaccatcttacttgcttctcctgtatggcagtgatgttaacttttaatctctcatcaaagctagaaatgtctgagctattatacatagctttgtctttcttacccttccctcaggtgtagggattaataattccagtccatttaagaagtatttattaaaaatttattttgtatatgtatcaaattttgaacccagatctcctgaatttcataggctatatatgtgtacattagaataaaagccaaaaatacagcacacttattctttcccttaagaagatgggactaatattagaggaccagtgcacactgatttttttttgaatgcatatttaaattactgttgcataactacgctaaaatttagctacttaaaaaattattttgttatgttcatggatactgtgggttaggattttggacagggcatagcaggcatgacttgcctgtgttccaccgtgactctggttcatttgggaagacattaaggccaagtgttgacagctgggtgagagatgatctgtagtattgactatgtctgacatgagacattagcttaggaggactcaaggactaaaattgctaatggagcatctgtaagtggcctctacttatggttcgggctttctcagtatgtagcagcctcagaatagtgtatgtctttacaaaaaaaattttattttatttttttaaatttttgagacagagtctcgctctgttgcccaggctggagtgcagtggcgcgatctcagctcctgcgaggaggcggaccgcccattccgtgcccggtagccgcgagggaccggtggtagccgcgagggacgggcggcgggctcggtgctgtggcgaggcggggatggcactcccccccgccgccccgtggggcggccccgactttcgggcggtgagtgagaggcgggccctgcaacctctgtctcctgggttcaagcaattctcttgcctcagcctcctgagtagctgggattacaggcatgtgccaccctgcctggctaatttttgtcttttttagtagagacagggttttgccatattggcctggctggtctcgaactcctgacctcaggtgatccaccgaccttggcctcccaaagtgctaggattacaggcctgagccaccccta

SEQ ID NO: 12516 - DNA, 9432 bp, Human
ggcatggtgatgggcgcctgtagtcccagctacttgggaggctgaggcaggagaattggttgaacctgggaagtggaggttgcagtgagccaagactgagccactgcactccagcctgggtgacagaatgagactctgtctccgaaaaaaaaaaaaaaaaaaaaagatgactttgtaggtgacccaagcattatttatatgagtcctggcccccaattagccatgggaaacacaagctggaaagtgaaggctagctgaaaacgtggaaggagaaagagaggtcagaaggtcagctttcattcagggccacatgggacagagactagaaggggcccaagatctcaatcaaaagccaaattggggtggccaagtcccgtttcattgagaatctaggggagtctgcccagggcaagggccaagacaaggcaggtatctattatgaactggaccactggagggatctgtagacacaacaggatttgagacactttgcattgtgggggtcccaaggggtgcctcttcccctgccccaatgagtatttgtctcactgggccatccctcagggggactgggcaaaggtccctttccagtttgctagcagaactgtgatggtggtggtgaaacaaaccacaggtagaggcctggggattacttctgagctcccttcctcactgtcccctagcactgaaggctcttcctgacaagcacccaccgggagtgtgtgtgctcagagcacagagagtcctggagtcaagtcactcatcaggtgcctctgctggccagctgctggctccccaccttgtgtggaggtgtcctccctctctccactccccagctgggatggcagggccgtcccctgctctctctgaatctccttcctcagccaaacacattttcctctcttgaaggaagatggttaggggcaggaccagctacctaatttgcaggacctattgcaaatgaaaatgtaaagcccctggctcagaaattaagaatttccagacagctgcagcagagcattaagccaaacatgggacctttctgagggtggagttgtatgcacacacccacagagctagcctggggtagggaattcttttagctgtgcacagaagcctgcagcccaagggccctaattacactttgcagcagggctgtcttttactgttataagacattctgtgggagttgttcagacctgctgctatcaacacacccacagcatccttctctccactcctagcctctactgccctctgcttcttgaagggggctctgggcagccctgaaaatcacacagactggtggttctcagtgatgcatcagaatctcctggaggtgaaatacagattgctgggccccatccccagactttccgactcagtaagtctggggtgggcctgaaaatctgcatatctaacaagttcccaggggatgctgatgatccagggaccacgctttgaggccactgatgtaaagaactagagcattcagcccaggtgaacccggtcaccagagggctcgtcaggccacatcagggctggttctgacctgctctgaggctggctgccccttacccaagggatcgtgcagccctgaatcctcccactgctgatttcctgtctgtcttttcagtgtggtgaaccaggaggaaaagtcatttgccatcggggtgcagttcttgttgatgcgcttgctgggtaagtgtctaagacccctcttcccaagaagtggccccaggcgatggggcatctgaaggctatgggtgcagggtagcgatggaggaagcaccatctcatctccatggcgaagagaagctgtgcataatcaacagcagatgccaaaatccatgtggacggtttcccagattgcttgaggttaggaaagactccatctatggcattcattcctaactaagttatgtaagaaaaatgaaaagtgaacacagctgagaatacctaatagagtgttaaaggcaggtatttttaaatccttctcacaaaactcactgtaggaacaaaactttgcattcctgccaagccagagcagcggctgagcccagccctggcttcctttccattttacaaaattcactcctcctaaaactatttagcaaaagtttcttccctgtggggtcctctgctggtgagtcctgcctgccctcaagcagtccagagcccaccagaggaatggagctgtgcacaagtgatcagcagtgccccaggggagagcgagctgcttgaggcagcaggagtgctctcccggggtgcctgggctgagggctgggggcacaatgcaggcccattcctgaactgctcacactggctgttccttcttgacatatctgtgcactagacttaacacaaggcagcaatagagagatccttgtaatgacaggcacacagtagtaaagggacctaattgaactgaggatgtgttaattaagggtgcaaactacagaggggaatatggagactccagcaagaggaacttcagttactataaggtgtcgtttctgactataaatcctgaaataatggatagcccactgtgcctcattacccaggggccaggtcaacaccgcgccctgcagtggcttccatccccattttgagatgtattggtgatgtctctactggggccaggtgagcgggagcccttgctgagcccaatccagtcccaggctgggagaagtgtttggatgatgggaatgaaccagctttttcagtgggatttcttgttcctctagtccctgcagagccccttcagaccctgctcctgctgcctgcattataaacacagaggaagcagggcggcaggatctacctgtcctcccagcagaggctctgctgtcatcagagctccttattttcatttataacttaactttctctaacacttctgctgggaaagagacctcacattcctctcagcccatccagcacctaggataggctctaaagagccctttcctgcttcctccagcaaccttgaaaatgaccttgaaaacaaggactctctcggactctctcgcactgcttgaagcactcgctgcttttgcttttccatttgagctcagataactcaatgtgggaccacaatgagaaaacccaggcctggaggggttccatttatcacccaagaacacaatccactcttgggtaaaaaaaaggacttcctattacaggttttaaattacacattgggattgggttgacaatgtttccggactttgcttctacataaggaagtgtcatatatcactctggccagttttcatccccctgttcacctggagacttgagagtgagcaggatctgagtagagaggcttcttcttagagtttcccacttgtgggcagtgccacaagtggagcattgtctgtctttcttctggaagcagctgctcacagggccctaaacaaagtctgggaggctgttgtcagcactgtggtgctgagaatgggatgggccagccttggtgtaaatcctggacaagccctccgcagtccagtaactgcctagagctgtagctagtggtacgctacccacaggtagtgtggcatccggaatattagacagccaggaaggcatagcccctgccaagccaaatcttaacactcagctgctgggaagttcggggtcccagagcagaagctttgagcagccaggtattgggaggtctgcagaggggtgttgtctaatccaatagggcagcttggtgtggtggaagtacatgggattcgaacctccataaaccagggttccaagtctggccttgacttctcttggctgtgttacagtgtcccagccaagaaccccttcctcttcactaaaaagtgggcacccacacctcggggccagtgtgaggacctgagaagtcgatgcctggagagcctcctgccacacagtggaggcccgtgtatctccactctgagctgatctcaggagaactatgttggatgtctgagccggcatcaaggtgatccctgtgacttactctgacttgaaagaatggcccaggtcccttttgtcttctaagccttctggtgaaagagaaattcaggcttcactgaaagctattctgctttccagagtcactgtgagtcctatgggtacggcagagccgttctcatgtatgtgaactgtgtcggggacttggctcccacacccctgctggacacctctgcctgcagttccacctgaccagggctttctgaaccctcttccagcctggctgccatctccagccctctatggcctcaccattgaccactcctgcatccggtggaactcgctgtgcttggggaggcgaggggcctgcgcctactatgacaacgatgctctccgagacaggtgagggcccatcatgtatgtgtgtcccagagccaggccctgggcttgagatgacagtagtcatatgcccagtggctactgtgggggctgtcaggcttccaaggaagagaacatgaagggccacctctgcggccctgccatggacagggagcaggggctactataacaggcatttcagggctcacagggagatgtccagggacttccatgacccgaaagcccttggaaggggcagcagacccagggacttccctgacccgaaagcctttggaaggggcagcagcagaaagaaggggcggggatggctggagcccaaggaagaggccatggctgtggaaaaattgggggcagcctcctgctgctcagagacagaggggggccacatcatggctcctggcagaggtccagggcagggggaccaacctgcctcaatgggccaagtccagctgcagtgctattgggttctgcaccccttccagccacctcacctgctgccgttgtcatatggcccagaaaccacaggaaggtgggcttgaggggactgggcaggggctggaaatggtatgggagtggcagagaagaccacaaaagggacaggccaagagggcagtgagaagatgcctctctccttctggctctgcttggaggtcaggaccgtctgggggtggctggggcagctgggtcacctctggccctctggaaagagccagtggagggatgatgagccctggattaagagtcccatgcctactccctgcctgcttccctacagctttgttcccttttgggtcaaagaaatgaggaaagtgatcctcacctggatggtgcccacaccttccgcgggccagcgtgggaatgatgtggttcttcccagtggtcctggccctgggatgtgggctgcagagccccctccctcaccagtcctgcctcctcctgcccacaggtacctgggcctgcagatgggctacaaggcgctgggcatgctgctgctttgcttcatcagctggagggtgaagaagaacaaggagtacaacgtgcagaaggcggcaggcctcatctgaccccaccctgggccactgccctgctccagagagtggaccttgactcttccacacctgcctatactcactaatgttaacacgtcatttcctttttgtatttttaaacaagaaagaaaaccccagtcctcatttgccttccctacctcttcctcccagagtcctccccacagttcctaagggccactgtgtacccgggctgtgtgggccagaactggggggctgagtcttccctggccccttggaagaggcccccagatgcccaggctcacttcagtgttgagtcctccattgaggatgcccactgaggcagccaggcccctcaccagccctggggggaatcctaaacagagagagaaaaagggtatctgcccttcttgccaggcagctccactctcccgctgactgcccacaccctgcagagtggcaggggtgaaaggaagaaggaagtggctgagttattaatagccagagccactgggagactggggagactggctgtaacccccttcacacctgggtttggcatcagcacagactacgggaggggctggctccctccccctcagaccctcacttcctgtacctagaggccattctggatgctgccatgttgggaagtacagtctctgcccattacctgcatgcaggcaccagagcagggactgagaaaccccaaggatgggtcatctaagtgctgtccatatgaaccctggactttctgtccttagatcctcacatgttatccctgtctttctggggtacgtttcaaactgaggaagctacaacacagtgaagacccaaggaaggcctatgaaatggtcctgatgcccaacctcccaccccttcaatgtggggacgagaccccctcatctcagagtaatgggaagaacctcccacatctccctggcagcagatgaggtggcttcacatgcacttccctgtctggacttcagcccgtattccgaggagtagagaggcagaagagatgtcagcaaagcaagtgatgaagcagagtggatgtccactgtcaccaagctggatggcaagctgcggcccacaaaacagccagtcaggttggctttcctggtttcagacatgctcataccattcccattttctcagcctcttctcactgcctccagagaggtgggtgcctgggttgagagacacagctgctacgtgatagatgttgagagacagaagccaacgaaggaggtcattcatcaacaaatatatttattggagaccgactttgtgcaaagcaatgctaatcagggttctccatggagcttccctcagctcttacctcacctccctccatttacattagggccttctcccagggtgtgctcggtgggcagtgtgggactgggggtgtgggagttggtgagagcaggaggagaggtggggacagcaagaagccacagattggcatgaaggatcctgacctgactatccatgccatccatggcccccagactgactctgcacctggccctttgccagacagctctgtctccccatgtcctctggaacagctgggcatgggtcatggccattcatgacccttaagtgccacccttcttggaagaccccctccagaagcatactggaagccacctctggaaaagcctcatatggtgatatgccaaaatatttatgtcaatgtccaaacaaagtccaatgccatgagactgaagtctttgtggaaaccactgttacagacaagcttatttccaaagccacctcatttccaaacatctcactcaggaagggaggctcaatgtaacctcaggggccagttttagcatttgaaatggttctgcttggaaaatgatgccctgcaactaaccctggtctttcccatggcaatttaaccacatttggaaggcactgccttcagctgagtttatgaacaatgaatgccaaccttcaggttctagaagattggttgcactcccaaacctttattctattatattactattaaaatattctaattttgctattgaggtaacttggtcatgaatttatgttgtcatatacatctgtcagagaacagacagcacctgcactttttaattttattttatttttatttgtattttatttttgagatggagtcttgctctgtcacccaggctggagtgcagtggcacaatcttggctcactgcaacctctgcctccttggttcaagcgattctcctgcctcagcctccagagtaactgggattacaggcctgcgccaccacacctggctaatttttgtacttttagtagagacagggtttcaccatgttggccaggctggtctcaaactcctgacctcaagtgatcctcccgcctcagcctcccaaagtgttgggattacaggcatgagccactgcgccctgccggcacctgcatcttgtaaacagaggaagtgctcatgacatagaccccaggggcccatggccatggagattagaggtaatgcaactgtcaacccattagcctggtatcaggcaagtaccagacactgcttattccttcagtgaagttctgctgggctctgagaaggccgcatcactgctcttgggtttatatccagaagcggagctggacgcaaacagctatgtccatggcacaaaacagaattaatatcataatcaaattgatcacatggtcacaaccagtactactactcccaagaaaatctttcttttcagctgtcagcagggaatataatagtgtcactttcatttcacttctagagcaaagcttaacaaactttcttgagtgtgtgacactcacagaggatgcaaattcccaacaccctccacccagccccagcgtctacttctgtgggtctaatggggacccaggaatggctcttttaacggccccctcatgagattgatgtgggtagttcccaaatcctgtgaggtgggctgtcagtgcaatagagcctggggtatgcccatttgtgcttaggccactgagaaatttacaggctcgataggcctttggtatgttcaaaggtgagtgaaggataacaaggtgaagagatgcctgtgaatctgattttttggatggctgcaactaagagtcaatgggcatgaaaaacaatccaagagctcacatttatatgaggcccttatcagtactgagagagacattctcacttcacaagcttggatgtgcaaaaagaaaaaaatcacttatttctttaaatcagttattgatttcaaaccccccatcctactgtctggctggaaattcaatatcaaccatgcttgggtctggctcctagagccatctgaaggtccttggatgcctacgcattcaagggtgccattgtgggtctttggtccctttcccatttgaggctgtttaatggccctgcttctcacctgagcctggaaaccctacaaagccgagaccccagggttaggcccacctccctgtgcacactcgcggctatgccctctcccggccccagtcctaggaagcccactcctctgcaccactccctctccctacagaatcccgctcctcaagggctgaacaaaaaagccggaaaaggaagagtgtgcaggaaccttttttattcaatccttcttttacccttcttggaaaaagcgcaaatacagtgataactaaataccgtatctctatcaattatcctttggcccaaagccctttggggtgatcctccatgatggatgccccatgtaaaggtgaggaatctgatcccgaggaagcaaccattgtggccaatttcacatagataatagctggccaggtctagactcaaaccaggctgtccacttctctctggtccagcccaattgccccagctgagtcattctgaagagtcagcatggactaaaatggtggggaggcccctcttttcccactgatgttcactggcccatgggagggaagtgggggaatctcttgagggccattaaggtgggtaacaaaggcaaaagaaccaggtaacagttcatttacttaccttctattcaacta

SEQ ID NO: 12517 - DNA, 77994 bp, Human
agacatgactctgcatgctaggtgttgagtgcacagtgatagtggtagacaagtattggtttccaaatttgacagttttccaatttggtgtgattaccttaagtccagctataccagagtgttttcttcaaggcttacaatagtgaaagataacaattaaatttttaagagtaattactgtcagtagcagcataaactttcttccctttattcttatgacagcttgagtcttcatcctttaggtcccagtttaaatataatcgggaagacttttcacactaactcatgtaagtgttcctgtcattctgttagttcctcccccttttttttggctagtttttcttgggactttgcatatatacatatttgtttgtttctggtctgttagtcccattagtgtataagctccttgagaggaggttccatgtccagcttattcacaatcgtaccctaggtttccagtataaagcctaacaaacaatgcatttaatcaatgacattcttgacatttttgtgaagagcatttatttgatacttaatttttctttttttttttttgagacagggtcttgctgtgtcacccagggtggagtgtggtggggcagtcatggcttactgcagtctccacccccttggctcaagtgattcttccacctcagcctccttagtagctggaactacaggtgcacaccaccatacccagccaatttttaaaattcttgtagagacagaggtctcactttgttgcccaggctggtctcaaactcctggcctcaagtgattaaatttttaaaataatgtattttttctttatttttccaatttatataaaaatggaaatattttttattattcattaacgttgggtaacactttatataaactttccctttgtgttatatggaagtctaaatttacagaatactttaaaaccccacggcaacacaaaacccacatttgtccgtgttccttccataatttgaaaactttgcctttttcccttacactgacttgaagcctggcagcttgggcctaatttacaaggcactaagtaagtactctcttaaaaaacagagagtgaggatgccctgtttcacaacttaattccaaaaagccaagtcagacgaaatcgacccactttcctgctaagggtttgtcccaagaggcgagctcttctctgtccgctccagccaagctggccgattgcccctgagcactggacacaaccttggtgtcccggtttcgggtcagggttactttccaattgttaggcacgactttgtgcgtgcgtgcgagactgtggactcggaggtgcgcatttggggcgtagccgagccatttaaaccagcgaatccgcgttcaccttgtccttccacctctgccctatctcggcagatgctccacggatttgcacgaactcccgagtcttgacctccctcccctctccgggctgccgggacaactcggggcggccactcttgccaggaggcgtaagtaaggatgaagttggaaaaactgaactaggtctagggcacgctctgcaacacagtcggggagacgcttcagagggccggagagggaggcaagttgccacggcgcgaagggggcgggccggcttgggccgctcgcatttcctgtgacaggggctgccccagcctctccttctcccgcggcggcgggaccatttcctgaatcgctgaagcggagggaggactagggcgcgactctaccattagcgcaaagggccagggggtgcccataaggagagctcgggggatgcagggacggtcaagaaagttcggccagggctaggggtcccccagagtgcgcagaagcgagacatccctggccagagtgcctccttcaggcctgccccgccgcccgtccgcttggccccggagcatcccccctccccgcattcccgaggtggttcagcccgagaggccggcgtctctcccccagtttgccgttcacccggagcgctcgggacttgccgatagtggtgacggcggcaacatgtctgtggctttcgcggccccgaggcagcgaggcaagggggagatcactcccgctgcgattcagaaggtgaaaccgcgcggggttgcggatgccaggcccttaccgcctctgggagagacagacgcggggggaagggccgggcccggagtcgaccgggccgaggcggaggcgggcctgctgggaatcagcagtgtttgggaacacggactgctggctgtgcctgagtgggtggcggaagagggtgaaccggtttttctcggagtctttcacgcatttacgcgtttttctacagacacaaaagcccaaacagccgccgcctgatttctctagggatggggcggcgttcgggctgcggggcgcgtgcgcccggcggcggccgctcagggaagggcgtgtgtcggaccggcggccccgcgcgttgctccggagttactttggcgtcgccccgccccgcgtgccgcggctgcttcgtgcggaccccaccgcgggtcgcggcaggcagaggggaagtcggtgcgctggtcgccgccctgcaaactcagccgagtttgggagctcgcaggaggacttggggaacgctggagggaaccttagtatagagtttgaggagcgggcaaggaaggtccccatggactctggggttgtccccagagcctcttcttcccttctgcatcgccgcctattcatttattctgcagcaaatatttattgagcgcctattttaggcgctgaggctactgtggtgagtcatggtccttgccttcctggagcttacagtctaatggtggagactgtcgtgaccagttaatgtaagtcgtgataaatacacagggagctgcctcctttttaaaggatagagctgctgcagtcgctgctgtgttactgccagtcggaacacaaaggttctttattgtcctctaccccttgttgcctgcaagcaaggcagcattctaaattttactgacctagactttcagaagttgctgctgtatttagcagtttactttaaatatttttgttttgttttatgctgtgtagcaaagatcaaaatagaaaaaaaggtcaagttttagtaccactcagaccacgtagattatgctaatcggtttctgtttactgtcaggttcttcgtagtgtggcttttgacatttgcccaactgttgctttattttatgaacaaacgggcttggcagtgcctggaaatgcagtgctttcatatagtgctctgagttaagtctgcagcctggcaaacagctccaagtacgcactcacgcaaaactgcgtttctggagggctcaccttttttatttttgtacacaggaaaagtccagagtttttcttttttttttatagtttctgttacataagtctgaagatatttatcatggataatgattaattcggaggatgctgatcaattattttccattctcagctgaacagaaaaatgggctctaaattaattgccttattctacaatgggagagattgatattagatgtgagacagatattttaatggtgaagttcaatagtttgaggaatatactggagataataagttgtgaaatcattaggttgaggactggattcgtgctttttaaggactttttttggtcatccaatggttctatttaagaaataactgcatttattagcagatcatgttagtggttttttttttcccccagtaagtgaagattatgattcacgtgcataaaaaagtgacagttaatgttaaatggatgttccttttatttagattgcgtgattatggtattgtgctaatacttttgaatactggtagggtggggcaggttctggaggagcatatcctgagtcccttgatcttacagctgaatcagcccctgaaaacttaagtgacttgctcaaaatggcaaaactggcactgaaactaactggccttttaattgctacaatcagtactctttcttcagctccactttacttagatgaattatttaaccctcaaagccaagattgcttggaatgttaaaagatgatagaatgataaatcggtatgtttttcctcttaaacttttgagacagcataattatgaagtaaactcataaagtctgtaacaaatatacatgcatagaaattattatgtttaattattatctcataattggagagtcacaaaaccatgctgttataaaacttggaaactaaccagctacctcatcaagactcctgggctgaagttttcatgtatttatttcattctggagaaggacagaatttttctttactgttccaaagcattagaatgatgaaaaaccaactcggactcttaacttttagtcttaattggctaaagcttctattacagatagcagaggtaattaaatgtttgatataaaagaattcagattttcccttctgggcttgtttattcagagggagaataattggaatattaaaacattattgattaaacacgatatcattccaaaggtgtaaaagtaagatttttttgcggtgagctgtcatatatattaaaaggacccaaggggattcaatttctgtatagatgaaacatttctagaaatctgaagggaaaaaactcagttattgaaaagattgtccgtatgaactgtgcatggcatatttttacaagagatttaaacagtacgtaatgaaattttatgcaagagagctgctgatacactaatgttgctttaaattatatttgttattaaaatgaattttaaaataatttgtaacagcgggtagcaacattaacaaagtcattttaaggaaattttgttttttttgtgtttccatgtttgcttaatgatttatgatagtaatgattgtttgcaggggacagtattttgttaagggatacgctttagagttcttgtacaagcagtatttactaatgccctccctttctgaattttctagttttttattttacttgatgcactagttttatgctaaaccttttctaattctgtttcagatgttggatgacaataaccatcttattcagtgtataatggactctcagaataaaggaaagacctcagagtgttctcagtaagattgataagaaactttttttttattcagttttttgtattggttaattttttactttttactaacagctttattgagatataattcacataccatacaattcacctattttaatgtgtacaattcaatgttttttagtatattcatagagttgtgctggtattacgtgagtcagttttacagcatctttaacatccccaaaagacactgggtatcctttggcagtcactatcccccacccctcaacccgtgacaaccactaatctactctctgtgtgaatttgcctgttgtgacatttcatataaatggattgatatactatgtggtcggttttgactcacatttttcacttagtgtaatacttccgaggttcatccatgttgaaccatgtttcagtacctcattcctttttataggcaagtatttttttccgttatgcagctgtaccacattttatttatccatcggtgatggccatttgtgttgtttgtacttttgactaattttgaataatactgctatgaacatttgtgtacaagcttttgtatgacttgttaatttataaaagaaaactttctttgggaggagattgggtatcacttcgtttcttatacttcttaccctgcattatacaataatgacttcaaatatatgtatagtcttatctgtgggaaagttagatcttcatttatatagggtattgagttgcatccatgtatgtggtgaaaacaaagcttatatctaataaatagagaactgattgtcattcataagggccaaactttcttactttgaagtgatgtatctgaagtaaataatatgccctaatagaatctgatgtggtagaataagttgaatatattatcaaaagtaattagaatagaacagcactgtccattagaaatataaatgggagccacatgtgtgattttaaattttctagtagacacagtaaatgagtaaaaagcagatgacattagtattagtaatacattttatttaacctattatttccaaaatagtatcatttcaatatacaattagcataaagatattgagatatattgcattcttttctttgttgttctaaatcttggaaacctattgtgtatcttgctttaataacacatctcattttggattagccatattttactgtgtgtagtggctgctatattggtcaacacagctgtagaatacagttgacccttggtagccatggtgaatcgattccaggactccccatggataccaaagtcccagatgcccgtgtccctgatataaaatggtgtaggatttgcatatcacctactcacgtcctcctgtaaactttaaatattctctagattgctcataatacctaatacaatgtaaatacttgttatactatattgtttagggaataataagaaaaaagcctacatgttcagtaacaaccatccatttttttttttcagaatattttcaatgcatggttggttaaaggatgtggaatctgtggatactgagggctgactattttattctcacccttgttttgggatgcatctgtctttcctagagacttcactggtgtatcctcaggcagataattcccaccaaccttggcccttgctttgtttggttttcacattgtattggtctcttgctgtcatttgatttaccctctatttaattccaagtttccattactttttcccctttgtttaaaagtatttttaaatgtaaaaagtcatatatggttatcataaaaaaaattataaagtataagtttgtggagataagtcaccttttacatgccactgtcttatctccttcccctccataggggtaactgcttctagtgctttagtatgtatccttccaaacatttttctgtgtatttacatatatgcattcatatttatgcatacacgtttatagatattgttgtttttaatatttatgtaggttcagttttagaaatggaattactgggttaaagaccatactaagttgccaaattagccagcaaaaagattgtattggtttgctttctcccagccaggtttttagagtcctagctttcagctacccctgtgagcagtagatattagacatctttaaaatatttttgcatatccagttgctgaaaagtggtgtcttaaagaactttttgttttggccaggcacgatggttcatgcctgaaatcccagcactttgggaggctgaggtgggaggattgctttgacgacatgagtttgagaacagcctgggcaacagtgataactgtttctacttaacgccgccaacaagaaaaaacaaaaagcctttttgttttgaaataatttcacacttacaaaaatgtttcaaagatagtacaaagaattcctgtatgtgctgcattgaatttttcaaacgattacatagcccacttggttttttattcatttctcccccatattgttttttagaaacatttgagagtaattgcagatatgaatccctcttacttttaataacctcagtgtgtatttcctaaaaacaagcacatattcttaaattaccagagtataattgttaaaatcaagaatgcaatactattatctaatatttagggcttttttgaattttgccagttgtcctattagtgcatattttctggtccagggtccagtacaggatctggtgttgtatttgtcttgtctcctaagtatactttaatctgggggtcttttaaaaatattccatgattttgacattattgaatagtatagaccagtagttttgtggaatgtccctcatttaggatatgactggtgtttcccatgattaaattcacactatacacttttagcagaagtaccactgacgtgatattgtgtccttcacagtgcatcctcagtagccatatgttagtagtttgtcccaatattggtgataactttgatgacttagttaaggtggtatcttaactaaggtggtatcataactttatggtttgttcaccataaagttgctatttcttgtaattcatatgtatctaataccttgaggcacatttacattgtttctcatcatacttcaacacactaattttagcatccactaaaaatccaatgatttgcctaaaatagttatcactttaagtggttaccaaatgatgactaaatctatcattccttttacttttacttaagtcctactgtgaggaagaaatttgttcttttcctattccttcattcttcacttatttatctctaaatggacttaaacattattactgtattctctaggttataatctcttactttattatttattttctttaattcttccagatctggccagtgggagcccctcaagctggcttcttgatatgtcttcattattttttgaacatttacttattttcttataccacaaaatgttctaggctcatcctggtttttttttcctgtgcaggtgggtagtcacccgtttctccaagccctggttctttttttggagaatgatgtttagaaactaagatctgagtgctaggttatcttactgttcaatctcttgtatgttttgcattttatatgattgtttccattacatatattattgcttagatgaatcttgtgcatatatttgagaatgttctttaaaaaattaactagctgatctacttctttggtttaactgtggatagtaaggagatcaattcctcaagtcagccatggaatgttaaagcttagaggcacttattagaatacaatcatgcgctacctaatgctcttttggtcaacaatagaccgaaagattataataccatatttgtactataatacccataagattataataccatcttcctactgcaccttttctatttggataattgtagataaacaaatacttaccattcagttcagtacagccaacagtattcagtatagtaaaaggcttttcaggtttgtagcctaggagcaataagctatactgtatagcctaggtgtgtagtaagctataccatctaggtttgtgtgagtactcttgatgatgtttgcacaacaacgatgaaatcacctaacaacacatttatcagaatgtatccccattgttaagtgatgaataactgaaattatttttgcctttggtttttaagaactccacacagagccaagggtagtatatgtcacggatagtgtatgtttaggtctagaaccaactgagtcagcaaaattttcaactttttcagatatatatatatgatcatttccctcattctctacatattggattagatctcattttctcacatatacttggtgaacaatttaagcaaatagggcttaaactgacttagggagaatcttaaattctgccgtttttggtggatttaattttattcttttgttcttcagatattctttctttctcaagttgtcagtattggtttgtgaataaagagaaaaacaactcctcctctcgaccttaacaggtgttcttgtttctcattgtaggagaagcaaaaggaaaataaagagaaacgttaatacatgacagccatctgggaattgatactccaattttaaattaacaactccttaagatgtgataactttgcctgaaactgtgtttttttttaaattaaaaataactatgtattttatgaaagcagtatgtgcaaattagaaaacaaaaatgtgtaaaaataagagaatgaataccatattcttactacccaaagacttttcagtggtagtacctttgtgtatgttgctttatcaacgctctctgcagacacacacaaattcaaatattacactcatgagtcagtggtctgaatcacttgtggagcgcatgtgcctggaccatcttcctttaaattctggtaacacacgtgagaatgtgttactgattcactgtgatgtttaatttgagcattttctaaatcaacctatgtttgcttaaatcatttcttattttttgcattttagggtgagtccaaactattccagagttgcataaatttcaaacaacaaaaaaaattagtgtcgatcattcatcgtaatttaaaagagttgtttaaatctgtagtttggaagataacttctattctataaagtgcattcccgttgtctaataaatattcatagcttctaggtaaggtttattttataaaatgaaattacttccagcttaattttgtaattatgtcaacaaatagagtgtccattttactttattcaaagtaattgatgagttactcttagtggcctctgtgggaggtgaactggctcttttaataggttaataatcatgagtatttgagaatatttgtcatatttaccaggacagtaccatcatcaaaaataaaatactaaatatattttataacagcccttagcttatatactcctttttttcctcatatcaacatatactctttttttttgttttgtttttcaagacataatctcactcttttgcccaggctggagtgcaagtggtatgataatggctcactgcagcctcaacctcctgttctcaagtgatcctcccaccttagcctcctaagtagcagggactacaggtgcgtgccaccatgctcagctaatttttcactttttcgtagggatagggtctcactttgttgcccaggcttgtcttgaactcctaggcttaagcgatcctcctgcctcagcctcccaaagtgctgggattacaggtgtgagccactgtgcccagcacaacatatactgttttaggaataaaacattaagaaagtaaactgtttcagtgagaaacgtaactatatatagaataaaaatattcaaagtttctgaggaaaatatatttaatatcatttttattatcatttcaatattgtcacctgagtccagattctcctagagtatttgctgattgctttttaggtgacctatatacaaagttataaaataatatgagtatttactacttttttgttaatgttcatctttgaaccttgagtcatcttagaatatgtttaattgggctgagtgtggtgactcacgcctgtaatcccagcactttgagaggccgaggcgggcagatcacctgagatcaggagttcaagaccagcctggccaacatggtgaaaccccatctctactaaaagtacaaaaattggctggacgtggtggtggatacctgtaatcccaactgcttgggaggctgaggcaggagaatcacttgaacctgggaggcggagattacaagtgagccaagatcgcaccactgcactccagcctagctgacagtgagattctgtctcaaaagaaaaaagaatatacttatttgatgaatgctataaaataatgcaattttacagaaaataaacatactgaagttagaaaaggccaattaaaattttttttttttttttttttttttttgagacggagtctcgctctgtcgcccaggccggactgcggactgaaaatttttcatttttacctacctccttatacgagggaaaatgatttggaggtattagggcaattggagaaatttgaatgagttctgtggattaaatagtaatgatatatcaatgttaatttccccatgatggttgtcctgttatatgagggaatagccttgttttggaaagccagtactgaagtattaggagtaatgtattactgactcacaaatggttttggaaaaaagtgagtgcatatgtatgtctgtgtgtgttggtgtgtgtatttagagatgataggaaaaatgtggtaaaatactaatcattagagaatctgggagaaaaaatatacaagactttgctattgaaacttttctgtaagtttaaaattatttcacaattaaaaattgaaaagatttgacagttgagagaaggttgggcaaatgtcttaaaatgaaactacttcataaaagatcctgggtttatagattttaaaactgcaggcaacttcagtgtcctgctttaactccattattttacatatgagaccttaagagtgtggcagattagatgtaatactagtttcacactggctttgtcaagtactaatcaacatgatactaaaattttttcttaaagggtcatgaataaaccacatctgttagtatggtttggtcagtggtcctcagaaaatctcatgtcgtgcaaccatactaatactcaagcaaaggaaaacttgaaggcctagactgaaacaggttatgtgttctaattaaaaatggctggttggttttttaaaaaatggcaagatatggaacactatattttaagttccttcctagatctctacagaataatgaaatagttccagctagtggtccctgttagtgctgcttgaagaatttcaacaacacaattaaccattatgtataatttagtacaatataattattactttgtccatttagtgtaaagttcactatcaaagatgtatcatgtctcattgggcaacatagtgtccatgtgacgcaaagcattaaaagcatggccttgtttgtgaaagcgttattttaaggtcagcaagaaatagtgttttttcctttcttattaaaaaaaaaaaagctgtgaaacctgttgtttgtaacaggagaaaaataagtagcaaagaatatgctaggattcggctgggtacagtggctcacgcctgtaatcccagcactttgagagtctgaggctggctgattgcttgagctcaggagtttgagagcagcctgggcaacatggtgaaaccctgtctattaaaaatgcaaaatttagcaccgtgtggtggtatgtgcctgtgggcccagctacttgggaggctgaggtgggaggattgcttgagcccaggagatcaaggctgcagtgagccatgattacgccactgcacgctccagcctgggtgacagagtgagaccttgtctcaaaaaaacaaacaaaaccaaaaacgaacaaaagaaaaactcggattccttttatggtgtctattttagaaaatgaattaatttggaatctgaattagagaactttagctgaaaaaacttatttttattattttaatttgtatttagcatttttagtaaatgaaattttaagaaagcctaacaatttgatgcaggttttaagtttgtactcatggggcttgtatggctgcactgagacaaaacactagtgattggatcactgctaattttaatatggctttgtcagttaatttgttaaaattgtgaagagaagcttagctaaactaattcataggtaagattacaataagcatgtttaaccacgtaatgctgataatgaatttgctttattttcttaaagttaatcttgagtgttgttggtgttataacatttcttccatcttttgttttagcatatctctttttttctgtagttggagattgcctattcattgccttctctatatgctgtgtcctgatagatgggtagtataaacacagtgggcctaagttgttggtcattgctacagtagtgaaaaggaaaaaaaggtgtggttcccacctcctttcctaaattttagcagaacatattgactgtacttgggtttgaggtttttagcaaaatgaaaatggcagaaggaaagggataagcatatttcttttttttctttttgagatggagtctcactctgttgcccaggctggagtgcagtggcatgatctcggctcactgcaacctctgcctcctgggttcaggcagttgtcctgcctcagcctcctgagtagctggaattacaggcgtgtgccaccatgcccagctaatttttgtatttttaggagagacgggggtttcaccgtgttggccaggctggtcttgaactcctgacctcaagtgatctgcccaccttgggctcctaaagggctgggattacaggtgtgagccactgtgcccagctgagataagcacatttcactggattcctttatttagttctttttaaaaaaactcagtgtactagtatgggcctattacatatgtcagttattccatctactagctatgcaatcatgtacaagttatcaacctctctaaacattagtttctcatctgtaaaatggagaaaagagctcctgcctcgtagtattggtttgtggattgaaacatatatgcatataaaaaattataacactatttagcatacatggcaagatctctgagctcattatatttaaatatttattatttggaacttttgcagtgtaggaaaaattgaagtgctattgatgttcgggtaacaaatttttaatgaaactttagaaatgattatagtgctgtttgtacttaggcaggtaggaagaaaattattttttaatactgatacttgttttgttttaataggtatcagcagatgttgcacacaaacttggtataccttgctacaatagcagattctaatcaaaatatgcagtctcttttaccagcagtaagtatctttaaaatcatgtgaagtagacaatctttatagttacatatggtatggcacatttttgttgaatgatttttaagttttgtttagtaaatcctgctttactctgagaacatgaaagtattctatgttatctaaaagctttgttttgcttttatatttaatttgaattcacctaaaattgattctgtccctgagaaggttatattcgtttacctgtttacctacctacctattttaatttttaattgcacaagtaatttgttaatctgaaatgtttcacagcaagtcccagacatcttacagtttgaccagtaaatactgtatttccatatgcatctctgtcagacaggactattctcatacccaactaagttaaccataatttctttctgtcttaaaatattcaatttattttcaatttttatccgttatctaaaacaaacctaaatgttttacacgtgatcttagccaaaaggccgagcagcgattaaaaactctaaatttttaaacagttgtttgcctcagaatccaaacaaggtacacgtagtgcattggttgatatgtgtcttagtctcttttaatctgtatcattttatctttttaaatcttcatttatttgttaaaggaactgggtcatatattgtgtagaatttttaacattctgcatttggctaattgtattctcatggtcctttaacgtgttcctttgtttctcttatttcatgtaaactggtaattagagaggcttaattagtgaggtttagatttttggtaagagtattttgttggcggtgctttgtatttcccataatatcagatcaggaagaacatgtttggttgttccatttttagtaatgttaagattgatcaatgggtatacttgataccagcctgatcaatccattataaagttccctgtctacctatcacttaatggttttaatggtcattgatgcttgtggaccagatcctgtatttcactttgggatcacagaatggtgaatttctaattctataatccctcttgcatttattagctgtaattattttaaaaagataaacttcctttcattaaatatttggttatcctgaaactagagagtccccataggaaagtcatgataaatgcttgattctgtccctttatcaattttcagaatgagttggtctctagcaacctgtgtaggttaccattttaatatttttgtttttattatctgaatttaatacatttttggatttttaatgtttaaatcccttgcagtcattctttgttatgttgaaattttgtttctctgatcaatggaagcctcttcatttggctcctgtgttcctctgacatgactcaagtatttcatagcttctttgtttttgtgatttgctgtatgctactttatataaaacatataacaatgtaatggtaccaaaactaacactaacaataagatgcttgtccctaagatacatcccactggggatattttaatcagtatatttagttttgaagttgaaatagttcttcatgtggcagttgtcatcaacttgactaccagctaggtagaatttattttcgtgaataatgtgaggaataggttcagtttcatttgtttccatgtggatggttttttgtcccattattatttcttggaaaaacaagatattttgtcatgcaatctatgttgtatcaggtgtccgtttatatgtgggtctgtgtctgatctgtttatatcgtttccttggtctgtttttatgaattccactctcttgttatacttaatcttattccttttttttttttccaagaatatcttggctgttggttctttgcatttccatatacacttaaacatcagtatgtcaggttatatacacatatacgtaatcctgtagggattttcattcagattaccttgactgtaaatcaatttgggaagacttgatatctttacaaaattgagttttccaaatcgtgagcattgcatatattttcatttatttagttctttaatgtctgtcaatgaagttttatgatttttccctgtagatggtttgcacatctctcattgggcttattgctagatatttaatactttatattttttgaggccattttaaatcgaatctttgtcttttaagttttattttctagctgcatttgctgtttacatggaaatgcaattaatttgaatctcacattcttgttcagctcttgcttctgagtttttctgtagatgctttcagttttctgtattcatgatcatatcatttgtgaataatcagttttgtttctttcttgtcaatccttacaccttttatttctttttcttgccttacttctctggctatgacctccattacattcctgaatagaagtggtgatagaggacatccttgtcttgttcctgatctcaaagggaaagctttcactgtttgaccattaagtatgatgtttgctgtagtgtttcatagataacttgtcagattaaggaagctcctttctgtttctgatgtgctaagtaaaaatttatatgttgaatggatgttaaattttatcaagtacttttattgcatcgaatgagatgattataagactttttcttctttaatctgttaatgtggtaaaatatactgatatacttttaatgctcagtcagtcttgcattcttgtaattaacctacttgttgatgacccacttggtcatgatgtttttaaagaaattgcgatattcagtttgttaaaattttggttaggatttttgcatctttgtttgtgagtgtgattgacctgtaatttttctttcttataatgccttcgtctggtttttattttgaggctatgctagctttataaaaggagctggagaattttctactttttcttatccagaagaatttacataatatttctatttctttgttaaatgattggtacaattctttagaaaagccatctgaatctgaagttttctttgcaaggaagtttttatttacttacttctttaattgttataggacaatttctatattttataaattgcctattttggtaagttgtggtttttagcattttaataaatttgaacattaattagcatgaaaataaagtaaaagctcttgaaataatcttattttcctaatgtcaacactgtctgtagtgataattttctttttaatgtcattatttgtgacttctgctttgaaatattttttgatcattcttgccagatgtttattatgggttttttaagtcttttcaaagaatcaacttttggttttgattgtgctctgttgcagcatttttcaaaccttttggtctcagaaccctgttacattcttaaaaattactgaggacttaaaagaacttgatgtaggttatattgttaatataaattataaatttttctcagttgtgaaattaaaacaaatctaaaaaatttgttaaaaataataaacttattgcatgttaatataaataacattctttaaaggaaaaataactatctttgtgagatgaatggcatcatgttacgtttttgcaagtttctgttaaatgtctggcttaatagaagacactatattttcacatctacttctgcattcagtctattgtagtatcttgtttcggttgtagcagaaaatgcagtctcacacagacatgtagttagaaaggggaagaatattttaatagccttttcagatttttggggataaccttgtttgatattacagcagaactcagtaagtttttttttttttttaaggttagttgtggtgtggaatcttaaattgtatcattacatttttcttactctggtacatttaagcccattggtctttattacactttgaatagatttttactcatgtataattttataacatcatgctttggtgatttggaaagtataagtttactgagttaaacagttcttccaaacattaacatttttctgtgtgataccaaagactacattggttaaaatcacctctaatctcatcagaaaagtgcctaagtatggggatgctgtcaagctcaaggtcgtagataagtttgcacattccaagttcttgcttggaaattcaaatgtgatcttggcaacaaatgttattagttgattttcttgctcactatgtttgtttttgagaaaatgtctgccaaatacccatgcctagataaatacagttaacaattgttctttcaagtaaaaatggtattcagtgaaaacggtgcctagttcagctggcaactcaatcacaaactgctttttcttgattattttactttgtgacagataatgtttattattttcccattttgtcactgaatatttatttacaagacatggagaatttacaaaataatttttactgcttcatcaagcacatttttaactgaaactatctttttctttcttcaactgcaagtgtgtggcagccagtaatacattgactaataatagtttgatgtcattgccttgattcataatgaggttccagcaattatatccactattgcttttgtaccatcattataaatgtgcacttagcataaaaggcaaacatcatcttatggaaatagttttgcccttgggcacctcatgtatgtttttgtttatgattaatttctgatctttatgattttctcccttttactttcttttggtatatttttttctgttcttctgagttttagatgaatgcctctttcatcaattttcacctttctaaggatgcatttaaaatggacataagttttcctctaatcatagttctgatatgtagtatattcatatttatttaattccaaatattttctaattttcataattattttttaatgcattggttgataaaaatacatttcttaatttccaaacatggatattttattttcttgatttctggctttattgcattgtggttaaataacattttacgatttgagttctttggaattccttgagatttgtttcaaggtccagcatatggtcagtttttacagatgtttcatgtgtatttaaaaaaaatatgtattgtttagccactgagagcagagttctatatatgtctattaggttaggtcaagtgtgttaatcttgtttgaatcctctgtagccttaatgattgttgtttttttagtctttccaatgttttgtttgtttgttctatcgattactgagagatgtatgtttaaaatgtacaagtcaaattgtggactgactgattttccttttagctcttttaaggttttttttttttttttttttttttttgagacggagtctcgctctgttgcccaggctggagtgcagtggtgtgatctcggctcactgcaagctcctcctcttgggttcacaccattcttctacttcagcctccctagtagctgggactacaggcgcccgccactacgcctggctaattttttgtatttttaacagagaaggggtttcaccttgtcagccaggatggtctcgatctcctgacctcgtgatccgtctgccttggcctcccaaagtgctgcgcgccgcctgcaacatcattgtgaattatcccttcttatctttagtaatgcttttaaagtctactttatctgatattagcatagctaaataagctttctttggtgtttgcatggtattatcctcctttctgttttcttgtgttagagataacgatattatgagtaggatgtagatttttttttttttttttaactcagtctagcaatcaaagtgctgggattacaggtgtgagccactgtgcccggccaataattaatttgttttttattattccttttttttctttctagttgggaaatcttacatatttactattcttttagtggttactgtatagattataatatacatcccaatcaaaggaccataaaatacttcatttctgttccttccctcaatgaccttttcgttgttgttgtaatgtattttaagtctctatatgtttccacaagtggttgttattactgtcttttttttgaagtcagtgttcattagatcatccacatagttacttaccatttctgatgctttctgttcctcctttcatttatgaccttctagcttagatcactttttttttcacctcctaaagaacattccttagtatttcctttagcactgctttgctggtgagacataccttcagtatttttgttttgttttggtctgggtctgaaaatgcctttatttcaccatcattcttttttttttcctctggagacagtgtttcactccgtcacccaggccagagcataggggcatgatcatagctcactgcagcttcgaacttttgggctcaagaaatcttcctgccatagcctcctgagaagctaggaccacaggcatacaccatcatgcctggctgatttttgtattttttggagaaatggggtcttatatcgcccgggctagtcttaaactcctggcctcgagtgattctcctgccttggcctcccaaagttctgggattgtaggcatgagccaccacacctggctcaccatgattcttagaagatattttccaaggacagatactaggttagttgttgtttacttagcacattacatttatccttgcgttgttttctgtcttgtatctattgaaaattcagatatcaatgtaattgttgatattttgaacataatctgcttatttgactgcatttaagagttttgctttgtctaggatttttagtggttttagtatgtttaggtgtggatttctgttttcttaaatttattttttctcacactgtagttagatattggaagatttctttctaattatcttgcttggtgcctgttgggatttctgacatctgtaggttcatgtctttcatcagttttgggagttttcagtcattatctcttcaagcaaataattcttccataagactccagttaaacttagactagaccttgtaactgtatctttatgtttcttaatcccttcagacttttccaaccatttatcattctaagtatatttttttctgaccagttttccagttcatttttcactgggcctaatctgttatacctatcccttgagttcctaatatatatttttctatttctagaatttctataagttcttttttagatcttctctggcattttaaaaatattttctgctctttgctgagaggatgttactaactatagtttgagatacttgagtctgaaaaaactattatgttttaggatgattttacttaagttttctagaatggggtttttcacttcatttcagttgaatggggtgggaattagaaatgtgttcataattatatataagtttaactttcagttttttcccatgtcatctcaagagaagaattatttatttatagttctatttcgtgtgtttggaactggccaagatcgagcactagctagaatctaaaagtcaagaatctaaacactgagaataaaaggagaaaaataacttctaatgccagtgcactaacacttaggcattttacttcttagtttcagccttgtgtcttttttcttaatgccaaagcattataactttataagggaactactcttcaccttacacatattttaacagacttgttttcttaattttaagccaggagacagcaaatagcaaaaatgggagaagttgttctataagcagacatatatacatgcagtgttacctgacagccaagatggcatagaaatagacataaaatttataaaaagctgacaattcaaaatgtgcactactctggctccatttagtgtagatagatagggccctatcttggtaaaccttgcaggcatcatttaaatgttggttctcagttggtgtttactttctgaaacaacaaactattgacatacttattttcataattaggaaccatttttaatttatttttataggtttgtgggtacaagtgcagttttgttacgtggatttcttgtgtggtggtgaaggctgagcttttagtgtacccattacccccagtaaggaacactgtacccaataggtcatttttcaatcctcatcccctccccgcacctaggaacaattttaccagtagaaagtgtgactatttttttgtgtatgcagatttttccttctcaaacatactttgaagaaatggcatttctatgttttaatttcatattagttactgttaatttattttttatcatctgctagtattagcatatacaaagtggtaggcaccatttgtttagaaaagaattatgagagaacaatttcattcaagaaaagtttttattcattaatgtttctttgagaaaaacttggggagaaaatagttctttctattgtggtagttcattttaaggctcacagtctgaaaatatttctgtataatcaaacatttttaagctagaaagaacctagataatcatatagtctagtgtttcttagccttggctacacattagaattatgtggaaaactttaaaaaacttccagtaacttaaatcgatctgggctgagggccctgtcacagtatttctttctttttcttttttttttttttttttactttggtaggtctttgtggcagacctgtcacagtatttcaaaagcttcttaggtaattctaatgtacagttaagtataaagaaccttaaatttatctgcctttcaaatggattatccaatgacattttgagaatttcagaaaaatattctgaaaaaaattcctgttcctgtggtgtcagcttcatttgatactgtttaacatgaatgatttttataatatgagaaagataatacttattatatattttattagaatgctgtaaaacagttcatggtgtccaacatgtaaaggtactcagtgaatattggcgatgatgacgataataaagatataggtacacattggaggatatcaatggaaaggggcattagattctggagtatttgaagtagaactaacaggattcagttactgagtagatataaagtgtagaagagagtgtttggagactcaactgatggtgatgccatccactaagttgagtacataaaagcatgtcttcattttaaaaggctgaaagctgattggaattccttatcttgtttttacttaattcattgtgagtactgcgtttgaaatatccccagtttagccaaatatacttcgtgaattttaaatttatttaaatatatacttaaaatttttgtaagtatctttacaaagatatctgtacaaaaaataaaagtctgacctgttaaataaaaattgattgaggctatgtagtcttacattttatatattgtttgaaattaagttgcattttttttggtaacatcatatttgacattctgagcagagcccttgggtagcatgtgattagctgtttcttccacacgctttagtaaagatgataatattagtcttcaggttcagcaactgtcctggcaaagcatctgttaaggtacttctctgactaacatttggtcttacagagtttcctttttacaggtgtgattcaagtaaggtgaaggaacacatgcttagagctgtggaacattttgaagattagcaggttgtattacatttgtaacatttactaaatttttagcataggtaactttgttatggttagaacaccaaggactacaaaaagccatacaaaaacctactgtcacttctgtcttctacctgctttttatgcaataaaagccaatataaatatataccttgctgttttctacacaagtagaacttgccgtgtaccctgttctgtaccttgttttttaattacagtaaaaaaaagaaagcatctatattctcatttaaagttatagaaataacttttcttaaaatttcgtattttaataatgttttcagtgtttgataaacaggataatgttgtcttatttcaggggtccccaaaccctaggccatggactgatacgggtctgtggcctgttaggaaccgggctgcaaagcaggaggttagcagcaggtgagagagcattaccgcctgagctctgccttctgtcagatcagtggcagcattagattctcaggaaggtgaaccctattgtgaactgtgcatgcaagggatctaagttgcatgctccttatgataatctaatgcctgatgatctgaggtggaacagttttatcccgaaatcatccctcgcctgcccctcccaccatccggccaccatcagtggaaaaattgccttctacaaaatcagtccctggtgccaaaaaggttggggaccactggtctttttggtaagcatgataatactattttctcctttgaaacttattctttagcttccatgatagttatctttttctctctctggctgcgcagctcgtcgtctttaccacgcccattaaatgctgctactccattcttgaacattttctcgttatatgcactcttcctgggagattttatccatactcatggattcctatattcttgacttcaggtgttccatctaaacattgatggttgccaaatacagatcttttttatgagtatgagccatgaatccagcttccaatagacatacccatttggacattccacaggcctctcaaaacaatatggacaaaactcatttctcctcagttccccctctgttgttccctgctgtaaaaagggggaaaaagttcacagccagtattttcatattttctgtctcaagcaagtagtattaaaaacacttagttctcttagtcagaagcttggtggtcatctcagagttcttccctttctttcacctgccatagcttggtgtccaagtgtttttctttcactggtacctagcatggtgctgcacaattaaaggtgtctagttaaaacattttgatatttaaaaacaggaagcaagactgtgggtgaaatgtctctgaagtgtttatttttgtgagttttagtacaaattaagacatcagtatctttctgatattgaggtgaggaaggctgtgttgagaataaaaagcaaaagagaaaactataaagaaaaataattgattcctttaagaatgtataacaaaactttttatataccaaaaaattctataattgaaagacaactcaatagttattttacagtataacctgctgttttagaaatactttgtattcagagtacatttgaaacagcagaagatgtgattacttctgccgttaaggattatggaaagttccacaaaggcagtattcctgtatttcatagataatttgtctatgggggcacatttttctgaattgatactatacggagcattttaccaacatcattgcctaccttctttttcaaatatcttaggaaaaaaaatcatgtttactgtttgctggacagtatatataaaattcagaagactaattgagtccagataggtaaagagattggatatatcttactgtgaagaacagaaatgtgtgtgtgtgtgtgtgtgtgtgtgtgtgcacaaatttccagaactatattaaaatcagcgaaagtaacttgcaaaaatgctagggaactgaaagactgtccctttgacattagggatgactccatggttttcagaagggcaactggaaagatggaattaccgtcactgaaactacggataaggcggcttgagggtgaagggaaatatcagagatttcatgtctgatagacttcaaatggagatgtgaaggtggagtaggcaattttgataattaaaaaacatgaaagttggcagaatgatactgcctcctgatttaattctcaaagtgttcatactgcacaatcatttttcattcaacaaatatttatcgagtacctctatttgctactagatgattgggggctccagtaataagcaaatataatcatgggcgcagtccttaaagaacttaaacctgtaatgggggaagacataccttaaatcattagcacatagctacatgtttaaattacagtccgtagtaagtgttattaaggaagaatatctgaaaatgttggagcagacagtggggaccttataattctggtgctcagggaaaaagtgacatgaggtgtaattcacatgcaatagaattcattcattttaagtatatagatagattagttttgacaaatccacgtaatcaccactataatcaagataacaatgtttatccccaagaggttttccaaatatcccttttctgcccatttttaaattaagttctgtgtatgtagactgaaaaaaagggcttaaaattttaaaatgatcatatatatatatatatatatatatatatatatatatatatatatatatatatatatggatttgtaggcattctttatatattctggaacaagtcttttgttggctatatatattgcagatatcttctcccagtttgaaaattgtctttttattctctgtggtgtctgatgaacagtttctaatttaaatgaagtccaacttgccaatattttgaagggataattctgtatcctgttaaagaaatattttcctgtgtcatagtcatgataatatgaagatacatgtatattttcttgtataagttagtttattcatgatccattgcaaattaaatttgtatataatctgagataggactcaagtttcttcttttcgccatgtgatagttagttgatccagcaccatttattggaaagatcattctttaacgattagatgtaagttgtttcgttgtgacagtatatgtgggttgtttcttaattctctgttctgttggtctgtttgtctgtcgttgtattaattatgtcttatttattgtagcttgtgataaatctttgtatattctagtgttcttccccaagattttcctggccattctgggtcctttgcattttcatgcaaagtttagaattggcttgtgagtctgcaaaaagtctgtggaatttttattgggattgcatggaatcttgaggtcaacatcagggaatttgattatcctctacaatattattaataaatcttccagtcaacaaagatggcatatccttccattttgtgaactctttctctcaacagtatttcagtgtagaggtattgcacatttgttagatttattcctagtgttttgagtttttttggatgctattatgccatcagtttttaaatttcactttctaattgttttttggaaatatatagaaatatagttgatctttatatattgaccttagttattatattcacttattctaatggtttattataggttctcttgggttttctatgcacttaattatgtcatcagcaaataatgacaattgtaagtcttctttttaaatcattatttctttttactttgttttctattttcttttagtctttataccattgatttgtgttggtttatttattttgttgaatagaaatggtgatgtatattcttgtcttattcctgaattcaaggggaaagaatccagtatttcattagtaagatgacattggctgtaaaatttttgttttaagagtgctccttttattcttagtttctgaaagattttattgtgagtaggtattgaatttcattaaattcttttctttatctgttgagatgattatatggattttactttgatgatttggtgaattacactgattaattttcaaaagttaaatcaacttacattcctgtaataaatttcattggttataatgtattatctttttaataagtctggatttgatttgctaaaattttgtttaacatttttgtgtctgtgttcatgagagatgttttgacctgtcattttccttatgtccttgtcaggttttggtagtttcataaagaattgggaactgatgcccttctttttgttttctggaacaaaaaattggtgtgaggtattatttattcttaatggtttagaagaattctctattgaaggtatctgagtcaggagattacttcagggaaaattttaaatgatggattcagtttctctaataaatagaggattgtttcagttttctatttcctgtgtcagtttctataagctatgtttttcaaagaagttgtccattttacctaaattattaaatacattatcataaagttgttcttaatatctcattttccttttactgcccatattaatatccccttattttccttttactgtccatagcatatgtactgatgcccccccttttaatttttctaaaattggaatttctgtcttttcttgattatttctgctaagggttattaattattaatattctcaaacagccagcttttggcttaattttctcttaatgctttttatttcattgagttttgttcttgtttacattatttcctcctttgtactactttgggtttgatttgccatctttagctactgaaaataaaggatgatagtgttatttttcaactttccttcttgtaaatatgcattttaaagctataaatggtcctgtaagcatagcttaaactgcatctcacaaattttgatattacattttcattaccaattaaaaatattttaaaatttccattgtgatttcttcttttatgaataattttgttactgatttcttattattattatttttttctttttggagatggagtctcgctctgtcgcccaggctgaagtgcagtggcatggtcggctcactgccagctccacctcccgggttcacaccattgtcctgcctcagcctcctgagtagctgggactacaggcgcccgccaccacgcctggctaattttttgtatttttagtagaggcagggtttcaccttgttagccaggatggtctcgatctcctgacctcgtgatccacccgccttggcctcccaaagtgctgggattacaggcatgaaccaccgcacccggcctactgatttctaatttaattccactgtgcccggcctactgatttctaatttaattccactgtgctcagaaaatatattttatatgatttcaatcttttgatatttattgacttgctttatggcccagtatgtgattcagttcagtcaacattccttgagtacttgagaacaatgtgtattgaacagttattggattctgtaaatacaaattaggtcaaacaaattggttactagtaatgtcaaaatttttttatattcatagggttttttttcttctatacattactgagagaagtatcttaaaatctccaactgttattttggattattctgtttttccttttagttctgtcaacttttactttataaatttttgaagcagtgttgtgagatgtatacacatttatgattgttaaacattcctgttgagcttttatcgtaataaagcatctctgtttatccctaataatttaagccagctattcagtattaacgtagcaacatcatcatacttttaattagtatttgcatgatatctttttccatttttttcttttaatatatctgttcccttgactttaaagtagttgtgttgtacacagaatatagttgtgtgttttgaaatccaatctaatgtatttgttatttaattggaatgatgggtccatttacatttaatgtagaacatgatatagtaggatttgtgtcttacaaggcaggtattttttttctatttgttcctttctttaatcaagcataattttttctatttgattttacatataattttacagtgtacatctttaatatgtgtgcatgtatttttaagtagttgccctagagattaaaatattcttcattaaaatattaaaatattagtttatcaggttgtctaaatttatacttttaacacttgttgaaaaatacaagaaccttataacggtttaatttcatttatctcgctgtctttttctttttttagacagtcttgctctgttgcccagggtggagtgtagtggtgtgatcttagctcactgcaacctccgtttcctgtgctcaagcaactctcctgtctcagcctctcgagttagctgggattacaggtgcccgccaccacgcctgctaatttttgtatttttagtacagattgggtttcatcatgttggccaggctagcctcgatctcctggcctcaagggattcccccacctcggccttccaaagtgctaggattacaggcatgacccacctcacccggcctaacctagtcttttgtgtgtcttgtcctatactttctttttctacatttgtttaaaccagtagagtcattattactgttattttaaatgttaatatgtatttatccacatatacttttccattcctcttaactaactcctctagttctatgcttccatgtggggccattttcttttagcttgatatattttgttctcttataacaagtgttttcttaacttttgttcatctaaacttatttttatttcatcttcatgttagaaggtatttttttcttagtgtggaattctgggctggttggttgattttcttttttttttgtcttagcactttacagatgtcattttgtcatcttcattttctattatttctgatgaaaaattagttgttagttttattgctgttcccttccaggtgatatgtcttattttcactgactgcttttaagattttttctgactttagtttttaatactttgatatatctgggttcaattcattacttcattaaatctctgttttgctgtttctaaactaatgatttcttaatttcagtgattatattttccttttctggaattgtcatttgactttcttacagaattacagggctttgctgaaattctccgtctgtcctgtgtttgtttatttatttatttattttttgagacggagtctcgctctgtggcccaggctggagtgcagtggcacgatctcggctcactgcagccttcgcctcctgagttctagcaattctcctgtctcagcctctctaatagctgggcctacaggtgcacgccaccatgtctggctaattttttgtatttttagtagagacagggtttcaccgtgttagccaggatggtctcgatctcctgacctcgtgatccacctgcctcagcctcccaaagtgctgggattacaggcgtgggccaccgtgtccagccttatttatttcttgaacataccaatcacagttattttaagtctttagtaactccataatctgttttttttttttttgagacaaagttttgctctgtctcccaggctggagtgcagtgatgcgatctcagctcactgcagcctccacctcccaggtgcaagcgattctcgtttctcagcctcccaagtatcagggactacaggcacgtgccactgcgcctggctgatttttttttttttttttttttttttggtatttttagtagagacagagtttcaccatgttggccaggcaggtcttgagcttctggcttcgagtgatctgcctgccttggcctcccaaagtgctaggattacaggcatgagccaccacatctggcctggaactccaaaatctgaatgacttaggtgtctttttaaattttctgttatttctcttggttgtccattctttttttaattgagatacagtttatataagatttaccattttaaccattttaaagtacagaattcagtggtttttagtatattcacaattatgtaagcatcataactatctaatttcagaatgttttcactaccctaataaagtgaaaactgttggcagtcaatctcaattctccccctctccccatcccctggcaacagcaaatctactttctgtctctctgaatttgcctagtctggacatttcttatgaatagaatcatacaatttatgtggccttttgtgtccatcttctttcacttggcataatgttttcaaggttcatccatgttgtagcatgtataagtatttcttctttgtggctgaataatattccgttgtattcatatgccacgttttgtttatccattcatcagtaggtggacatttgagttttttccagtttttaactattatgaataatgccactgtgaacatttgtgtagaaattttgcgtgaatgtgtgttttcaattctttttagtatgtaccaggaatggagttgctagatcatatggtaactgtttaagttcttgaggaactgtcaaactgttttccacagtggctgtacccttttacatttccaccagcatatatgagagttgcaatttctatacattgttcacaacacttgttatttttctggacttttaatttttatgttattgcagctatcaaagtgggtgttggtcatttatttttgttttttagaaagccttgcaatttttaagagtgttagaccttgtggttgaacaattatagaagctctagtttgtgttactttgctccaaagagaattaagttttcctttggtatgtgaagtactaggaggttaccttgaatctattaaaggttggttataagactttttagggctgatctatttcaatttcgaccttactcttaaggagtagctggcccttctgtagtctcaacagagagttggagttatttatgaaggctcctctaacttggtggggcctacactccagtctttgtctccatatcagtgagcagcagctggaatctctgctgagctctttagcctcctacctgctatttcgactagttttcttgaatgtttcccctcttgtggtcctttctctctggaaatttattctttagtttccagctctttgatagtcaaaaattctgactcttttttttccttagtccaattggactgcactttctacttgagctgtatttccctgttactcagcaaactcaaggaaaaagccaagataattgtggagctggtcttatatgcttccgttctttcaggagttgtagccccttctgttcctctttgtgtaagtcactctttagtggcttcaaacagtttttactttttgtctagattttatgagttttatttagctgagggttagtttgatacaagttattctagcatggtggtaacagtaatgatgttttattagttgaattacaagaaaatgacctcactattaagagtgagaacatgaatttttaacagaaaatttggacaagaatagaggaaggaggatttctgttttcagacagaagagggttaaggtagccaggtttgaaggatgataaataaggatgattaaaagttagataatatgactcaaattagtgttttttgtttgtttttttgtttgttttggtgaaaactgaacaaggtttttaagtgtttaaagaatacaagttggagaaataatatgagaatttaagagaaaataagagcattcatctggatttagttgtgaagaaattaaaattctgattttaaaatgtgtgctattagagtagacttgtttatttctgtaaatgttagtgattattaactgtttggaggtttgagtatttaaatgtgatggccaaataacaatgtgtatctattaagtgtgccaaagagaattgtgttcacaaaatggaaaggcatacagtaactggccatttttaaatgtaggaggaagagaacaactgataatacaggaatggacattacatttagaacatcgaagtaaagaataatgcctccctctcctcctacaagattaaaaatgggggattggagcgaaactaaccgtttgctttctccaccaaaatatccctaagaagggacccaggtgtggcagaccacctcatatctgtttttccttttgcccttttgtgaactctgaaggttagtcagtggttttcttcaaaattgcattaggaaatttgccaagggcatccttttgaggcagctgtctctgtacccttggaggccatcagtaatgtttccaatctatagcagtagtcggcacaaaaatgttgaactgttgtcttcatgttttaaaacattcctctgctgccactatcctccaccccgaaatagtgtaaaatatggcacattttgggacttagagtcctttcatcattttttgttactgtacatttttaggtaaaatccatcattaataagtgtatccaatacatcaataatgaaaggacatttaatttttttcacataatttagataataatagacacattagaaatgcttaatatataaataaatgagaattttttgtatagaatgttaacattttaattttcactactgagattttataaagtaaatatgctttaaagttttgggggttattaactatgttcatgatgaaaatgcattagaagaattcgaaatgcatttgtgtttttgttcttactgcaatttagtaacataagcaactcttttaccctatgcatctttcgtatattagtctgtttctcttgttttactaaactgtcttctttcagccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctggtaagtttttctcctctaagacattaacaccagagttgcttagcaactgaaacgacatgggggctcaagggatactagattgttgatgacaaaactgctttgaatgcccccgagtacaagctctcttagagtttgttagctacagagctacgtgacctgtattcagtgtttatcaggctgcccttgggctttgatgtagctgacacacaccattcctctgatgaacagaactggctaaatttagtctgtctgaaactgcaatacagttggctttagaagctttttggaaaaaaaggcgttgcaccatggcttaagaattaaagtctgtttaaaaaagatattataacatttccctgagtttttatttacttaaatattgattgatctcagaaacagtatcactgggaaaaacacatggggaaagaaaacagtctctgaagtgctggtgtatttagtatttccttattgatattgaagctgaatctaaatttttttaatacataggtttatagcataacataaatattggaattgattttaaagcaaaaattaaaggctgaaaaataatgtaaacttccttacattatttatacactgagccattctcttttctatttgtcaattttaagtgtagggtcactaggttgatatgttttaagacattggatgctgatttagttacctttggctggtttgaaattttaatcatacaagtatctttacactattttgtttttgtaacagtagcatcaacccatggccgtaatttttggtagaatattatctacattaggtatcagaatatttttaccttctaagacaaaagttattttcattgataaagaagacattatacaactagcagtaatggaaataaaataacagaacaattattaaaattagtaattggcatctttaggatactgttttctgtagccgattgtgttgattgatagcattgtgtccaaggatgatgggtgcagtaaggaaacaagagagcacagagcaaaagaggtaaggtagcctggcttatagaagattgaggtgtgactgatcatataggagggcagtggtgtttcagtggctgtctcctatttcctgctaaggcttgcaacatatatggcacacatccagtatggaggtaggaataaagacatcactgcttttcagtttgtagtcatattgtagtcaagagaaagcttcttgccaagtccacatttagttcaccaggacacactgtttttagaactggaaaggtagtgatagtgcaggttagctagttaggagttttgtgactttttatgatggtactttgaattaggattttgacttaaattctctgtgtaacattgaagcctaaggccaaagaagcatttgagcagcagtacagttatggttaacatgacattttggttttgtgtaaggccttctgaagtatattcttttataagctagttattatcaaccacttatgacctggtttgttcagaatactatagagcttccgaaacaatagttaagaatttctccaggccaggcgcggtggctcacgcctgtaatcccagcactttgggaggccaaggcgggtggatcacgaggtcaagagattgagaccatcctggccaacatgatgaaatcccgtctctactaaaaatacaaaaaattagctggacgtggtattgcacgtctgtaatcccagctactcaggaggctgaggcaggagaatcacttgaacccaggaggcggaggttgcagtgagccgaaatcacgccactgcaccccagcctggcgacagagtgagactccatcaaaaaaaaaaaacaaaaaaaaaaaaaacagaaagaatttctcctaacaatagttacggagttacagttaagtgtaggagaaattggaaggccagtaacttatattttctttatttgttccttatagcatttagccaacctgtttatgcacacaaatttgcatcttggctgtttcctatttcagtttggtttttaatgtatatttcattatgtagactcagttttagagctacttatgttctcattgatctgggtcaaatcactactcagtctcaggttcccttttttaaaaattactatttttttctttttgagacagagttttgctcttgtcgcctaggttggggtgcagtggcacaatctcggctcactgcaacctctgcctccccgggttcaagcgattctcctgcctcatcctcccgagtagctgggattacaggcgcacaccaccacacctggctaattttcgtatttttaatagagatggggtttcaccatgttggccaggctggtctcaaattcctgacatcaggtgatccacccgcttcagcctcccaaagtgctgggattgcaggcatgagccaccgagtccagcctaaaaaattaattgattttttaaaagctaggtaatacatgcctatgggaccaaaatcaaaggataccaaaggatgcctagccgccacctctccagacagttctagagaggcattggtttctagttgtccttcaagagatattctctcgctgggcatggtggctcaagcctgtaatcccagcactttgggaggctgaggtgggtggatcagttgaggtcaggagttcaagaccagcctgaccagtgaggttaaacctcatctctactaaaaatacaaaattagctggcgtggtggcacacacttgtaatcccagctacttgggaagctgagacaggagaatcgcttgaacccgggaagtggaggttgcagtaaaccaagattgcaccattgcactctagcctgggcaacaagaatgagactccgtctcaaaaaaaaaaaaaagagagagagattttctctatataaaataatgcatgtgtatttcctttatttttactctttttttttaaagtacaaatgatagcactcattaaatactattatgtatcttttctttctcaaagatatatcttggagaccattattttattccatatgtaaatagatgccttattctttttggtctctatcatgttcttttttacaagtttaatttattcgaacatttaggatggaaacataggcttctagtcttttgttattatgaattatactgtcatgaatttgctgtaaaaatatatatacacatatatatgtgttctgtgtgtcaatacgcatgcacacaaaaatttgtatatctctagcataaattcctggaactgaaattgctgggttaaaggtatatatattttaaaatttgacagttagtgccaaattgctttgtgtaaaaatagtaatatccatcagttctgcatttatgaatttcacatccatggatttaaccaacagtggattgaaaatacttggaaaaacaaattgtgactgtattgaacatgtacatactttttttttcttgtcattattccctaaacaacacagtatagtgactatgtacatagcatttacattgtgttaggcagtacatgtaatgtagagatgatttaaagtatatgagaggatgtacataggttatgtggaaatactgtgtcattttatgtcagggacatgagcatttacggattttgaaatctgtgggtggttctggaaccaatctcccacagatactgagggacaactactttatttgaattgttgtttgtcatcacaaatttcctcaagcttgatcccacccttgattccacaagcttgattccccatgaaatataagtaagatttctgttccttcaacaatggatgaaagtgcttctttcttcacaatatagttagatcgaacttttgatttttgagaatctgagaggtgaaagttcggtctcatagttttaatttgccttcctattttaagtgaagcaatcaatcttttaatgttgatgaacctttttgtagtttttgtgtgaactagtcattccctcattatgtcctttgcccattcttttactggtggtggtcttttacttacttcatatgttaagtaattaatttggtctgggtctgcgatctatcttataaataatattttcttatttacctttttattatttaattttgagttttttatgtcgtgcaaatttttaaattttgtatagtctaatttatcaatgttttatggctcagggttttctggcatacttaagaaggtccttccattattatttttaaaattctcctttttgaaattcttttatggtttcttctttttaaatgtttaagttttctattcatctagaattagttagtggaacaaatgagatagtgatccaacttgttttttccagatggctccccagttgtcacaataccatttactgaattagttttctattgctcactaatacttaatattactgtgattatttactcagctatgtatttgggtctacttttagactctgttctgttcaatcgatctgttagtctattcatttatgttcatagttaattactccaaccttatgatatgttttgctcttttatgaagaagctagtccttccttctttttcagagtgctcctgacttcaaaagcatcaatttcttaatccaaaaatgggaataactacttcacagtatttgctgtcttttcctataaaccatttactttgctatcgattaattattgtttggtattactataataatgcaaaaaaaaaattatttccaggtacttttgtatggaccatctgtttaactttcatattttgcttctgatcatttttcttcaaagggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtaactaagctttatgtccttcttgactagagtgctctattagcctttgaaaagtaaaatgattgttgtcaggttcttagctggttcataaaaataaaagtttaaagtgagtgacagtcatgcccataaaaaggagatgttgagtttgaagctagtttaaatctctttgctcaatgtagctttttaagcttatttatttttatgtcttttggacagtttgtttgaggttctgtattgttgagaattgttttttaaagccagtcaatgaagaaccaaacatttggtttagctagaaagttgagaaaataaacacctgctccttcattttacttattaaggatgtattaatttatatgaattccccttgatttatatggatgttttctgatgctgtgtttcagcattaaaaggtaattctaaaataatttgccattagaatgttcagtggaggtgctgctgtacttgtcttagagtggtgtaagtccattaaagtttattaccaatctcagaatgaaattgtaccatgtttctcttttaagtattctgtgaataataactaaaagccagtaagtggcgctctgttctgctaattgactgttaaaacatttggcttatttccaggttaatgctatttcagttacaaaatgtaatgaagttaagactgtaagatagaattaaatgtatttggaataaaattttctagattttgatttataaaataaacagagcactaaaatgtacccagataaaagaagttagtgttaatctgttgataattccttatgatgaaataatataattttaaaataatacagatttttaataattttcatgagatatactgaaagcaaaaggagataatagaaaaaattgccaatcattgtagcttcacaaaactggcacttgctacatttttttcccccaaagttacttaatgcttatggtagaattatttttttgtttttattaggtcaattaaaagtccaaacaacagcaagatccagtcagtgctagatcagaagggagttcatgtgtttctctatacagtttggttaccaggagagagaacaggaaaattgatgattctgacagcaactccattaatgatggcacacttcttaacttcttagaaacctatagttaagaaaaggtatggtgtgcacaaaaaatggatgttgctgcagcatggtttgatatgacataataagattcgaagaaaaaaataatgcatatagcaatgtgcatattgactttttggagaaaagtattgaggtgtttttagaaattttttgttcttagggaccaacttttatttttaaaaatgtcgtattttgtaagtatgtgtaggtcttccttttactatagtacagtagttatatcactttttgccttgttctcatagttataaatttcttcttttttatttttattttttgtattttgttaaaagaatagaaacaatgtcttggtatgttgcccaggctggtcttgaacacctgggcttaagtgatcacctgccttggcctcccaaagtcctgggattacaggcatgagccactgcacctggtcagtttatgaacttcttaatagaaaataggctgtacagaaatgaccaggtagagatctgaagagattaaagacaattttcaaaaagaaaatatggttaaaatcattgaggaaatttttatttgtttatttatttatttatttattttgagacggcgtctggctctgttgcccaggctggagtgcagtggcacaatctctgctctctgcaagctccgcctcccgggttcacaccattctcctgcctcagcctcccaagtagctgggagtacaggcacccaccactacgcccggctaattttttttttgtatttttagtagagacagggtttcaccggaaatctttattgttttaaaaatctctttaggacaaataaaaaacttcatttaaattttgatatttcagaatcaaaagaacacaaaattacagttaccaaaaaagaaagttatacagtgttctggcagcacctagttttttaatcatatgagtttcttataaaagcattttaattatatgttaccttttaataaagaagttcatggtgagttttattaatgaatttttttactagatgctagaggatgattgaagagttttattaatgaagttttaatattcatttcattataaaacattttcttagtttttataaaaataagctgcatattttacattgaaagtttttctgtttattattatttatttttatttgttttaattcagcaactaagctagtattgcaaaatgtttttctctgtgttctcttagagggtctattgcttccaggtgagcactttagcacaaatttttttttttttttgaggtggagtctcactttttgtcgcccaggctggagtgcagaagtgcagtctcggctcactgctgcttccgcctcctgggttcaagcaattcttctgcctcagccttcctaggggctgggatgacaggtgcctgccatcacgcccagctaatttttgtattttagtagagacatgttggccaggttggtcttgaactcctgacctcaagccatccatccacctcagcctcccgaagtgttgggattacaggcgcaagccactgcgctgggcccaatttttatgttaatttgtttcttaaactgctggcaaaatgttgcttaagtataatagtcaatccaacatatattttcccatgttattgtcactgttacccagataaagtttatttttttgtcattttgaaccttaagagaaagatctggctgggcgttggtgcccttgcttgtaacctcaacactttgggaggctgaaatgggaggatcacttgaccccaggagttgaagaccagcctgggcaagatggcaagacttgcattttttacaaaaagaaatgtgaaaattagctgggcgtggtagcttgtgcctgcagtcccagctacttggaggtggaggcaggaggttcacttgagcacaggacttcgaggctgtagtgagtttgctggtgtcactgcactccagcttgggtgacagagcaagaccgtctctaaaaaaacaaaaagagtaactccagttttcagagtaaaccaccatcttcctacataaacttatttgcatatagagcataaacttcactagaattcaacaagctctataaaagcaggaagtgtgttctctgctgtatcccaggtgcctagaaaaatgcctgaggatggacacacaaaatcttatttatttctttcatttcttcagtaaaaagcaagtgttatatgatcacctgtctgaaaaatgtttatttaatcaacaagtacattcagtgtatgaaaaggcaaattgtgtagaagggatttctgaagatgttatattggacagatacctgtgtatttttcattatcaggcattagtaattatagctttccacatttaacagaattttactaattatatattcaaatataaagaattttacaaattgcagtgcttgtgttaaagaatatgttttgtaagttccatgtgtgtaattcttcagatttggatatgtcttggccccctgtagcttactgtatgtgggacctttgactaaattacttaatttctctaagtaagattaagtgaaatgatgcatgtaaaaatcctgacttggtaatcatttgcataatttttataaaatcagttggctaatcatcaagcttttttaaaaaggtgaacacaaaaacatttgagattggtttatcagctactgtcttattttagccacagcatctaatttatttctgggtgttttaatagtattaagaaagtgttgattcacgtggctaagttgcaaatgacaatatcttcaaaacactgtgctttctgtcagtgtactctttggttagactgacccagaggcttgacatgaaagtagaaggagatttttctttcagtacctaaactgttcacattcgttatataagtatgaagggcaaagagcatgtattgccacagctgagattgttttctcttattattatcttattatctcttactattacacaatggattattaagagatagacgaaaaggaggtgcttgagataggcctagcatttacttttacatatgtatttttacatggtagtttatttcctttacctccgctattcgtatatatagatctttctcattttttaaatggcaacattctttgtatggatgtattataatacaacaaagccattttcacttttgatagatgtgtctagtcttttacaaatacttctggaaaaaatgtctttgtagctatgtctttgattacttgtacaagatttttgtaggataaattctagaaatagaattattaaaatatatgaatacttgaactacttgagagacattgccaaattgttttcaataaaggttgcatgaggccacattcacattcctacagcatataaaatgcttactttactacatacccagtgacagtcttcctatttgctaaatatatagcggaaaactgtaaacttaatttcttcaattattagtcaggttgcataactttgtatgtttatttgctgtttgcatgttttctatgaattgcctgttcatgtcatatattctgtggtttgtctgttattgaaggagttgtttataggttaagtctgtttgccttatgtgaatttcacatgtaaaaacattttgttagttttaagaggtaggaatttaacctttatttgttgttgttttttgagacggagtctcactctgtcgcctcactctgaggctggagtgcagtggcatgatctcggttcactgcaagctctgcctcctgggttcatgccattctcctgcctcagtgtcccaggtagctgggactacaggtgcccgccaccatgcccggctaattttttttgtatttttggtagagacggggtttcaccgtgttagccaggatggtctcaatctcctgaccttgtgatctgcccgccttggcctcccaaagtgctgggattacagacaggcatgagccaccacgcccggctggaatttaactttttaaaatagtttgttttagtgataggattctgaaatggtaatattcatgaaaaaatgtgattatttcccaattatatcagaactttgacccagcatttgctaagttatggtattaatagatttactaattactagtaaaatactttggaaggttcagcatgcttattagactattaaaaggcctgagaagatttttattaaagaaactgatttgatttcagttaacatgagtatattaccatggagcttttcttcttcttctttttttttttttttttttttttggcatattactttccaaaggtaacagctaatattcagtaagtacctgttagtgccaggcgctaacagaaacaaaactatcaaaatcctttgcatgtcttctttaattctcacatccttgaggtagtaggtaaggtactattactatcattctgtgcatgaggaaacagacatcctatggaaatacaggcaggccttgctgtatgcaattctgatatacatgaatatcagttactgcagttaagctaaataacacctgttcccccagcaccaccatttgaatttcagttaccatagcacattaagagtaattgtataaagtatgaactcttagctgctctttcttcagtctacaaatcactacataaataacagatgcctgtcatgataagtgatggatgttacttttagattttgtcagtgattggtcactgtgcatctgtcagttcatgcacatacagcaaagcttgttgttgtgttgcttccttggctcccagcagtaaacctatatgagattttacaaacctggataattgaaagagggacttggccaacatagataaaagtgcaacaaagaaatgaaaaatgataatgctagaaatgaaacccaaattcagtgtaaatggagtactgaagaaattgctgactgtggaaatgctgacattgctgccatttcagagaatctggatatgcactgcaggtgcttaaagaaggagaactcattgatacaaatgagagaagtagttgtgatgaaaaggatgaaaatgtcccagaggaagcaagactggcaaaatatttcacattaaagaaattcttggaaatatttcacaactttgaaagtgtaaaggataaaatgttggatgccaatccaaacttagaaaggagtgtgacaatttgctaagccgtggaaaagagacttactctaaatcgtcatatataccattaggagaagggaactactttttaaattattcttgacaggatttttacaaagaagtgaaacactttaattctcagtgtttctttttttttccttttttttctacttcttttttttttttttttttttgagacggagtcttcctctgtcacccaggctggagtgcagtggtgcaatcttggctcattgcaacctccacttcccaggttcaagtgtttcgattctcctgcctcagcttcccgagtagctgggattacaggcacatgctaccatgtccagcacatttttatatttttagtagagatggggtttcactatattggccaggctggtcttgaactcctgacctcaagtgatccacccacctaggcctcccaaagtactgggagtacatacaggcgtgagccactgcatctggccaattctcaatgtttctaatgtttaaaattacagtgaattaaatattttctcatttccctatgtatttttaactgacagtaatagagttttcagtgttttgaccaaaattttaaaggccatggaataattatgatttttttccctactgattattaagatcgttttgcatgatttctgcttgcatggtcattgatatggtctgatcctactatgcaaagtgaacactataaggttttatagacactttgggaaatgctagtaagttcctaacaatatgaatgttataaggttaaaagctactcatttatcttaaggattcagatacaaatatgtcagatgatatgtgttatgaagagaaatatgcaaagtaaaaggaaaaagaaaaataagcatgtatgccattttagggtggtgagcagatacctagaaaaagaatgtggcacaggcagatggaacagcaagtatgcactggagcatacttggtgtgtttgaagtatagcaaggagacccgtcgaactggagcggagtgagtgaaagtgggaagtcataagaaataaggtccaagagatagttgaaggctaggccttgaaagtctttcagtccataaggattttagattttattctgtggaaggagatatactgctggaaagttttgagcactggaataacatgatctgaatatatggttttcaaaaaatgcctttgggcagctatatagaaaatgggctgtaattgggcaagggtgaaatagggagacctgttaagaggctcttgttgtatttaagagatgatcgtggctttaaatagtatgatagctatggaggtaatcagaagtagtcaattgtgggatatttaccatgtattttgaaggtagagcggatttgctgactgatcaaatgtggaggacaaatgcaaagtttgtgttgtcctctccttgaacagtcactatgtgttgtgttcctctcacagatgtgtgataatacacacagggtatattgctgaccaggggagtttcccttagccttagtgttcagagtttttattgggactgtattatgtagatttgattaatcgcttgtccatgtggttgatctcagtctccaatctcgatcctttacccccctgcttggcccaaaacccccatccaggatgaaaggagctacaggaaatcccaattaagtaaatttactaaatttttctgatttttttctgattttagtaatcagtaaatatttctgattattaaaataactgatgttaaatttgaaaaatcttggccaggtgtggtggctcatgcttgtaatcccagcactttgggatgccgaggtgggtggatcacctgaggtcaggagtttgagaccaacctggccaacataatgaaaccctgtctctactaaaaatacaaaaattagccggacgtggtggtgtgcaactgcagtctcagcttctcgggtggctgaggcaggagaatcgcttgaacctgggaggcggaggttgcagtcagccgagattgtaccatgcactccagcctgggtgacagagcaagactccgtctcaaaaaaaaaaaaaatctaaaaaaatatgaaaagcatacaacataaaataaaaaacacctcttacttcactatattttaaattattaggcaaattcacttaagtatagtagcctatacttagaatcctttaagcagtactacttataattacataattttaaaaaatatgtgtttaattatttttctttagactctgagttctatgaagtgaagaactgtgtcttattctgttcactgctttatcctatttgttgactgattagctagataggtatcctcttgctgtaagtgtcccctgagggacaaaactgcccacagttgagaataaccagcttgaagaaatggttagtatgaataactgtgtgtaaagatggtctgtgtcactaaagaaacaaatgacaataacaaaattgttattgatattatttttaataccttttaaaacttttatgagattttttctaaagttctaatgttatgaaagattttgtatcttttaatgagctgttgttctctttacttgctagaatcatgtttccattttttcattggttgctggaaactcagctaaatttgtgcttggctgcagtgaccttactgaactgggctagtcatcctacattttcttacttgctcttgttcttttatccttgatattgtatctaaacatcttattaactactaaaaattcttgatgtggacaggtgtataatttaggtaagtaaagaatcctattctttttaagcagctatttaagcagatagtaagttagctaattgagttttttggaatacagggattcttgcaaataaattattagaaataactccaaataagagctataattgggttagagattaaatggttaaggaacaaatagtaaaatgtaagcagtaaatgatgaaatatgaatgtgaaaataggcctgaggagggtattatctatggagtttcatggtcttaagataggtggggtgaagaaatttcttatattttaaggtttttatattacagtgatagagatatattatacagaactcttttcatgggagatagtggcatgggaaaagtacaatttgaatttggagaggaagtacacatagtgattaagagcacgggctttggaccatttagtagctatgctactttagagcctttcgtagcagtacagctttgggtaaggtccttgatgtttgtgagccttaaaatgttgttgtctgtgaagaagtcgataataatactacccgtttcatagggctttggggaagagaaataatacaggtaaagctattagcttagtgcctggctaataataagtgttcattaaatgttagctgtcattttaaacaatattatttaaaataatttgtagattaatgatacaatttttataaaattttagtgtattggtttgtatctgaggatgtgaaatacatgtgtatatgtatgaatgttctatatatatagaatatttgtaaaattacattattcagaattgacagattaaaacaatgttttccttatagttaagtatttaaaaattatttttttcagtctacctaattgtgtgtcactatagacagtgacagtgctcatcacatctctatattaccatggctcctagcctggggtgttgtacctaataagtactcaataaatttgatccttgacttactcttcaaaagaaaattctttttttttttttttgaccactgacttaagataaaattaagtattaaccatctcattggagaaaagaatgccaataatataaaatatggtaatttgggaggtttttacatgtgtttaaaataaaggatgttattttcatagaatatctattagaatataaaactcaaaatgggaagaaataatgtgctaatgataagtgtttgttatatgcccttgcaaaacacttgcaaaaatatattctaggtaattaagacatcagtagggtctttgcatatgtattatcacgctttgtagtgcgtcttaacatcaaaattgtttatgtaaaagatgaagaataaccttaaagtctgtagtaatgtatgataccattgtttgcagaaaatggttgtagaagatgcattttataatgctatttcactctgcagtacaaatttttagaacatattttggggtaaccttttgagtttgcttctcttagtttcattagtatctcaagagataatatacattgccagtgtagcataatttcattatcctaagaaggaaaataatatacttcctaaacaatcagaattgaagtcatagtcataattttttttttctttaatggataaggcttcgaggaaaattatgaaatgtattgtgctttagtagtgttagctgactgcattctctctgtggtttaggcttgatcatgaatgatgttgggatcctctgagggagagaagtgacagtaaaagaagggtagtaattgagctctttgggattggaactgctcacagtcccaaaagataaagcacaagtggcatggtcttttctatctagggcttaagctacaattactttgctttcctttagagcaaggtttagtgttttgttatgtatctttttggatttttttttcttttggctattgtggttttgctttctttttgtttctaatattataggttttagttatatagttaccttctgttaagacaagaggtctttagacagtgttggagaagaaaaggcaaaaccttcatttactgaaaatgaattacataaatgtccgatcaggttacctattaaattatgaatgttagtgtttaatagtttagtatatgcaacatatatttgaaaattataactgctattaaactagtgttttggaacttttttgttgcaaattatttgcttcggaactactgaatttgtttcgtgttttgttttgttttggtttttgaggcagagtttcacacttgtcgcccaggctggggtgcagttacatgatctcagcttactgcaacctctgcctcccgggttcaagtgattctcctgcctcagcctccccaatagctgggattacaggtgtgcaccaccatgcctggctaatttttgtacattttagtagagttggggtttcaccatgttggccaggctggtctcgaactcctgacctcaggtgatccacccaccttagcctcccaaagtgctgggattacaggtgtgagccaccactcctggcttacgaatttgttatagcttatgttttaatagaggcaatgaaaaatagaacaaacatgtgcttcaaaataaaatttgaggtttgtcttattctcagtttttatctattagctgtgtaatcttgatttttagattccttggctaaaaaaattgagaattagggtccttacctctggtaattgttaggagtttgtaggaaatgactgtgaaaccatgtaactggcagtgttgtagggtaccttcagtattaagttctcttcgcctctactctcacccagccagtttgtctctactaagactgtatttccttgttgaaagaaaggtcccagagtttttgagaggcttacattcacatttatgagaataaaattgaaaaggaggaaaaaagaaacagaagcacggaaggcaaataggagaaaaacagttatctctgataaagtactccttcagataaaacagttcttctgattggaaatgtgaagtctttctgcttacatcattgctgctgttgtaagtcagtaatatatttgaagaggtgggcttgttttgtttttaattgtttgttaagtaatttaatagtgaacttttggctcatttgggcagtttcatctgtgaaacctttccaggctgtctagtactttgccttttgtacttaaattttctccatgtcactcaagggggaggaggagtatgtagctatataagcagcaagttgggaaaagactcatccatacttctgagacagtaatgttataatggcaaaatgatgagttccccataccgtaacttggcccagtaaacctctcaggagctgcttaacattgttagatggcaatgtgggactttatggccattgtttattgtttcctgtgatacatttttactgttgccagtgtgatactatagcagtggtagtttggctaccccagtattgctcactttggaaactctgtagttcagatttcttagcctacagcttgttgcatgtctctgcctgtttttagaggtgtgagagtctttatgtaatgtatgtgtcttttaacatattaagcagtatagccatttgatttgaaggaggcctttttaggttataaatcttgtagttgggaaagggaaagaagactttttaagattttgtcctaaattaaagcttatgaaattatattcggtgtttgtatagttttcctgtctaccattatataatgagtgagtattgaaaaagagaacaaagtaaaaatctagagatttggtttcttttccttagtttgaccactgttttgctgtgtgattttgtaaagtttacttttggtatattttccagtgtagcataaggatgatatcttctcaagaaagatggtatagataaatattagatagtgtgtaatggaaaatacacacattcaggatgttcatatattatatgcattttattttaaaaaatgactaagaatcatcttccagtggatttcaagttaaccaccatggattggttattttcttttgtttgcagattattttaggcatgtgaattttaattcaaagacttatttttattatttgaaatcagtttttactgcatttaattatatatttttgggactatatgataaaagattatcttatttctcttgagatgttaaagttatatacaaaaaattatgtgtataatgttgtgtcttgtttcaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggtaagattccatttggaaaatttgctacttaatgtaattgaaaggctttaaattttaatgaccttttaatctagacaaagtcagggcgttttcttttttttttttttttttttttttttgacaaaaggtagggttctagtaagtacaaaggggtcacgaagaagataggaacttcttatctgttattttctggaataagttataccatacaattttatatcgaaagctcactaattcacagcagaaaatactgttttgtttttgaaaagttataaagggtcaggaataaacccaattttacttcacagcactgtagtatcaaaattaaaaggaaataaatttgctactagtttgaacctatttttaagaagttagcatttgtttttctgagttggtattttttgatactgcatgtatggtcttaacattgattttagtaaatgtggtatgtggagctgctgtgtatgtatgcatatgtatatgaatagctaaaagtatctgaaatgccaaattatgagatgggaatctatagttgagaaataatctttcataatatcaaattagaaagaaagcctttgatgacatagagaacacattatttatatcttgactggttgtggtttttcaggcccaccacagcagtactcaggccaggaagactattacggggaccaatacagtcatggtggacaaggtcctccagaaggcatgaaccagcaatattaccctgatggtaatctctcctgatgttaactttcccattttctatccctgcctaatattaatgtagagagttatttaaaacatttcagtgaggacgaagaaactaacaatttgtttcctctaaattttgaaacacttcagtactctaaagtaccaatgatagcattagtttataatctaattcaaagtatattttaggtgttccattagtaccatcaggaatcacagtctgtcattggaatccttatgtaaaaggatctttttgtaatatgtttagggttgtttgatttcagccaaagcttatgtttattgatttacttttttttaataagagcttcattaagatataattcacctgccataaagttcacccattagttgacttgtattaattgtacaaatacatagagtatatagttctcaagttatttttccaagtctcatcattttaattaatgtttcatacttctcaacaaactaaggtttacattagtgcttgcctttgagaaaaatttgggagactaaattatatccataatatagccatatagagattgagtagaatgggaaaggcaatttggaaataagatttttagttagggttttttgttttttgtttttttgtagaaagtggcttgtgaaaaattggttagtaagatgcactgtactttaggaaaatttgaatagcaataatccaagcatacaagtaggttttcacagtacagtttcatcaatttttctgtatgcttgaaaattttataatacagtgtagaagaaaaaataattcagaaatacattacaaaatgatgtgggttgttagggtttgccaaaagccttattcatgtatatgatcctttgatgtaaatataaattactgaacagagaaactaagaaacttaaagctaaagtattagcagccattgactagcagcccatgtaagctagcaagaagatacaatttaggatatttgaaaaaacatctcacctgtcattttttgttaatacataaaacataaaggtacatttgtacttaaggacattggtttttgttttgttttttcttttcatatgtaaacatggtattaagatttttttaaattaaaaactttagtaagattgttgtagactctacgtattttaaagacgtgaaatctactttgttaaattatatgtattaagaagtctgctgaaaataaatgattgtttctattttttaatttttaattacattttaaagagttaaatttgacattgttgttttgatcctgggtatctcttgaaatgtgacatgtgtattgttataacctttctgttcaaaatatattggtttgttattttgtaaatatcaaaacattaaggttactttaattcattttattagtggattttaatttgaagggtatcatttttgcataggtgtatattactttatatctgacatttacatagagtattctatttatgtcgacaattaatatttgtaaacaacattggctcttttctctcatgtccggatatttatgttagtaaatatatagattaggaattggcaaactttttctgtaaagggccagataataaatactttagtctttgtgggccatatggttttggtctcagctactgaactcttattgtagcatgaaagcagctatggacaatactgaaatgaataggcatgactgtattccaataaaattttatttacaaaaacttgccactggccatattaagactgcaggccatagtttgccaacccttcatgtaggtatttatgaggtggcttgggaacattagaatactagagcactgagtataatgttcatttgtaattttattcctgtgtccttaattaggcatttttgtaaaattgagtttagattttaggtaactaaaaggttatttcctacattttcttagtgaaactttaaaaaaaagagtgagagtatttttcactagagtccaattatctcgcaggtaaaatttattgtgctttaaaactaaagatatactctgtcaacacaatattaattttatgaagatgtatgtttatgatacttgaaatattttctaaagatttccaaaatggcagcattaagatatataattttgcatctgaagatactttgagatacttaactttatgcaagtaaatgttagaacttgaaaatttttcagtttctttcaggggaaaaacttatggaactcttttatattttgcattgtttttagcatatgctgtggaattggagaccagcagaacaggtgtttgacaaaatatgataattgcttcctttgttcattctaatttaatttaggttatttacatgtgaaagacttttattctctttgtttttttaaatgggagatagttttttttccctcaatgaggattatcagatttaagacaataagtgtaatgtttctaaaactactgctttttgcttttaaaaaaatttgcacgttatctcaatatgaaaacaatcacattggtaaatctttggctaatgcaattgaaattattttttatgttccatttctttttcttttttttcaattttatctgaaagtttaaatatttttagggttttcactcagtggccattaacgtttcttcctgtctcttgtcgaattgatgtaggtcataatgattacggttatcagcaaccgtcgtatcctgaacaaggctacgataggccttatgaggattcctcacaacattactacgaaggaggtatctatataccttcacacacatacacatatatatccccttctacaggaatgaaaattcttgcataagacaacttctacccatgcaaagctcttgtagaatactagttgctggctttcttgaaagttgcagggagcccaaaacaatcaaaataatttccttacaaatatttaaaatgtataaccatgacttgccatttctaacaataataaaaagactaaaacattaaagataattttttcctcagtggaaattttctatttgaacataaatccatcaaacttttttttctcgtgtgtgtttacatatgtataattttacatataagtatagtgcctttaggaaacagcttgctgatctcgtgtagctagtgtgtgctcttgtagctgtctttaattttgtcttttttattttatttagcatagtcatgatcttatgactgtgatgttccagtaaatgtaatgctcgtatggcagagacgctgaaaatgctgcagttcaaccttgcaaaattggctttaactgcagtttgtttggccgaaatccttctgtttggtttgagttttttctttgttttgttaacttctaaaaatcaatatggcatttcattttgttcttgtgttgttggctatgcatcttagagggaaaaaagttacttaagcagacttctcagttttttttcctcttctccaattatcctgtaggaaattcacagtatggccaacagcaagatgcataccagggaccacctccacaacagggatatccaccccagcagcagcagtacccagggcagcaaggttacccaggacagcagcagggctacggtaaagctttgtacagtgtatttttatcaccaaaaaaatgtgctgattgttttaaaatatggaagtggatatttaatacttatttttacaagaattatcacttgaaaattcagttttagactagtctactgttaaaatgttggtttaaaatgttgctcttagataaactagtaatccatttaaaaagaacaacaaactggagatggttcatgaccaaaggtaatgtgtggagtcatttaaaagacaagaaaaatgaattatcagatgtatttgtcatgcctagccctgtgtgtgctgggaaaactgatgattgggtaattattgaccatatgtatataatctgcttagcaaatttattttgaaaaactagtggccaatacagttttttttaagacatactgattttttttttttttgagtacaaatgagatctattcagaatgcataaagaaaatgtttttgtcattccctaaatagcaatatacgtatccatcgggatgaattattgcagctgtgtatcatacagaatttgggggaagtgtagcaatattttcctattatatactcacttataatacctgctacctggatatctgactttaacttcttagatagggagtggggaatgacgaggacctgatatttcagtcttaactctcaggctactataaccactttagatacaactctgttgaaagaaaagtagctgcttatgaatactgactccttctcttcctaacagggtctctttcacgtcggtaatatcttattatttttattcattgacttaagctctgccattgctgtggacatctttgtctacctgtgatagcaaatcttagaactcaggtcagactgaaattctcttgccccctcagcatacgtgttgaaactcagtcagatattgggagtcaggtatttttctaaaaatgtcaagttctgatttccagattctagatgtgactttagaaatattccatggattttttttctttcataaaggaactttcttgcccttcccaaatggccttttcattttgtgactacttagtatttatactttgaataaatacaatattctggttttattgcctttggatgaaaacagatgtaatgcagctaaatcaggtaaattcattgacttaagataaataccttcaatggtaagagagggtgaaagaaagcttaatttttgttgaagtattatagttaaatgctgttttgttagacatcaggaatcctaagagaaatttctattttgtttatccataggcttgtgttgtccaaaaaaaactttatttccactagaaataaagttttaataattgaatatataataaataataggctgatataatttatttaagcttgaaaacttgttctcttttgacacttttctctgaaatcagtgtttttatggcaggttttgaatggctacgatagaaaacatttaagtgtcaaagcttttcagcttatgctttttttttttttttggacggagtttcactcttgttgcctaacctggagtgcagtggtgcgatctctgctcactgcaacctctgcttcccgggttcaagcgattctcctgtcaacctcccgagtagctgggattacagtcgcatgctaccatacccggctaatttttgtacttttagtagagatggggtttcatcatattggtcaggctggtctcaaactcctgacctcaggtgatcctcccacctcagcctcccagagtgctgggattacaggcgtaagccactgcgccaagcccaactagtagagtttataaaacagacatattgtttagcaagccaagtcagtcccttgccatctctggaatttgtaatcatttttatgggtaaagtattaaaggtgattaattctcagtgtgacttttgaatcaagttttttcacatgtaacctgtgggttttcatgtttttagtttctgttttaaaatattttggtaacaaatttgtcaatgcatagtatagacatatacttttggtgattgcaaatataaatctagagtcatacagttgtaaatatcgtttattcctccactttattcagaagttatttcagtatttttctttgaatctgcctcttgctttctctttttcctcttgcttgtgctggttaacgctatcagacgtattgattaattttcttatcatcatggagttaacctgctttacaactccctgagtcttttttacccattttgaaatatattttgtaatggctagggcatagtacgataattatagtgaagtaacattacagtatttttactcttattattaccatccagatttatttcagaaagcatttgaggaaatcaaggtaccaaactatctttttttagcttagatagaaaaatacagtaacatctctgtagttcacatccttccctgagttctagggacttacctttttatgtgggtttttgttgtgtacattattttcaggtccttcacagggtggtccaggtcctcagtatcctaactacccacagggacaaggtcagcagtatggaggatatagaccaacacagcctggaccaccacagccaccccagcagaggccttatggatatgaccaggtaagtagtttgaccggctgcagaattgccacattgtttcttcactctcgattaggtgaacttttttttaaaatttatttaacttgaagcctcatgtttccctcatgagggaatgtttatggtacatttgttaacaaaaagtgtatcacttttgagattcatgctgtttaataacacagttgatcatagttactctatcatataaaacatggccttatcataagacaacaacatatatattctgtctctctctctccccctcttgctctgtggtctttaccctcaggcatactttgtttactgaggtaaagtatagatagagagtttatcatatttaccatttttgagtgtacatacagttcaacgttaataaattcatttggttccccctccgtgatcccttctcatcccttttcttcccaacctctggtaaccttagtgatttctgtgatcctccctgatgtttattgctgagactttgccttaacctactgagatgtggagtccatctgtgttgatgctttcatgagcactccacttcactccagcatatccactacacttccttcacacccataatatcccatctctttaaattaaaactttccgccctctgttgcctccttccacacacgtaactattatttcaactgttatttctcccctgtcattcttctttcagatatgtagaagtgtatctcatcctaggatgactgtattcccttgaacccagtgttcatttaactgccttatttttgtcattaaactcctcagacttgtaccacagtcatcgttttatgaatgtactcatatatactctgaattattatggaaatgatttattattatggcagttcctttaggctggtttcaggtttgtctgcacttttcagtgaaggtggtctggtttgttcaccacttaagctatctaaaataagttattttttaacaaggaactgtctttaatatgcagtttaggctttcagggccaacatcagtatctggtttgaggaaaaactcagatgcagtggtaactagaatttgaggcatgagcagttctttgatcagccctctctcatgcctacaaccctcttgtattgacacttcttatttaaggcaaaggagatacaaaaagcataagaacagataagtaatatttttcaaaaatatcctcaaacaaaacaaaaggatcagttggaggttttattaagttttagaagtgaaataagtcgtggctagtgagtatttaaaggcaggattcctgagcagataaaatttaggctcattgtaatctgcaggtaaactttttaaaaagtgagattctgtccatgtattccatcactcaacaaatatttattctccatgtgtttgatactgcagtaggtcctacggaggtaaaatagtcaaccagctgtcttgatcttccttgacctcactttagctattggcacattttcctttttcatttttagatggtcttctttagtttctatatttctgaaacattttgttcctctcgcgtttacattgattcattctttattgtttttattggttttcctttttattttaccctaatatcaattcttgactctgtatttttttttctagcctctgaatcatactgccctctattttcagtattcttagctcttacttctcaacccagtttcagctcctttttatccaaatgtacagaacatctcttgtctttggattccctcagctttagcatgttgtagactaaactgatcattttcctttctaagtcaatatatttccaaatctcctaaacttcaagccattcattaagcaaatgtttattgagcaaccattatatgccaagtgccatgctaagattgggaacatattgggaaataagatagacgtggactcagtctttatgaacttaagtgtagatggcatacaggtgggtaaacatatgatatgatacagtgtgataagtacttagataaggaaagctaagatttatgtggaaggagcttctaactcagatcttgagaaatattccttcggaaatattatatataagtgtgaagtaccaaggatgagccaatattagccaggtagatgtggatgatgaaagaagagcattcacaaagggactagtgttaaaccgtgtgtagttcagtaaagcagaagcatggggaagaagagacaagactggagagaggtgttggagttagcttaggaaggctcttacaagccgtattaggggacttgaactttatcctgacatcagtgtggagcttgaaaagcagtgtatataaagtgtgtagcagtggctagcacttggtagctatgatagatacatgatttacttcttttatcatcataattattccactctctaaagttctcaggaatttgggactatactgtgtggataaagactcatggtgtttgagtagttgccaaccacttctccttccccactagaaaagaatatgagggggggaccattttagctattttagtgccagtagtgtttctacattaacctaatgtttaaccttatctttagcccccacccaaagacctattgatctctttattttaggaaaaatagttcgttcacgtcttgatggttgaggcaatggaaaactaacgaagattctgaaacccaatactaacataattatagttgtagtttaggcagatgaatcttacagcaatatgcaagataaaaggggagaaattaaaagggtggaaattgttaggatacttccccatcggtccttgctatccagtaaacagtggttccattcttcctgttcctcaggttaaaaatctagagtcatctttgactcccctctttgcaaagcagacatccaattagcaaaccccttcacctcttccttcaaaatatatctaatatctagccatttttcacagtctcctttcacccaagtcaaaagtcacaactagcactcatctggactgttgcaatatatcctcctttttgcttttcttgattttatcgtgcctcctctacaagatactctgcacatgggacccagagtaatgttttaaagacattagtcacctctctgcttacaaccctgtggtgttttaagtaaaagccatatgatatactggcctacaaggccatataggacttgtgctcccacctcctatgctaccctccttgtgcctgcatatttatatcccaaccactcgctgccctcattcactctgcttcagtcacactggcctatttgctgttccttacatgcatcaagtgagtttctacctgagaatctttgtatttgctgcccctttttctgcctgaatgcctgcagtgcctccaacctcactttattaaaatctctgcttaaatgtcatcacgtcgtatcagagagtccttcactgaccacctaagtaagacataacaccctccattgcatcactctttttccctacccttttcatagttttttgaacagcttaattgaagtataatttatataccattaaactgcatgtaataaaagtgtacagtttgatcttttttgacacgtatatacacacctgtgaaaccatcagcagaatcgaagtaatggggtatctatcatgcccagaagttttccctgtgcccctttgaaatccctccacttgcatcccttctccagacattgttactgatcttttaactaaactgtggattagtttacattttccaaaattgtatagaaattgaataatatagtatgttctggtttttatctggcttcttttactcagcataattgttttgatacttatgttgtttgtgccagtaattgtttattgctaagtagtgttccattatatggctatttgtttgtccattgagatgggacatttgggtttacagacacagtactatgaacattcatggacaagtccctggggacatttttcttgggtaaatacctaggagtggaatggttggatcatatgataggtatatatttaattcaacaaactgccagaatgttttccgaagtagttgtaccattgtatattcctatcattttacattcttaccagcagtgtatgatttcacccatatccttgctaactcattgccaatatttggtatgaatcagtcttttaaattttatttattctaataggtgtgctataacacctcatgactttaatttgagtatccctaaggacaaatgatgttgaccatcttctctcacttatttgctacctatatttcttcttttcaggagtgtctgtttaaatcttttgctcatttttaaattggaggctctttattttttttattattgagtattaagaggcctttgtatatcctagatacaagtccttaatcaggtatcatttgcacatattttcatcctgtctgttttttcattctataaatagtgtctttcaaagacaggagagtctaaattttgatgaagcttagtttatcagttttttctttatggattatgcttttgggatcatgtgtaagaaatctttacctaactgaaggtcacaaagattttctcctgtactttcttctagaagttatataattttagagtttacatttaagtctatgattcattttgagttgatttttatgtatggtgtgaagtatgaaataaagtttgcatggctttttttctttctgatgcatagctaattttctcagagtcatttgttgaaaagacttttttttttttttttttttttttttttttagatgagtctcgctctgtcaccaccaggctggtgtgcagtggcgcgatctcagctcactgcaaccaccgccttccgggttcaagcgattctcctgccttagcctcatgagtaacgaggactacaggtgtgcgctaccatgcccagctaattttaattatttatttatttatttttatttgtatttttagttgagacagggtttcaccttgttggctaggatggtcttgatctcctgacctcgtgatccgcctgcttcggcctcctagagtgctgggattacaggcgtgagccaccgtgcccagccaaaaactctcttttacctactggattgtcgttttacctttgcaaaaaatcagttgtccataaacatgtgtctgtttctgaactctattctgttccattgatctgtttatgtatctttatgccagtaccacactgtcttcattagtatagttttataagttttatagttttaaaataagttttataatcaggtagtattagtttttgaactttgttctttttatacaaagttgtttggcactgtaagttctttggattccatataaattttagaatcagcttgtcagtttgtacgtaaaagcttactaggagtttcattgtaattgccatgaatttatagattaatttggggagaactgacagtattatttagtcttccaacctatgaacatggcatatgtcccttaaaattttttttaacagtgtcatataattttcactatataggtcttacatttatttttctaagtattttttgtgttttgatgctattgtaaattttttaaaattttagtttccagttattagttgctagtatatacaaatacagcttatttttgtgtattgatattttatcaaaactataactttactaaaatcacatctagtagtgtttttgtagatttcattgaatattcaaacatagaaatcatgttgtctgtgaataaagacagtctccttccttttcaatctgaatgctcccccatgttccttccccaccctcctgcttgcctcaactagaaactccaataccatgttaaataaaaatggtgagagtagacatcttttgtcttgttcctgatcttagagagaaagttgtcatttttcatccttatataagatgttcatgtagggttttttgtagatgtcctttatcaggtgttatatttctagtttgctgagaatttttattgggaatgaatgttgaattttgtcacatgatttttccttatctattgagggaattatggttttccttctttagtttgctaatttttgaattacattgtttgagtttcaaatgtgaaccaacttcatacctgggataaaatctatttggtcatgatatatatcctttttatatattgggttgattagctaaaattttgttaagaatttctgcatctgcatcgcttgagtccaggagttcaagaccagtctgggcaacaaagcaagaccccccacctctataaaaatctagccagtcatggtggcatatgcctgtagtcccagtcagttgtgtcctgacataacagtggttcaacttaggttttttgacttcacaatgctgtgaaaagtgatgtgtatttagtagaaattctacttccagtaactgtacaatcattctgttttatattttcagtgcagtgtttaataaattacatgaggtatgcaaaacttaggatattttcagcttacagtgggttaattgggacataaccccatggcaagtcaaggaacatctgtgttttcatgacaaattttggaatctgttttttttttttcttgtaacatgtttgtctggttttgttactgaggtagcactggtttcatagagtgagttgggaagaatttcctcccttcagaaaattggcattattctttctaaaatgtttggtgcaaagttaccagtgaagccatctgggtttgtagttttttttgtgagaaatttttaaattataaatttaatttatgaaatatagggggtattcaggttatctatttttttcttgagtaaatgttttgtgtgtttttcattggagttgtccattttatctgtgttgttgaataatttctttatcatcgctcaatatctccataatctgtagtgatattacctctctcatttctgatattaataatttgtgtcttctctctttgtcctcatttatctggctagttttaatctacctattcatttttctcaaaaagcagctcgattttatttattgccttttgcccatttgcttttctgtttctttgatttctgcccagaactttattatttctttttttctgcttacttgggttttatttgttcttatttttccagtttcttaagattgaagttgtagtcccattgatttaagaactgtctttctttctaatatagatgtttctttctaagtattcttaaactgcatctgatgctgttatttttaatcagttcaaaatacatcctggtttcactttttatttcttttttgacccacaacacatcagaagtgtgcaatttcattttcaaatatttggagattttcaaatctttctgatgaatttactcctttaccattatcaaataactgtctttatccctgccaatattttttgctctgaaatctagtttgtctagtatcaatactgcaataccacttttcttttgattagtattagaataatatatttttcatccttttaacatatttgtttttatatttaaattatatttcaagtagacagcatatgtagtcagtcggatcttgctttttttaaatccagcctgccaattgctgcctttaaattggggtttttgacatgtttagtgtgattatggatatgattaagtatatcatctttattttttctatttgtcacatctggtttttgttctccttttcctctttttctgccttcctttgatttttctcctctttttaacaaaaacagctttattgagatataaatcacatatcatacaagtcaccattctaaagtataccattcagtggtttttaagcatattcaaaaaggtagactgggggtggtggctcacgcctataattacagcactttgggaagctaaggcaggaggattgcttgagcccaggagttgaagaccaacctgggcaacaaagcgagacccccacctctacaaaaaactagccaggcatgatggcatgtgcctgtagtcccagctcttcaggaggctgaggcagaaaattgcatgaacccaggaggtcgaggctgcagtaagttgtgattgtgtcactatactccaggctgagtgacagagctaatatcctgtccccccaaaaaagtgcagccatcaccaccctctaattttaaaacattttcaccagcctgataaactgtatacctattagcagtcactcctcattcccctttaactactcagccttaaatacttaaatactcattctgtaatttcgttttcaaatatttggagattttccagcaacagtagtttactttctatctctatagatttgcctattcagtacatttaagataaatggaatcatacaatatgtggagttttgtgactggtgttttgttttttttacttaaaataatattttcaaggttcgtctgtgtagcgtgtatcagtgtcttcaagtgatagtatgcctatacatagtgtaagaaccttaaggtagtctgcttttcttctctttgtgttattgttacaaattttacttctgtatacgttataaaccccacagtgtattgaatttatttttgtctaaaaaaatcagttaaagatacttaaataataaggaaaaaaaaatttttaaattgacccatgtagttaccgtttttggtactcttcattatttatgtatggattcatattactatgtggtatcatttttgtttgcctgaaggatgttaacatttcttgaaatgcaggtgtactggtaataatcagcttttgtatgtctgaaaaaaatgtttattttgcctttatttttgaaagatattttctctgggtatagaattctaggtggacagtttgtttttgttttctttccatactttaaagatgctccactcttttcttccttacattgtttccaaggagacatttgctgtcatttatctttgttcttttgtagttaatatgtcttttttctctgtttttaagattttccctttatcaaattgtttgattgaagaaatttctctcttgcccaaattgttttgagcaatttgatgagagcatgcattggtgttgatttcttcatgtttcttatgcttggagtttgttgagtgttatctcagactttgtcattttcatctctacaagtttggtttaggtctttttaatatcttccgtgtctgtccttaattgttttgaacatatggaatacaaatataattcttttaatatcctcttctgccaactctaataatctatgtcattttagggtcagttttaatcagttttttttctctgtcctttgtgtgcgtgataatctttgattggattccagacattgtgaattttatgttgggtgatgaagatatatgtatacctagagatattcttaagctttgctttgggattcagtttaataagttacaaacagtttgaactttctgaaattgcttttaagatattctaggcaggacaaagagcagtgtttagtcctgggctaaatactcatcactgataaggtaagagccttttgggtgttttgcccaatgccctttgaattgtaaggctttttactctgactggtgggaataagcactgattctgttcctatgtgacaaacaagtattgtttcccctaatccttttgggtgtttcttgcctcagccctgggtattttcctcacacatttgcatatctgtactatgctgaataggaggagggttcctctgcacatctccacagttgtctctttaggcagatctttcttgtagggtactctgtcctgttaactctagctacctttttctctccagactctaagccttatctccttaagtcagaacatctggcagactcagcctcagttccccttcgtgcactgcagactggaaactctcaaggtagttagctgtggtagtcagagggctggcctcatttgtttaccatgtctcagggatcattgtcctttgttggctctgtcctgtgtgtcctgaatatgattatcatatgctttgtgtagtttttttttttttattgtttcaggctgccagataaatccatcttgaatagaaacatgcattaatttttcaacataacatttctcttcatttgacagattattttgttactgtttattgtcatattcttcttccccaagaatgtaacctctttaaaagcatcgctttgtctgtttttattactgttgagtctctgtcacctagtagagcacagcacataatcagtaaatattggtgaataaagtataaacaactgagtaaataaggccattactttctagatttgaatgcgtgatcacaagaccagagttaagaggaaacccctaaaatgttgtgaaggaataatgttaagattttaaactgattaggtaaatagaatgaaggaaagaaatgtaaagattttggtattgctcagatttctaccttaggaactcttctcattcaatatactctccctaggcattctcatttattcacaaggtctcagttcaccatgctgttgactcccaaatctctatttatagtctcaatctctcttctggaaattagatgcctactcgacagctctgcttagatgtatcataggtattaattcagcagaaacaaaataaatttataattttttctaccaaaacttttctgtgttctttatcaaagagaggggtactatcaccaagctagattgccaagtgcctgtttggtatttaagtgtccctgcttttcctcccttgtctaataaatgacaaatgttattgatcttcctttttgaaaagcttttgaacccattcatttctttctaacctacacccttatcttagtttagaccatgttcatctcctgtcttcatcgcagtaggatcttccatactgtcttctttcccattaaaattctttatactgtagtcagaggaattttttttaaaaattgaagagcaaagagagagaaggtgaggcttagagtgttcaagtgatttactcaagatgacagaattcaggagtggtgaagctgcatgactactgctgagtgctgaaagcccatgctctgttcactgtaccatgctgccacccatactgttaatgagtacttgagtagttcacagagcattttcatgtttttcttcttgaataactttttaaaatagagattataattacccttgtcagatgataaaattgaaactcagggaggttaagcaacttgcccaaggataagaagctgttaagtggtgacgttagcactagaaattggtttctggctccaaaacccgtacttttaatccttaatgccaccttggaatttgttaatggttgcagatacacagcctacctttttaggcatgattgtggttttgtttggtcctagcattgtgatcaagtatgggccaagttacttagactctcagtgcctccatttcttcttctataaaatggaggtaatatttactatatatagatggacacaaagcatttaatacaatatgtgacacaaactgaggtattattatcagggtatattattagcttctactcctcattattgcgtattctttcttcccacttccctaagcattctgtgttttatcctccatgcctttgtttcagctatttcttctatttgaattgcccccttttcttttcttcttttctgctattcagatcttactgttttctcaaggctcccacattcttgggaatatttttctaattaatttaggctgtgttaaccttttcctttctgaactctcttaagtttgctaagacttagagaacttatctgttttgtaattataccttaatttctgagtcttctctgttttccacatttttgatgatgatgagtatttgttccataagtgttcacagttgcttggatataatttatttggtatacattattgacctggtctctttcaagtagttcataatacagtagataaattatagcttatatactatggtacagtggttcttaacctctcttctgctttcacatcatttatatttgcaactcactttcatcattagcatctcattttatacattgactaggggagcatttccctccatcattgagagtcactgatttataattctaaaaagcgctttctcatgtcctctcctatttaagcatcataacaaacagatgaggtacaggaattaatgtagccattaacagaagggaaattgtgatccagagatatatatgttactctcccactgatgattgaagaaaccgagtctcacagaggtttttttagactcaaataagaagttagcaatagagttggaacttaaactcagatttagtatttagacaatctaacaatggaataataagctccagtatgctaaccaataactttcttattttaaaccttttattatgtttattttaaacacatatagaaaagagagtaatatagtgaacccctgtgtacccatcacccaacttcatcagtttatcaacattttgccaatgttgttttatctacccctctacactatttttttcagagtattttagagcaaatcttagatgtgatatcattttactcataaatccttcaagatgatcattgatttaaatttagctgaatataactatgtaaaacacactagtgtaaaatccctaatctcttttttttttttttttttttttttttgagacagagttgctctgttgctcaagctagagtgcagtgcaacctccgccttctgggttcatgcaattctcttgcctcagcctcccaagtagctgggattacagatgtgcgccaccacgcccagctaatttttgtatttttagtaaagacggggtttcaccatgttagtcaggctggtctcgaactcctgacctcaagtgaatcacccgccttggcctcccaaagtgctgggattacaggtgtgagtcaccatgcctggcccataaaatccctaattctgtttaattcattattccatcatatatatggtgacattcaacacattatcatgtgtatttacttctgtggaaatgtagatttttagggtaccatttcttatggtagagaagtatttcaagtctagaatgtttttgagttatattgttgtgacgtggagagagagttgtttagccaaaggaaacagttaactaattatatgcttccagtgagtcatgctttttgaaaattagtgcttttatgaacatctgttttaaacacatttaagaaatttgtaataaaatacatatttcatagtatgtctttctttttttctaccttctgttttagaggaaaagatgttgcttatcttctccaaaagttaacctgaacagatgtatactggacattgtttacccccactcacagaattgtgctgcttcatcatgtcccttcgtgctgcttcatcatgtcccttttgtctatattccctttctgtctcatcctgtcatcctgagggtcttcaagtctaccttattaagaaaacaaaacagacaacacaaaacagctttccttgattttatgtccctgtggcctgtctaaatacctctgctgaactttgttgacctcagggaaaggctcaattattttggtatggatagaaggttctttaccttttatgtcccacatacctttccattttcacttgccacttattgcaaatacccttgatgttcatttgtaataattataacaagctaaacactcacaaagttgtcacactagcatatgatttacaccctaatatatatattacatcagagtttagaactagaacttctcactcaatgcctgctcaattcattcaacaaaattcactaaacatttaagttcccactctgacaagtattattctaggctcatttgctaatccctagcatattttggactatgaaattcatttgcaattgaatataatatcagaagaaattacagggtgatactgtatacctaacgatataaaaaaattttgtttattgtaggtacggctgcttttttgtggtatgacagtgttagaaatgattcgtttgtaatcttctttgcctgttatggtcaaactattatctaattatatttttaaatttatcttttagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggagcatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttacaaacctttgtttcaactttcttatctggaaataatatcatttataaagggacacttttatgtttttcccttttttatgttggttgatataacacaaagagatatttaggaaaatgcttattgatgaggtttattctatctgtttttaaagcaccgaggttgcattctagataaccttgtttattagcatggcatattttaatcattatttgagactgtcctgtgcctgattattttagctaaattcagggagattgcgtggggcaggaaagcatgcattgaaaaatttctaaccacggttatttaagcataatctgaaaacatctagcccaaaggtaagttgctattttcatcacagttgcctatgcccagggaataagatgtattctttataattgaattggtttttcccacgtctaactggaaacaaaacagaaggggcgtcataaatttgaataagcagaacatactgttctcaacatactgtaatcaaaaggaggaatttcagtgggtctctgtgtgtgtatgagagagagagtgtgtgtttgtgtgtttcaaggtcagaacaggtttttttgtttttgttttttgttctttgtttttttttttgagatggagtcttgctcttgtcgcccaggctggagtgcagtggcgcaatctcagctcactgcaacctccgcctcccaggttcaagcagttctcctgcctcagcctcctgagtagctgggatgacaggcacccgccaccacacccagctaatttttgtacttttagtagagacgaggtttcgccatgttggccaggctggtctcgaactcctgacctcaggtgatccacccgcctcggccttccaaagtgctgggattacaggcgtgagccaccgtgcctggccagaataggttttttctttcaacttgatcagtagaaaatggacatcaagtttgaacagataaatcatggacagccttattgtgattgaaatgcttgtaggttctgtgccaattttccaccactgtgtactttgttgctatttaaaactgtatcaactctaacggaagaataaattatttgtgattttaattttctcatttgtttctttaaattagatctctttgactctcttgtcttgtctggagactatgctgtgggtttttatataagttagtccagtataagcagactatatttgtattctaggactttatcaaaattctcttgccatgcccaagttaattagaattaaccgttcagtaatcagcatgttgtgtaggctgtttgttacagaattctttctccgaaaatgaagtccataaggctataatcaagatgactgaattagataaatgagttgaggagacaaaattgtactgaacccaacctggtgtagtacgttatctcatttgaaataagctcaactgacattaagaaataatttgtcttgccaacccatcttctgttgtcttattctccttttaatggaaactaaaattgcaattttaataagcagaatttcctccaggactttcttcctggagactagtgcatttgcaaggtttaattgttttataacagtcctattttgtaaaagtttttaattggtggtgacaaaaattaccttactcctctgatacctagtaagaggaataactttaccagtagctgtctactagatttgacatttctgtacagactatatattctacaactgaaatttgcattttatcgaagtaataatatcatactatcccataaaattccagaaacaaagtattaccaagaaaagagtggggtcactattaaacatttcaaaatatgctaagtgtgttagttctgttatttgggaatatgttattattctgtagcattattcaggtggcacattgtttttggttttctcttaaaattttttaatggaatttttaaacatacacccaagtgtagagcagagtatggtgcgatgggcccccatgtaatgttaacccaatttatatacttagcaactcatggcgaaacttctgattgttcatacactaacccccaaatagaaacaaacgctatattatttaatcacttaaatattccagtaaacatatctaaaagtacttgaagattcttcttgctcctaaattctgtgttttcaatgttaacattgaattagaaaccatctgagaatttgtacgtataagtcattgccttttctttcattttaaaaagtcattcatgttaaataaaagattaatagacatacattatacaaagagttaacatttttcataatttcatccattaaaagtcacaattattaaaaatttggtacttttcttccagtttaactttacacaataagccaacctatatgttgttttttaaaacaaaaacggaattatactacatactattctgcaactttcttttctttttaacttagaaatatcttgaatgctccttgttcccttgttgcctcttaattttttactgttgtagaaacaaagcttttataagctatattgcagagttgtttttttggggttttttgtgtgctgttggggtatttctttacagtaaatttttaatatcttaggtgtaaggctatggatgttgaaaaaagtatcaccataaaaggtatatcactggcaacaccagtttcattagtcttactaatttttgcaattctcatcaattttttaaaatgttatctctgaattttatttgaattgca

SEQ ID NO: 12518 - DNA, 34310 bp, Human
atcacttgaacccgggaggcggaggttgcagtgagccaagatcgtgccactgcactccagcctgggcaacagaacaagactctgtctcagaaaaaaaaaaaaaaagttagaattgaaaggcaagtgatttggcaccaggcatagtagctcaaccctgaaatccccagcactttaggagaccagggtgggaggagtgcttgaggccaggagttcgagaccagcctgggcaacacggcaagacccctaattctacgaaaaaaaatttcaaattacccaggcatggtggcacacgctggtagtcttagctacttgggaggttgaggcaggaggatcacttgagcccaggagttcaaggctgcagtgagcacgattgtgccactgcactccaacctgcattacagagtgaaactttctcaaaaaaactaaaataaaggcaagtgatttggttcctggttaaggcaagcaggctggaatggaaaagcagccatgggccgggcgcagtggctcacgcctgtaatcccagcactttgggagaccgaggcgggcggatcacgaggtcaggagatggagaccatcctggctaacacagtgaaaccccgtctctactaaaaatacaaaaaattagctgggcatggtagtgggcgcctgtagtcccagccactcgggaggctgaggcaggagaatggcatgaacccagaggcggagcttgcagtgagccgagatcgtgccactgcactccagcttgggcgacagaacgagattccatctcaagaaaaacaaagaaaaaaaagaaaagcagctatgatcaccaaagatcagtcagacctagaggcctcttctctcatcccggaacgtgtacctcatagaacttttggctttccaggatactatacatattaaggtcctgatattaattcacaggtccagcatgggattcacatcctcaaggacatggccacctgcacttctgagttgtctttgagtggccccaaactggatctttgcaggttccagactagtggggctggtaggacaatctttgaagctagaccagttactgggcctctcaggaagaggcacccacaaccaccatcctgaactaaggtctgagctggaggttctccatttggtcaagtgccagttggtgaattccaagagtatcagagatatctgaaagtgactcagaccctctatgggactatgggtggtccttttgcttatttttctaattgttctacaacaaaatgtgttatttttgtgattacaaagagtatatgtctagcggctgggttgccaggtgcattctatttattggtatcacactggtctttgctttataattacagtatttgttaaaatacaaatttgtttaaagactttcctctgtgtatgctctcttccacaattttcaaagtgtttaataaggtgcacatatttggttttcttttttttcttttcttttttttgagacggagtttcgctcttgttgcccagactggagtgcaatggcgcgatctcggctcaccgcaacctccgcctcgcgggttcaagcgagtctcctgcctcagcctcctgagtagctaggattacaggcatgcgccaccacgtctggctaattttgtatttttagtagagatggggtttctccatgttggtcaggctggtctcgaactcccgacctcaggtgatccacccgcctcagcctcccaaagtgctgggattacaggcgtagagccaccgatcccggcctgtttttcagtctctaatacactgttccgcgtccctagcatagtagctgttttctgtaaattcggagcgaagttgactgcaaaacccgccgggttcaccggcctgggcggtgtggacttcaagccccaggaggcattgcggccggcacatcgggaactacggcgtctgagaagggggccgggccctccggtcctttccctcccagaagcccgcgggcggctcggaacgctgtttctatcatggccgcgggagccgggacggcgggccccgcttccggcccgggcgtcgtgcgtgacccagcggcgtcacagccgaggaagcggcccggccgggagggcggggagggcgcgcggcgatcggacacgatggcgggaggaggcgggagtagcgacggcagcgggcgggcagctggcaggcgggcgtcccgcagtagcgggcgggcccggcgggggcgccacgagccggggctggggggcccggcggagcgcggcgcgggggaggcacggctggaagaggcagtcaatcgctgggtgctcaagttctacttccacgaggcgctgcgggcctttcggggtagccggtacggggacttcagacagatccgggacatcatgcagggtgagggccgggccgggggaggggggttggagcgccggggaagggggtccgggggaccgggagtcgggactgggggtcgcccagccaacgatgtcttctctcccagctttgcttgtcaggcccttggggaaggagcacaccgtgtcccgattgctgcgggttatgcagtgtctgtcgcggattgaagaaggggaaaatttaggtatggctatttttgtgttcttctctgggcttacttgcgtagggttttgttttaaaacttatatctagaactgaaggattccaggttaaagtgcgatagtttccatcagagtggtctttttcattctacgatgggtctgttttctggctcgactggctctagttttctccggttaaggttgtcttggctgcttttctgtgttttttttaaatcttctcccacctgttaattgctcaccccaactttgctcctgtctaaagtgagttatgttcatatggacatcttttttcccccatggtagagagtttttcagagtggaagtactctgacatttttcccctctgaatttaacttgaaagctatttagctgttgtcagtttcttgccactcgtatctgaggaggatgggtatattctgaatttgagaggcaaatgcaggtatttaaaaataatttttttgcctgtcttgacaggtgttaaaaaatggtcacgttaaattcattgatttgaatttggacccttatcgtgtatgtcaacctgtagcaaatatgtcaaaaaattaaatgcaaatcttaccatatttgcatgctccatttccataaatatatatatataatttttggacataacttttttacccttagaaaagagcttaaaaatgaaaactgtgctttgtcctagactgttcctttgatatggaggctgagctcacaccactggaatcagctatcaatgtgctggagatgattaaaacggaatttacactgacagaagcagtggtcgaatccagtagaaaactggtcaaggaagctgtaaggctctatttttatatcttttttctttgaccaaaaatcaagggtctttgaggatacagcacttactctttactgtgtggggcagaggaaaacagcaatggggagagattgagcaagcaagaaagcacacacacagacgttatttcttcaggtgtctcctttcccacccaggcttgggaagtaatggcagttgctcagtttttgtgatttgggtggtcttccttgtggctttggcattgaagctctgacattttggaggttactgcaccattcgggagcactctacaagggccttaagtaactctggcctagggtttggtcacccttgtttataataaaccaaggagataaactggggccttggaaaatgtggtactgactttgagttctttctgtctgcagaaagaggggcttagagaatatcccttttgaacagatagattagaatcagaggtgctgggataatgagccagctagcaaaatagtaatggtagaagaatgatagaaatccggcacaggcagtgttcttgaattcaagaaaaaagctaatggagtgtctaggaatttgggattgtcactgtgttgtggctcaggtagcttcaaacagtagaaattattttaatttaaaacatagaagtggctgtgggaaccagttagaaaaagatttttcttcccccaaaaccaaggctggggggtgtggaagcagatgcagaggtgaagatggaaaacatcagctaagcattgccctggtggtagaaaatagggaaatggttaagaaaagagcacccctaaaaggatgggatcccaaagatgggggtggggtagaaagaaaaaccttgcttcacaaggaaaacctgtctcttggctgtgtacattgtacttgggtaccctattaaaaaacaactagtgtgcatgaggtgcacatattttatttatttaattaaggaccttgggcagatactacttttggtctggtaaagaaatgcttaaatattagtcatttccaaggaagaataatttcaagagtacatttttagtataggaaaatcaggtttaggttgaggggaggcatatgccagaatagacattatcaagggaggagaaattcatgcctactttcagaactgttaaggatcttttgaatgggtaccagtttagaataattcatttaacttctattaagtacacattgagtatcccttatccaaaatacttgggaacagaagcattttggatttcagattttggaatatttgcattaaatttagtttgagcatcccaaatccaaaaatctgaaatcccaaatgccctcaaatctgaaactttttgagtgccaacatggcactcaaaggaaatgctcattggagcatttcagatttcggattttcagatttaggatgctcaacctgtagcaactcctttagaacacaagggctatagatttgccatctggcccctcttctggaagagtctttgtgggctttcatctttcagctgcgtatttattattattatttaggctcatagagctccttatttgggtggttcattaggaaaaatctattagaaaaatctaagctctcagagtagccattttcttacgttgactctgttctccttttccagtctccaccacgtactagatcttatgcttattgttactgcagtgtaacaagttactccaagaataagcagctcaaaacagttaatattatctttcagtttccgaggatcaggagtctattagtgattctggctcagggtttctcatgaggttacagtcaagctgtcagctaggtttgcagtcatttcaagactcaactgcttccctactcacatagttgttaacaagactcactttcctactggctgttggctggacacttcagctcctggcctcttcacagataaggctgcttgcaacatggcagctttgttttcctacagcaaatcatgcaagagagcaagaacccaaggcagaagtctcattcttgtagagtctaatcttggaagtgacacattatcacttccaccatatgctcttggtcatacagactagactcactctggtagagtgtgaatgggactccgcaagaggtgaggcgcattgggggctgcctttgaggttggcaaccacaattaccttgatctcctagttgttaaatgatattatttcatccatctcttcaatttactttgtaaaagtttctcatttacagtcacggaatctgttaatgatcgggaaaattctacagacgcctaggttcagtgagccttgctcatgcatttaagctttgtaaagtgccaaaacaatttatttaaaagtatattgaatctttcgcaaagtttatcaagtaagttatttgttaagttagaaccctcagtgcatggtctagggatctctggaggtccccaggaccctttcagagaagccatgaggtcaaaactgttttcataagcagaaccaaaacattatttgactttttcaatgcattggcatttgcattgatggtacaaaagcaaggatgagtaaaatgggtgattccttagcgtgatcaagatggtagtaattgtactagtagtcattgtattcttcactgccacaattttttttaaaactaccaattttaattaagaatgttagtcacagttgtttaaaagctcagaactcccattaaaaaaaaatttaaaaaagaatgtctttggtaaagcagcaaaaactggatgaattttattaactctagagccttgagtaaacatcttttcaggattttgtgtgttgaaatagaaagtatgggccaggtgcagtagctcatacctgtaatcctagcactttgggaggctgacgtgagtggatcgcttgagcctaggagttccagaccagcctgggtaacatagtgaaaccctgtctctacaaaaatacaaaaaattagctgggtgtggtggtgtgcacctgtggtgtcagctacttgggaggctgaggcagaaggatcacctgagcctgggaggtggaggttgcagtaagctgatatcatacctctgtactcgagcctggacgacagagtgaagaccctgtcaaaaaagaaaaaaaaaaaaataagaggaagtatgactaaaatgtttctgctgcataccaaaacatgatggttaccaggaaaagcacttgtgttattattagagttgcatgctgaactagctgcttttttatggaatactattttacctgaagaacaactgacaaattacagttgttcacacttgggtatttggcagtcattttcttgagaatgagtaaagcaaacctgtcacataaaacaagtgacagtatttgttgccagtgataaagtttaagctttctagtgaaaaacagaattttggaaaacttgtattcatgtgcttgatagcttcccaatacttagtcttttctgaagattggtaatattaacaactgacatttaaaaaatattttttaggctgggcgcggtggctcacgcctgtaatcccagcactttgggaggccaaggcaggtagatcacctgaggtcaggagtttgagaccagcctggccaacatagtgaaacctcgtctctactaaaaatacaaaaaaaattagccaggcgtggtggtgggcacctgtaatcccagctactcgggagactgaggcaggagaattgcttgaacccgggaggaggaggttgccgtgagccgagatcacaccactgcactccagcctgggaaacagtgagactccatctcagaaaaaaaaaaaaaaaaattaatgaatgtgtcaatatttgaagatcttcataactcagtgaaccagtattttccagatgaccaatgcatgatgttatgaagtcatccatggatgaaagatctatttaaactacaagatagactgatggattttttttttttttttagacgtagtctctctctgtcgcccaggctggagtatagtggcgtgatctcggcttactgcaagctccgcctcctgggttcaagcagttctacacctcagcctcccaagtagctgttattacaggcgcccaccaccacccctggctaatttttgtattattattagaaatgggtttcaccatcttggccaggctggtcttgcactcctgacctcatgatccacccgccttggcctcccaaagtgctgggattacaggagtgagccactgcgcccagctgactgatggattttaatgtgacagattaagaaaagtttacttactgcagtttcgtgtagaatcaaacaagaatagccacagttttctgaaaaagctattaaaatactcctccattttcagcttcgtatgtgtataaagccagatttttaaaaatgccttaaccaagggtagggcatggtggctcacacctgtaatctcagcactttgggaggctaagacgggtggatcacttgaggtcagaagtttgagactaggctggccagtatggtgaaaccctgtctctaccaaaaatacaaaaattagccgggtgtgtggcccgagcctgtaatcccagctactcgggaggctgaggcatgagaatcgcttgaacccaggaggcgaggaggctgcagtgagctgagatcacatcactgcactccagcctgggtgacagagcaaaactctgtctcaaaaaaaaaccccactctaccaaaataacacatcacaacagattaaatacagaagcagttatgagcatccagctatcgtctatattaaaccagatattaaagagattttcaaaatgaaaaacaaatgtcacccttctcattaaacttttatcttagtaaatgccgtaatttttcataaggatgttatttatgttaccttgtaattagtttattgttattttctaatgaattaataaatatttaaaattttctgatttatgtttctaatacagtgaatatcagcaaatataacctacataaacagaaagctctttgagggtctgcagtaacgttttaagaagaatataaaagaatcctgagaccaaaaatttgagacctgcttctgcaagctgttaattatatcaagactatatttgttttctcctcataactaaaggagagattgatctgttaggtttctttagagaacaaggggtagcaacacgtatagcatgtccttgaagcatttatatgttgctttttactatgcggcattgtcccctgcagctttggcaacagcagcttgatgttctttgagggccttaccccatttggggtgcttgtatatcagatacactctgttagaactttacatttgaaacaaaaatatttgttgaggctttttaaacattgctgcttcccagaacagccttgcttctttttgcatctgcttctttattcttcagttctgtgagtttggtcttcttctcttcctttgttaataaatgtgctttctggcatttcttcccaacataaacctaccttacctattttgaaaatctgtgcttggaatttcccttttatttaacttatccagagaccattgatattgcttataccctagaaaccttaacaaatacgtaagagaagaaactatacttacttctgggaactgccaagtgaaaaagcagtgattcatctttttaatttccccccccccacaggaaattaatacatagttttaaaagataagctcatagcacaacctttgaagcagacttcttcatttcaatttgaaagcattcatatttcctttcttgcttcacacattaaatatagaaggatatgtgttccaattctggagaacatagagtaaacatactctcttctgtctctccctcttaatgtaattataagtcttggacagaatgcatggagtagctatctgaggattctatctggaaataggcatatagggaaggagaccagaatttgaagttccaccaaaccagtgatgaatagtttaccattttttccttctctggtgtcacccagcccagactcaaaggcagcctgaaacctggaagtgcactccaggtgtgaacagaaagagcaccaagagaagctttctctttctggtctgaggagcaaggaaggatctctcaagggtcagagatggtgaaagaaatcccagttttttctcttttttcgcttctttcttgccctggcccccaggcaatactatcctggtggcagcagctgcctagcaatgacggtggcaacagggcagacatctaaaactgaaggaggagaactctttttctcaccaaaggagctgtgatccccagaacatggaacaaattccatagccttccactgtctgtcctgctgcttggccctgggtgcagatgcagttagtgtgtgacagagtggggaaaccaaagtccaggaatgcaaggctgcttcagtatttgaaaatcaatcagtgtagtccaccatattaagagaaaaaccatatgatcatataaattgatgctgaaattcacagaattcaacattagttcatgataaaaacactcagcaaactaggaatgaagggaacttcctcaacctgataaaaggtgtctacaaaaagcccacagctaacattcttaatggtaaaaattggaatgctcaccacttgtattcaacatcataccggaagacctaaccagtgcaataaggcaagggggaaaaagcatacagaatggagaggaaataataaaattacttctttttgcagatggcaggactatgtagaaatctcatgaagtatacaaaaaaaaaaatcctgtaagtttagcaagatcaacacaaaaatcagtcatacatcacatgaaaacagcattttaaagtaaaaaaagaaaagtcagtcatatttccatatactagcagtgaacaattcaaaatgaaattaccaacacaatgccatttacaatggcttcagaacagaaagaaatacgtgtaagtctagcaaaatgtgaaggaactgtatatggaaaattgtaaaatgctgatgaaagagattaaggccaggcagcactttgggaggctgaggcaggcggatcatgaggtcaagagatcgagaccatcctggccaacacggtgaaaccccatctctactaaaaatacaaaaattagctgggcatggtggcatgcgcctgtagtcccagctacttgggaggttgaggcaggagaatctcttgaacctgcgaggtggaggttgcagtgagctgagattgcagcagtgcactccagtctggtgacagagcaagactccatctcaaaaaagaaaaaaaattaagactgaatgttcatgttcatggattggaagacataaattaagttgccacttagctcccgttgatctatagagttaatacaattccagtcacaatctcaacaggattttttcttttttttttttttgagatggagtcttgctctgttgcccaggctggagtgcagtggcacaatctcagctcactgcaacctccgtctcctaggtttaagcgattctcatgcctcagcctcctgaggagctgaaattacaggcatgtgccaccgcacctggctaatttttgtgtgtttttagtagagatagggtttcaccatgttggccagactggtctcaaactcccaacctcaggcaatccgcctgcgtcggcctcccagagtgctgggattacagacgtgagccatcgcacccagcctagcgggattttctttcttttctttgtctttttctcagtttttttttttttttttcaatgtgacaaggtctcgctctgtcacccgggctggaatgcagtggcataatcatggctcactgcagccttgacctcctgggctcaggtgctcttcccactttaccctcttgaatagctggaaccacaagcatgtgccaccttgcctggctaatttttttttttttttttttggtaaagatggggtctccctgtgttcccatattgcacagtctggtcttgaactcctgggctcaagtgacgctcccacctcaaccttccaaagtgctgagattgcagatttgagccaccctatctggcctcagcaggattttctatagatacagactggctaattctaaaacatatggaaaagcaaaggaatttaaataaccaaaaagtgttatattgaaagaaaaatttggattcatactacccaattttaagaattatgagaaagttacagtaattacgactatagagattagtagaacagaagagagcatctaaaaacagacccacacaaatatgactgattgatttttgacaaagatgtgaaggctattcaatgggaaaaggatggtcttttcaacaaatggtattgaaacaattgaatgtccatatgcagaaatgaactttgaccataagctcacatcttgtacaaaaattaactcaaaattataatctaaatgtaaaatgtgaaaccataaaacttagaggaaacatgaaggaatctttatgtcctggagttaggcaaaaaaatcttagataataatttaaaaacatccataagaagaaaaattgatgaataggacttaatcaaaattttaaacttttgctctgagaaaaacactgttaagagaatggaaaagcaatcgacaggttgggagaaaatatttacaaatcacacctgacaaagaactggtatctagagtatatgaagagctctcaaaagaaacaagtctatacaaccctagttttaaatgggcaaaaagctcacccaaaataatgtagatggtaaaaaaaaattacatgaaaagatgttcaacatcatttactcattaaggaaatacaaattaaaaccacagtagattcaaataccaattagaatggaccaaactttaaaaaatactgatagtggggcatggtgtcacatgcctataatcctgctacttgggcacctgaagtaggaggattgcttgaggccaagagtttgagttcagcctgggtgatatagaccctatctcaagaaaaattaattaaaaaaaaaccctaactataaaaagtgttagttacatatttcaaaacatcatgttgtacataagtatgtgcaattttcatctgttttttaaatagagatgggatctcactgttgcccatgctggacttgaactcctgggatcaagtgatcctcctaccttggccttctgaagtgctgagattacaggcgtgagccaccacacctagcctattttttaaaaagcactagtgaggatgtggagcaactggaactctcatatattgctgatgggaatgcgggatgatacagctactccagaaagtagtttggccatttcttataaacacattttccatgagaccatgcaatcctattcttgggtatttaccttagagaaatgagaagttttaccttagagtaaatgagactgttttagcatctctatttataataaccataaattgcagacatctcaaatgtccttcagtggatgaatgtataaactatagtacatgcatggaatggaatactgcccaacaacaagaaaaagtgaactattgatagtgtaccaacatggatggaccttaaaggccttatacagagtgaaaggagccaagctcaaggctacatcctttaaaaaaaaagtcctacacacttacggcttttttgttcttgttttttgagacggagtctcactctgttgcccaggctggagtgcagtggcgcaatctcggctcactgcaacctctgcctgtcaggttcaagcaattctcctgccttagcctcccaagcacctgagactacaggtgcgcactaccatgcccgtctaatttttgtattttaagtagagacagggtttcacatgctgaccaggctggtcttgaactcctgacctcatgatctgcccacctcagcctcccaaagtgctgggattacaggcgcgagccactgcgcctggccctttttttttttttttttttttttttttttttttttttttaaagagagagagggtctcgctttactgcccaggctggagtgcagtggcatgatcatagctcactgctgccctcaaattcctgggctcgggtgatcctcctacctctgcctcccgagtagctaggaccacaggcacacgccaccatgcctggctacttttttgtagagatgggttttcactgtgttgcccaggctggtttcaaattcctggcctcaagtgatcctcctgtctcagtttcccaaagcactgggattacagttatgagccaccgggatcagtggttgccagggttaggtgtgactacacaggacagccaaggcagggttttggatcctcattgtagtggatgatacaggagtctacgtgtgttaaaattccaaaccagatgtcctaaacaagttaattttgttgtatgcaagttaaatagaattttaaaacagtaagacctgtatgattaaaaaagtaaaaactttgtattcaagaaagtaagtatagtttgagcatatgtttttctgctgaaagtgatgtataaatggatatggtcatctgagtaaaatgaagacttactttgtaccttccctgtgcagcaagaactgtgcctgcatattcaagggcatttgacatcagttgccttccgccctgtatggctgtgcttaacacgttgaggatagaagcaacagattagtacttaatgaatttccttgctattcttccccttagtctgtgtctctgtacattcttccctgtgaagatcaaaaatatctgtgaaccaattttccttttattgtttgttttgagacggggtatcgctctttcgcccaagctggagtgcagtggtacagtcactgctcactgcagccccgatctcccagacccaagtgatcctcctacctcaacctcccgagtagctgggaccacaggcacacaccaacatgcctgggtaggtgggtttttttgggggagagacagggtctccctatgttccccaggctggtctcaaactcctgagctcaagcgatcctcccaccttggcctctcaaagtgtgggaatacagttgtacagttgtaagctgccacacccagtcggcttgcctttttttgtatggtggtctttttaaagaatctgtgtctctcagacaggatttgagatagctactttattctatcatataacttcaaatactcccaattttttgttggcttttctaatttttaaaaatgttcatatatattataacttccttgtaaatgttcagtcactgttatttttcctcaagagaacctcattctcttgaggtttctttatggaaggactctactttctctctgtggctggtgagaccttatcttacctggaactttgccctttttatttgctgcttgtgaatgacctgggtttgttggcttcagtagttccctaggtgctttaattgaagttgccagctggggtttatggtagtaaggggttgtcccttcattctcctacagaactggccttaggcctttccagaatggaactagcagaactctgtggtcagcacatctctttctttccgcctacagtatatcctccctccctcatccccctcttgctttaaagcttttgcatccaaaaagaacagaatcaattgttctggggacctgaaattacaggacgtagaatgactcctgtccattctgtctttcctcaggaggccctattgaaattggttaaatggtctgtaatccaggtgatcagattttgctctatcagccatgtaacaaaagccattgtattgttgaaaagtgactaccttacaagcagaaagagacagcttccagtggttcataacacttgaacaataattgtttgtttgttttttttgagatggagttttggctcttgttgcccaggctggagtgcagtggcgcgatctcggcttactgcaacctctgcgtcccaggttcaagcaattctcctgcctcagcctcccgagtagctgggattacaggcatgcaccaccatgcctggctaattttgtatttttagtagagatggggtttctccatgttggtcaggctggtctcgaactcccgacgtcaggtgatccacccgccttggcctcccaaagtgctgggattacaggcgtgagccaccgcgcctggctttataattgttagtttttaagtacagaaatttgatatgatgtgagagagagttattttgatgtttgatattctgattacacctgtcattacaaaagtaaaaaaagatttttcccctcctttttaggctgtcattatttgtatcaaaaacaaagaatttgaaaaggcttcaaaaattttgaaaaaacatatgtccaaggaccccacaactcaggtaaatttgatacatttttgctcctgtgacttaaattcatctcattgctttttgtggggaaatagggaaagggttcttggtcaggaatattacttaaatattctcctttcaacatgtaacacctgcagcaagttatcttttatatccaagataactcactgtaagattggcttttcaaaatttagtttttattagagaaattgacataaattattcacttgccttatttctgtctagtttataacagaacattgatttaaatgatcagcaccaggtatggagctgacaaatgtaacacttctaactttatttacattaaatggtgatcctgcagatgtgaggaaacttctttggtgaggacatagcacctgtttcctggtgtcaaaagttctgttggtcccctgcttttattttttcttcttcctttttattcatttgtttatttattttttttgaggcagagtctcgctttgttgctcaagctggggtgcagtggtgcagtcatagttcactgcagcctcaacttcctgagctcaagcagttcttccacctcatcctccccagtagctgggttcacagctgcatgccaccacacatggctaatttttaaattttttgtagagacagggtctctttatgttgcccaggctggtctggaactcctgggctcaagtgatcctaccacctcggcctcccaaagtgctgggattacgtgaatcatcatgcccaaccatttcttctatatactttttttttttttttttttttgagatggagtcttgctctgttgcccgggctggagtatagtggcccaatcttggctcactgcaacttccacctcccagtttcaagcagttctcttgcctcagcctctggagtagctggggttacaggcatgtgccaccatgctgggctaattttttaaattttttagtagagacggggttttaacatgttggccaggctggtctcaaactcctgacctcaagtgatccgcccgcctcgacctcccaaagtgctggcattacaggtgtgagccactgcacctggcctctatataaattcaaattttattatttgaaaaggtaatacatgtacataatacagaattcaaaaggtataaccaaagagtttggtgaaaatactctcatctgtgaccctcagccatcttcttcccttcagaggcaaccaatttctttttttttttcttttatcctttcaaagatcctctatgcatgtgcaagcaaattgtgtgtgtgtgtgtgtgtgtgtgtacagacatccacatagatccattttctccattcttctcatacacatacgtgatagcatatcctacacactaatgtgaacacttttctaaattgcttttttcacttaatattatatcttggaatcattctatgttagcatataaggaacttctttatctgttttttatagctgcatagtaacccactgtggctgaacctgatttattgaccaatcctttgtgttgggcttcccttcctgtatgtgtgccagtgatttgcattgacggcattgcagaagttctcatagtgtctgtctcacctcatcatcattgaatttttactggagttctactttctcatgttgcaaatatcggtccattgtgtagaagctgagaaatgatctcctgaatattattcgagaaaagaacttggcccatcctgttatccagaacttttcatatgagaccttccagcagaagatgctgcgcttcctggagagccacctggatgacgccgagccctacctcctcacggtgcgccttggcccttctcccataaccatggtgtgcccttgaggatgtgcggggaatcagaatatctgaagtgaaaagagttgatgtgtgaaaaagacattgaattgtatgcactagctttcttaattaaatgccttaaaaatgcaaaagcaggccaggcgcaatggctcacgcctgtaatcccagcactttgggaggcccaggggggtggatcacctgaggtcaggagttcgagacctgcctgagcaacatggtgaaaccccatctctactaaaaatataaaaattagctgggcgtggtggcaggcacctgtaatcctagctactttggaggctgaggcaggagaatcgcttgaacccaggagatggagattgcagtgagccaagattgcgccattgcactccagcctggacaacagagcaagactccgtctcaaaaaataaataaataaataatacaaaagcagagatactggcagaggcaaatggaacacacctggtctccctcatctgccatttttatctcctttacacatggttaatctgccatggttgaagtagaacattcacttgcaatcgatggtggttcccaaaggcgatgacttgtgaactaagtttggaggaagggtggtttggtagatgtggtacgatggagttgctaacaggaagaaggcatggtgtggagaaaggtgtcactgaaagtataaagttgaaagaagccaaatgaaaacattctttaattggatcaaagagataaaagaatggaagcagtgaggctcaggacagcatagggaagaactagacccaggctgtcatagatgggagactgtggtgaaggaacactgagtgagagtggttttgttttgtttttgaaaccaggactttggcccagtacagtggttcacacctgtaatcccagcactttgggaggccaaggcaggcaggttgcttgagcttaggagttcaagaccaccctgggcaacatggtgaaaccccttctctacagaaaatacaaaaattagccaggtgtggtggcgcgtgcctgtagtcccagctacttgggaggctgaagtgggaagatcacttgaggctgccagtgagctgtggttgtgccactgcacttcagcctgggcaaaagaaaccaggactttgagaatgtggaaaatattctgtctcgtaacagatctgccaggcccatattaggatagtgtccatgatcttagcagtcgtttggcaaatctcagattatttataagcaggtagtttgggatattcaggcagcaggtgtcaagatagttgagcctggcctagggtcctttcctttccattccaggtaactggaaactatccttatctatataacacaaagagccctgattagcctactcagggctctttgtgttatatagataaggattctcaaacagttgttaataaggcaaaacatttgtagaaacagttataaaaattctatacacaaactggaagatattagtatgaacatttattgccgggcatggtggctcatgcctgtaatcccagcactatgggaggctgatgcgggcagatcacttgaggtcaggagttcgaggccagcctggccaacatggtgaaaccccgtctctactaaaatacaaaaattaactggacatggtggtgggcgcctgtaatcccagctacttgggaggccgagatgggagaattgcttgaacccaggaggtggagattgcagtgagccgagattgcaccactgtgctgcagcctgggcgacagagcaagactccctctcaaaaaaaatgtattagttatcttaagtttgaataaaaaaagcttgatttataagtcttacaagttctctcccattttatgtccttcgttttatgcctagattggatttgtaagtgaacttgtttgcatattgagtatattcttggtgaaagaagcagagaattaatgcaattctgtggcctcttcttcctgatgacatccttcctttcccagatggccaaaaaggctttgaaatctgagtccgctgcctcaagtacagggaaggaagataaacagccagcaccagggcctgtggaaaagccacccagagaacccgcaaggtaaaaagatgctctcttgtgatcttgggtaaaacactagggtggtcgctggaagcagtctcctccttaggccaggatcagttcctctcagcactccgacctactaacgtgttacgaggttactcatacaaggcactgggggagactgcacaccctgggaagataaggaaacaggatgcctggggtccctgacaacttcctgactggccattcctcaaaggctctttcaccatttctctctccttgcctcccccgtattgactcagtacttttcttgtggacacctaatctcttaatacattcaggaagcactgctcagatctgtgagtcgaatcccaaaaccagttcctaaagcaggggtcacaagcttagatgccctttgagggccggttaggaaacctaaaggaacaaagtggacctaggctgagagcatggggctgggaaccaggggatgtgcttttcagcttcttgtggttgttgctctgtgggagtatccaaggatgctcaggcttcaggtgctcagatttttgtatgagatgtccagggttttccatgagatttcccagtttttggatgttaacagttgatccacttaaaaaattttttttcatgttggttagacaacaagacaggctgccagatggatttggcctgcaggctgccagtttgccccctctcctaacagtttttccctaaagcatactaactgttccaaatgatagatgaactttatttttaaaaggcagtttctcattgttccaagactgtgtggcatgccttttactctgagaattctcaagatcctgctcttaagtgtgttgtaggccgggtgtggtggatcacgcctgtaatcccagcactttgggaggccgaggtgggtggatcgcttgagcccaggagttctaggatacagtgagctgtgtttgtgccactgtatcctatctctctgtcctatctactgtctaggacagacccagaccctatctctaaaaataaaatgagaagtaaaataaaggttctctaacttggagttttaaattcataatacaacttacatatcacatttaaagcctcctcaactggaatttgaagcttcaaacttcaaaaaagttgtggctgtttggatgagcatcatcagtggtgaaaaacatctttgtgcctatgcttgatttgcaggcagctacggaatcctccaaccaccattggaatgatgactctgaaagcagctttcaagactctgtctggtgcacaggattctgaggcagcctttgcaaaactggaccagaaggatctggttcttcctactcaagctctcccagcatcaccagccctcaaaaacaagagacccagaaaagatgaaaacgaaagttcagccccggctgacggtgagggtggctcggaactgcagcccaagaacaagcgcatgacaataagcagattggtcttggaggaggacagccagagtactgagcccagcgcaggcctcaactcctcccaggaggccgcttcagcgccaccatccaagcccaccgttctcaaccaacccctccctggagagaagaatcccaagtatgaagaccttctttgtagaaattttggggctggttggtggtcctggttgggcctggtattacttccgtgaatgaagtaactttcagctaagttactcaccaccaaggcttgctcagactgctagaacttgacgcaggagtggccagtgacgacgtagccatccctgccggttctgaagccccgcatgtgggcttccaagccttgcactagggcatgagtgggaatggaaaggtttcagagcctcctactcatcgctgctttcatttttagcaaacatctgagtgtcttgacttctaaacattagtcttgtgtgttaaaagaaatttgtttgcattgggccacattatactttgacccttaaaaagagactgatgaatatgtataattttgcacccttctgagcatttgagacttggcaagttcagtgaatacttactaatctcccatgtcctgctaggtactgtggggcagtggctagaatactttaattttgctccccattgtgattctcatcctggctttgagttttgcttccctttgtgtcctgtggtggatcctccctccaggcagactggcctgcttgctctctggaacatgttgtttgtttctaccactgtacttttgcttcctctcattccccacagtggaccgtcatcccttcatcattgcttgtccaaatcccatttgtcctttaaagggaagaaaagccgttgttgatgaagtgctttctgggggcagagcactttcatgtatcatcttactgagtcactacaatcctcactctgtgaggtgatgatatattagccccattacacagaggagaagggctcagaaaagttcttagctcacctgaagtcacacagctaaaagtggcaaagatgggctttggatttttaatccaagtcagtcttgacagaaaagcccatggcctgtataccatatacaacaagttgcctctcttacaattctccttcctcaggctgggtgcgctggctcacacctgtaatcccagcactttgggaggctgaggcaggcagattacctgaggtcaggagtttgagagcagcctggccaacatggtgaaactccgtctctactaaaaatacaaaaattcgccaggcgtggtggtgggcgcctgtagtcccagctacttgggaagctgaggcaggagaattactggaacccgggaggcggaggctgcacagtgagccaagattgcaccactgcactccaggctgggcaacagagtgtgactccgtctcaaaaaaacaaaaacaaaaacaacttctccctcctccacagactcctccctggtcaccactagtgatccaccttatggatctcccaaggccacctctgcctctgctctgtgttgtattatttggggacctgtggtctggcatgcattgtacttggtgccccaaagggctgtggcatctgataagtgatttatcctcaggcacagatttgcactatgtcaccactacttgtatgtagaagtgagtcaccggctggcaaatgggcatagctgctgggcagtggatgcagctccatgcatgttattctcatttgatacaggatctcattggcttctcacagcaatcctgtgcactataggtattgctcccgggaacagatgaggaaacaggagagtgcgagattacagtaattttgtaaatgggaggatttgtgaaggtttcagacatacaccctctctcatatgtcaaggatatgaagtctaatgaatcccctaaagcagcaggggttggcaagctgtggccctggggccaaatcagcctactgcctgtttttgtaaataaagttttattggaacacagtcacacccatcatcaatgtattatctagggctgctttctgttcattggtagtttgttgagtagccacagcagagacaggcttgcaaagtgaaaatactatctggccctttacagaaaaaaagggtcagtgtccctgctctaaagaagtatgtgtgaggtgccctggccacttatgggaagaaaagctgagcctattcagcaaggttttaggtggctcagattttatagaggaacaaacattgagctggcctgggaaggatgagcagaaggtcgtcgagtgtgttgggggctgggggactctacgcagtgggagctccttacatacaggcatgagaaagcctggtgtgcccctcagagtgtcatggagcctatggtaggagaatacggtgcataggaaagagtgaaggtaggagagtctgcatgctagatgggccaggcctgggatttctgtagtctagtgtgtcaggcagaggctctcaagctgggcttcatgacacaatgacctgtggaatgctcaaaaaatacatattcccaggctcctggctactgaattagaagagtcaggagaatgccctttaatctgctttttaaaccatgccccagataattctaatacaacaaattggaaggcctgatgagaccccactcagggaagggagggagggaggctggagactggagaccgctgccagggagcagggaggggcagtgggatcaggagggaaggcagggttggcagtgtcacttggacagggccaccatgccccaatcttgtatctcccacggcaccttgcacatagcatgtgtttactaggtatttattcaccaagtaaaataaggattctttgttcttgcatgttaaggagtgacacccaaaacacctgtaaaaagccagcagagggtaacattttaggcattttgggccacatgagttgtctgtctgttccatattcttttcttgttttttctttttctttttttcttgagacagggtctcgctctgtcacctgggctggagtacagtggcacaatctcggctcactgcaacctctgcctcccaggttcaagcgattctcctacctcagccaccatccccgcccccatcccagtaactgggaccacaggtgcgtgccaccgcacctggctaatttttgtatattttgtacagatggggtttgaccatgtaggctggtctcgaactcctggacttaataagcgatccacctgcctgggcctctcaaactgctgggattacagacgtgagccactgctcccaactgtctttttttgtttttttgttacaacccttaaaaaacgggcttgccattctcaccccaagcttcatggtacacaagccgcagcagccagactgtagcttgccaacacttgctagaccattgctcttcatgttcaaactgccagtcaggagcacaaggaccaggaagtggcctgacttggccaggaccactcagcccattacagttaggaggagcggccagatctcagccccatccacttgggaagtcaggagaggcagtgaacacatcacctgaaagtcagaggtcttgcgaaatcaccaccaaagcatgtatttgtacaggtaatagtgctgagagttcaacagaggacagggagaaggtgacctgtgaagactgtgcagggagggaggacagccactcagggaacatgacggaccagctggggactgaggttccaactggttttattccagcactgggataagcacatagaaaacaaactataaccccatctgatttttatttatgaatagtcattaacacaagaatatcctgagaaggaaaaacctcctgtaaaatgttttcactttgtctcaagtaaattattctcaagtaacatttggggataagatccaatgtaaaaacaagagaaagttaggtctaccatttgtctcagccacttagttaagtaatttcatagaaaacttatggaactcaaggaattttttcaagcctatgtacttattcatcaacttgcttttattattcatttgcaaaatacccaaacagcattaaaaataagttttttcttcatggcgggtgaagaatacagaaatttgtctctattcttggttaacttttgcgggtcatttgatttatataaattcctcaagactctgaattcagacactttccatgtttgtaaaagatgttataattctgaggtcagatctgtgctttgctctgttcccagggcagttattaatcaggtaaatgcaaagttgattagaagaaatgggctatagttttcattgaataatttgagtttggggttattttcagcttttgtactttttttagccacacccaagcatttaacgtttcatgttcacaagaaggattcttgtttgctttttactctaatctttgatggtataactcccttgtggctctctgacaatcacaatgttagttcagctaatatgtctccagctcacattggggtctgtgttactgtgctgggtatgctatgtgtttgggatggacaaaggaagatgtggcccccgccttcgaggcggtcctggttaggggcacactgcaaagtggcacttggtatggtggaaacagcactgcaggcaggaggagaaaggctttctgtgtgtgttgtggttggtagttagaggaggcttcactgagaaccatggccttgaaagatggatgagatgtcacttagcagggaagggactcccaagcagaggggctacagagaggcaggaaagtacagagcttatggaaggaagaaagagcagaacagtgtggctgtgctgtttgcacaggtgtgggcatcgtggggcggttggttagaaactgacgggccagactggatggtgtggactcccccatacaggcatatagatgccactgttcaggcagagagaagccattagggaatagaagaggcatgtggtaattttagggtgattgtcctaaaatcatctttggctttggaaggggaagagcctagcggcagagactctagttaagaggctagtggaatactgatgaaaggcgccgtgagcttgaacaagggggaatggaaacggaaaaatcagtccagatataggaagaaggcatgtccaaggaagagagggaggggtttgcaggttctaaatcagaaaaatactgagacctttaaaagagtcaaaaccaaacaagcaaaacaggaaaatgaacagattctttagaggggtggtgatgtgcttgatgtactcagtgctgaatttgaagggtgtcctgcagcctgaggggtgttacgtggagatgcctggccagccaggagaaaggacagtggctttgggaggtgcatgcaggcgaacctcgattgtggtcacaacgggacaggaaggagtacagggccaagagtgagccaagaccagaatctgggacaatccagggtgaatttgttttatacctgtgctctccttgatctcccctcagagtacccaaaggcaagtggaacagctctaatggggttgaagaaaaggagacttgggtggaagaggatgaactgtttcaagttcagggtaagcagaagattctccttggcctcttcttgatgcttgctgaagtacagatgcgtgttactgtcatgttaatattccagaagctgcttgtctccgaactagaaaaagttcagtaagttcccgatctcattttaattcatgaagaatcagtttttttttttttttcctttttcagacagggtcttgctctgtcacccaggccagaatgcagtggtgtaaacatggctcactgagcttcaaccttctgggctcaagtgatcctcctgcctcagcctcctgagtagctgggactgcaggtgtgcaccaccacacctggctgtttttttcactttttgtagagatggggtctcactttgttgctcaggctggtctcaaactcttgggctcaagcgatcctcccacctcagcctcccagagtgctgggattacagatgtgagtcactgtgccctggtcaaggagtcagtctgatgtcctctcccattaaataatggagactgtcagagtaacgccttatgtttaaagagagttcttggttttgttttaataacgcctatgatatttaattatagttgatgttcttcctaaaatccttcaattagatgtggtagtagggggtcattccctgcatttcttgtttaaagaaaaaaaaatcttaacagtttctatatataaatcctttttttttttttttttttttgagacagggtctcactctcatccaaggtggaatgcagtggtgtgatcttggctcactgtagccgtgacatcctgggctaaagcaattctcccaccttagcctctggagtatcggggactacaggcccttgccaccatgcccaactaatctttttttgtatttttagtagagccagggtttcaccatgttggccagtatgatctcgaactcctgggctcaagcaatctgtctgcctcatcctctcaaagtgctgggactatacttgtgagccaccataccataccctaccaaaattgttttctttttttcttttttttttttgagatgcagtcttactttgttgcccaggctggagtgcaatggtgcgatctcggctcactgcaacctccgccttccaggttcaagtgattcttatgactcagcctccttagtagctgggattgcaggtgtgtcgcaccacgcccggctaatttttgtatttttagtagtcgggttttcaccatgttgggcaggctgctctcaaactcctgacctcaagtgatctgctcgcctcagcctcccaaagtgttgggattacaggtgtgagccaccgcccagacccaaattgtacttctataaaatgaacaaggacttgaaaattctaggctgggcgtagtggctcatgcctgtaatcccagcactttgggaggccgaggcaggcggattccttgaactcaggggttggagaccagcttgggcaagagggcaaaactccatgtctacaaaaaatacaaacaaaaaaaatttaggccaggagtggtggctcacgcctgtaatcccagcacttttgaaggccgaggcaggcggatcacaaggtcagaagttcgacaccagcatggccaatatggtgaaaccctgtctctactaaaaatacagaaattagccgggtgtggtggcaggcgcctgtagtcccagctactcaggaggctgaggcaggagaatagcttgaacccgggaggcggaggttgcagtgagctgagattgcaccactgcactccagcctgggcaaaaaaaaaaaaaaaaaaaaaaaaaaaaaaaattgggaatgatagtaagaggaagattaaaaaatgaaggagaaaaaaagaaaattttagtacaaaacagcaaaaccatatgatttctttttttttttttttgagacagagtctcgctctgttgcccaggctggggtgcagtggcgcgatcttgcctcaccgcaacctccacctcctgggttcaagtgattctcctgcctcaacctcccgagtagttgggactataggtatgtgccaccactcccagctaattttcatatttttagtagagaaggagttttgccatgttgtccagactagtctcgaactcctgacctcaagtgatccgcccgccttggcctcccaaagtgctgggattacaggcgtgagccaccacacccagccaaaaccatgtgatttcaaagcagtggttagcaaggggttataatgcagaaattatacatataaacacacctatagtcatgtgccacataacaaagttttggttaacgatggactgcatatatggtgacggtggtcccattaggttatatatagagctgaaaaattcatatcgcctagtgacattgtagatgtcataggcattgtaacattgtagtgcaatgcattactttgtctctgtttagatatgtttagatacacaatatttaccattgtgtcacagttgcatgtcacatgctgtacaggtttgtagcggaaaaataggctacaccatatatcgtaggcatattccttttttgcagaggttagctaagttaatagtaatcggtaagattaaggggattaggactgttatagcagtggaagaatacatgtttgttacttttatttggagttgcaccaatgtttttggttcctaagtccagtggatgactctagtcctttaaaagttgagaaagccatgttgttagacatggggacatgagttagcagttgtcagatactttctccatagataagaagttgcaggctagagcctaggctctaccatctaggtttgtgtaagtcacacaaggatgaaatcaccaaacgatgcatttctcagaacatatccccattgttaagcaacatatgactgtatatatacatacacacactaatacctatatgtatatgtagacattatatatacataagggttttaaatatgacgttccctcagtaattttagaaaacgatgttggggccaggcatggtggttcacacctggaatcccagcactttgggaggccgaggtgggtggatcactaggtcaggagattgataccaccctggctaacacagtgaaaccctatctctactaaaaatacaaaaattagccgggcacggtggctcatgcctgtaatcccagcactttggaaggccgagatgggcggatcatgaggtcgggagatggagaccatcctggttaacacagtgaaacccggtctgtactaaaaatacaaaaaaattagccgggcgtagtggtgggcgcctgtagtcccagctactcgggaggctgaggcaggagaatggtgtgagcctgggaggcggagcttgcagtgagccgagatcgctccactgcactccagcctgggcgacagagtgagactccttctcaaacaaacaaacaaacaaaaattagccgggcgtggtggcgggcgcctgtagtcactcgggaggctgaggcaggagaatggggtgaacctgggaggcggagcttgcagtgagccgagatagcgccactgcactccagcctggggaacggagcaagactccgtctcaaaaaaaaaaaaaaaaaaaagaaaacgatgttgattttactgaagagcttgaaacgcatcactagccagcatttacggatgcctgtttgtaaagcacttgcattgtacaggttctcataggctgaagtgactggtgtttgcaaataaaggagaaaagtaaattatcctttagtgatatcctttctcttctcaatgcttgtgaaatttgaagaagttttccctttggggacattccatgtctttttcttgtggtttgtgcagagaaaggtgaactctgaaatgagtctacttttaatgttttccagcagcaccagatgaagacagtacaaccaatataacaaaaaagcaggtaatttaaaattctcttttctgttactggttatgtgggtagagcagaggtaaaatacgcgccctgtctcacaggtatagactggttatgtacccagtaaaaacctttttttgagattttcagataatccaaactaagttaaagtaataattatcttctggaagaaaagactaggaaaacagatgacacattttccggaacatgaatgatgtagatatgtttgcagtttggaatgcagaagtgattgttacttgaggatcaaatggcaggacatcaagaattcctgtgtccagatccacagtgctcatatcttgtccattccatgtttaaaaacataagctgtgatttcaggttcagatgattctcctgggattcttgagtttaccttatcactacattggagaaaatgtaagtaagtggagaggaaaggtggtaataaatcttttggttttcttttgcagaagtggactgtagaagaaagcgagtgggtcaaggctggagtgcagaaatatggggaaggaaactgggctgccatttctaaaaattacccatttgttaaccgaacagctgtgatgattaaggatcgctggcggaccatgaaaagacttggcatgaactgaaacaggctttcatttccacagaattcacaggagcatggttcctaataatagcccctgatagtctgctctttctttctttttcttttttttttttttttgagacagagtctcgctctgtcacccaggctggagtgcagtggcgtgatctcggctcactgcgacctccgtctcccgggctcacgccattctcctgcctcagcctcccgagtagctgggactacaggcgcccgccatcacgcccggctaatgttttgtatttttagtagagacggggtttcaccgtgttagccaggatggtctcgatctcctgacctcgtgatccacccaactcggcctcccaaagtgctgggattacaggcatgagccaccgcgcctggcatctgctgtttctttcagaagctgggctgggatgagaattttgggcaacctccttcgacgtgggggaggtcccatttccacttcatcactgttggagatcatggagctaagaagcagagccaagtccacccatgtccttggcagagatgacaggcacacagcttgtgcagtgccagaatatcattagcgtttcccttctttagtggtttgcttaaatttaaatccctggtaatctgtagaaccttctcctaggaaatggtgaagtctattaggagccacttgtgactccatgacctgttaaaaccagcaatgtgagtattatttggagtaaatttgttccacgtcaagttctggccttctgatgcaaatgcaaaggaacttagtctgttatgaacccaggttgatgacagaccagtccttgtggaataagattccctttaaaaactctttagccagtcgtgacatcaaccctagacctgtctgccttggcatttgctgtcaacatctgctgggctatgtaggcaggttaatcctccacttctcatgtggttgaaccagtgtgttttttggtaaaatggtgattgtagataagattagttccctgatcccctgccccctgtcccctgcctcttttcccaattcccttccttatgctggacttttaaagcttaaaaaaaatccgattgaatataaatgcctaatttcattctttgtgaaatggttgcttcctcctgattccctaattgtgctgtgttcgtgtcttgcactggaattcaacattcccttctccttttgtactgtgttgtgcttgctgtctctcccggacacccttaaagactgtctttttagcaaaaaatttcagtaaagtgttttctgtaatctttttttaaaaggtgagaactaattattgtccatacttgtagcattcttcattaaagtcttgcttctctcaactgtaagtagctgtttaattgcagcacagcatgtatccacagagggaggtagcaaaatgttaaactttgctgaactattttgatcaagaagctgatgtcagactttattgaatgttttaatccttggaagctatgtcaaacagatgatatggaagtttcctcttaacctttcagtttcctcatatatcatttctggggacaaaagaattccccctttctcacttctgagtgagtgaaaggcaaggcttaaagaaatgctaaagttttaaaattcatccattaggccaggcatggtggctaatgcctgtaatcccagcactctgggaggccgaggcaggaggatcacttgaggtcaggagttcgagaccagcgcggccaacatagtaaaaccctatgtactaaaaatacaaaaattagctgggcgtggtggcgggtgcctgtaatcccagctattcaggaggctgaggcacaagaatcgcttgaactcgggagatggaggttgcaacgagccaagatcatgccactgcactccagcctgggcaacaaagcgagactctatctcaaaacaaaacaaaactggctgggagccatggctcacccctgtaatcccagcactttgcgaggccaagaagggtaggatcacctgaggtcaggagttcaagaccagcctggccaacatggtgaaaccccatctctactaaaaatacaaaaacttagccagccatggtggcaggcgcctgtaatcccgacctctcgggaggctgaggcaggagaattgcttgaacttgggaggcggaggttgtgatgagcggagatggtgccattgcactccagcctgggcaaaaagagcaaaactccttctcaaaaaaaaaaaaaaaaagtttaaaattaaaaattttgaaaaatacaaaattagccaggcatggtggcaggcgcctgtagtcccagctactcggaaggctgaggcaggagaatcgcttgaaccggggaggtggcggttgcaataaaccgagatcgcaccactgcactccagcctgggtgatagagtgagactccatctcaaaaaaaaaaaaaattcatccattagttacaagttggaaacttcatacagctttattacctattaactgcattttggggtttagtacctattgttcttctatcaaccaaccccaactgaaaccacagggagaagttgagaacttgagctcctttcaggctagccgccttctgcctgcagctggtttggtctccctctgaaccggattagaatccagaagcttttctccccttaactctcatgtgagtcaatggtgctctccaggtagaggagtgaaactgatgcatttagggaaacaaaatatcctaatcagtgtttctttttatttatttatttatttatttatttatttatttatttatttatgaaatggagtctcactctgtcacccaggctggagtgcagtggtgctatctcagctcactgcaagctctgcctctgggttcacaccattctcctgcctcagcctcctgagtagctgggactacaggcacccgccaccacacctggctaattttttgtatttttcgtagagatggggtttcaccgtgttagccaggatggtctcgatctcctgacctcgtgatccgcccacctcagcctcccaaagtgctgggattacaggcgtgagccaccacacccggcatcagtgtttcttaaacttgagaatgcctatgttcattaatattttttcacataattcagtgttgtttttattatagttattgaaatgtgtgcaaagataaaactatgcttacagcttctgtagaactataaaacttactatgaactgacgattgtttcgccgaaaccaagtcactgcttatggcatgaccagtgctaggactgcgacggtggtgggactcgggtggggg

SEQ ID NO: 12519 - DNA, 26166 bp, Human
tcatctgtaaggtggggatgatgatggcaatacctgcttcacagagtgaaaattagatgagatgatgtctgtaaaattacgtaagacggtacccaaaagtagtactatttttcccttttcttattagagcaggttgggcacgttttgatgtccgtgggaatgagcaggtagagagggtggtattgaggctggaggggagagaagggacccacagatggggagagaagtcttgggtgcctgttttatcccaaaccaggggaaggagggaacaggtagggctggctgcaggaaagcttgcaggtatggggtacacagttaaaagggagtgtcttctgatagtcttgatgcaggcctggaggtcgtttgttatgggggtggaggtcctgatgtacattgtggcggtaagatgccgtgctgtctttgccaccagcctgtggcagccctggtgttacaccagggcaggtgggcagtttaatgtatctcaggccagatgacctgccctgcccacctgttgaggctccagtagatagacgtgaaagcacagtataagcataatgcaccactttaatccttttctctgaggagctggaaggcctgtagtcaccatctgagccaaatgtcattcaagtacttcacttgggttacacaccacactttgacccactatctcatttagtcatcacaacaaatgggtgaaataggtattattgtcccattttacagatgcagaatctgagtttcagggaagttaaggactttgtcccagggcccacagttagtaagcagtggacccaggatttcaactcagctctgtctgacctcaaaacccatgatctgaaaccactgtgaaagtttgcaaaacctctgtagcagccaagcaggatggaaagatgtgtagggattgtcttctccatttgatagatgagacaagagctgggtactctgatctccatcccaagcacacagagcttggggccccacagccctggtgtgaatcccactccactaccagaggctgtgtgcctttggaccaggcatcttgcttctctgaccctatatacagctgcagaagaattccttgcaggttgctgtaaggatttggagggaaactgttgcccagcacacagtacacattctgggagccatcgtttccccagtgcacttttcctgcaaatgtggatctacatcccacttggatgctgagaccagctgctgtgatcttgcatttgtttagcgctttgttctccttgaggcagtaaagtggtggcacctgaccggagcatgtagccacctatgacttcctgagtggggtggtgtggggagggccctgaggagtctgtggtcctaggccttggatttcatcagggctttcctgctccttctggttgcctcagtcccaggcaagatagggtcccagaatcttacagcccagaggccacctgttgcaacttcttttttacagatggagtcatcagaacccactgtgaggaagtgacttctccttgaggtcacccagacactccaaacagagcagagcaaaagcgcctagaacttgaaattttggacctgtctccaacaccctggggatttccaccaggaaggtgagcacccccactgagaattccaggctgctcagaggtgccagggaacacagaccagggaccagctgtggccccctcctccgatgtgcccagggaagtgggggaagccagcggcagcctgcgattctcaaccaggggaactctcactgtgctttctgagagtctgtgacacgggtcattttctctgacttgctctcttgctttttctcactctaaaaaaaaaaaaaaatgactggacactcctaaagccttcagtcaccatccaggggatttttatcgccacaaagggtaattcctgctccatccctgctgtgactcagctgtgacgttgaaccacacaagccagagagaagaagataaagtcatcagagctcctactcaccagagagtgaggcccaggccaggactccacaaggctggtcccctgccctggagcaacttaaacaggccctctggccagcctggaaccctgagatggcctccagctcaggcagcagtcctcgcccggcccctgatgagaatgagtttccctttgggtgccctcccaccgtctgccaggacccaaaggagcccagggctctctgctgtgcaggctgtctctctgagaacccgaggtgaggtgatggaggagcggagggtgggcagaaagtgggtgccagggagggacccctgatgggaggtgaggggcagaggagcctgtgacttcaggcggtgacttttcttctctgggcctcagtttccacacccttttctcacactccctgacactgcccctctggctgtggtggaaggagaggaagccacagaaaggcatcagctcccacaggggaaagccatccacaccgaggagagcctcgaggctgtgaggccactgtctcactgtgtggtctggtgctctgctaatgtccctaagccgcagctcgcttgtctgtaaagctgttttctgtgtcatagaattgttaatgaagcccaatgaataataatcacaaaagttcttataataacaaatataaacctcttggtgaatgacaaactgttagacgaatatctctccttccacagcattgctcatcacctcagaccgtttgctgggaacccttttggaggggacaaagagatcgatatatatttgtgtatttaatgatacttaaaatattaacaacccagaaaggcatgatatcagtactattgtggacatccctctttaagcaattatgcacctactgtgtgccaaatgctctgcccttgggtcctcagcacaacttagaggggtggatactattatgatcctattttacaaatgagaacactgaggcctaacagattaggtcagctttggtcagtttcctggcaaatatgcccttaaactatctcatgtgatgaccttttgtttgcggttttacagcttaagaaggtggcaaagctgaatcaggcaagtgagaagttcaaacatgacgacaaaggaggaggctgtgagaatagcgaggagaggctgtggccgtggaaaggccagccaggaggtggaggagcagaggttcactggttttaccatcaagcggattgtcagggttcagctcaggctctggtagtgggtctcctggtttcccctctccctccttccaaaacctggcagaggagggagctgattggaagttggagggctgaggcctgaggcctaagtcctgaagagcttctactcagctctgctcctgactcactctaccttgaccaatccacatgccctctggggcctcattccctcacttgtaaaatagactatctcggtagcggtagcaggtcagagacaccaggagctttgtaaaaacacagttgctggccaggcgcagtggctcatgcctgtaatcccagcactttggcaggccgaggcaggaggatcacttgaggtcaggagtttgagaccagcctggccaacaaggtgaaacctcatctctactaaaaatacaaaaattagctgggtgtggtggtgtgcacctgtaatcccagctacttgggaggctaaggcatgagaatcacttgaacctgggaggcagaggttgcagtgagctgagatcgcaccactgcactccagcctgggctacagagtaagaccctgtctcaaaaaaagaaaaacccccaaaaaacagacaaaaaacccacgggtacccaggtgttacccattagaatctgacacccattcctgattaagaacctctaggacagatgttctctgaggccctttcttgttctaataggccatgatcctctgtaattactaaacatataagaccaaaaccaaatggaggaccaaatgagaagagcaaatatagtcacatgtcagcaatcttttgcctaaacccctgagatcagatgtgttttgtaattcagaattttttttagaaaagcaaatcagggcatcatgtaattgtggcagggaatgcggcagtgccctgtaatcaagcacattaatgtttctgcaatgaaacatgtatatattcacactaagtggggcaagtaagggctataatagcttccggtcagtgcagtcacggcaggtttggcagcccaggaagctcactgcaaactaccaaaaaatgtgggatactcggcagttttgcgatttaggaactgtggctctgggattgtggacgtacatgatcaccaccctgctgatagttgaggcttctggagctgtcaggagagtggatggtgcagggagctgtagtgcctctctccaaggctttgtccatgtttccccaggaatggcgaggatcagatctgccccaaatgcagaggggaagacctccagtctataagcccaggaagccgtcttcgaactcaggagaaggtacgttggcacatcacagaaaggcatttgtccgttgtcttgatttttccaggttgaagccaagtagacagctgcccactccacccctggcaggcacctcccaactagtcctgagtccagactgaatttgctttataaggaataaggagactgatgttcacagtggtgaagtgtcttgcctaaagctacctggcaatagacttagagtgagaacagtccagaccaggggtccacaaactacggttcatgggccacattctggcccaccacctaagcaacgagctaagagtggtttttatattttcaaatggttgaaaaaatcagaagaatgataggccatgcataatgacctgtaattctcgaggctgtgaggccactctctcactgtgtggcctgctgcactgctaatgttctcaagccacagcttgcttgtctgtaaaactgttttctgcatcacagaattgttatgagccccaatcaataataatcaaaaaagttcttataataacaaatataaaccccttggtaaatgacaaacatgcctgtaattctgaagtgttagaattcaaattacatagaattacatgcctgtaattctaacactttgggaggccgaggtgggcggagagcttgagcccaggagtttgatactagcctgggcaacatgatgaaaccacatgtttacaaaaaatataaaaactagcctggcatggtggcacatgcctgtagtcccagttagtctggaggctgaggtaggagagtcgcctgagcctggggaggtcgaggctgcagtgaaccatgatcgtgccactacactccagcctgggtagcagaatgagaccctgtctcaaaaaaacaaaaaaagatattttgggacacatgaaaattatgtaaaattgagtacttgcaacaaagacttcatagcccaaaatatttactatccacccctttacataaaaaaggttagcaaactcctcatctagatggttctgtctgcctctgtttgcctttaggtggggagagaccattatcagctcacctcctgagctctgtcaaacggtgcttctaggaataagagacacatttggaagtgtgataggccagagagacattttcaggagctacaatttagaaccctggccctcccaagctggaaggaccctcataggttacatgtcctgctcagaggttcccacatgctatccagaactgatccattcccaccagctcatgacaaaatgataaaaataaggcaattctataaatcagtttatgtaaactaaattctttccatttataaaaccaaacttttactctgagattgcgtctgtcctatgcatgtctttatataaatgaaaggatgtaatcgtagatgatagtttttggcaaagcctttgctaagtaaaattaaaaagatgacaatctctttgttaatctctcaatttaaaaaaaaacacactcgtattggtccacgaatccaaacaggcaggagtcactgctcaaaatcaaatcctcttgtttacacacggggccctgagacctgcagaggagtctcgttgctcagccgccctctctacctccactgggaagtgcctggctcctttcagccaaagccctcttcttgcagcaaactgtggcccagggatcaggagcctgatgtccaggggtggttctgcataattctctgcttggctagcagcaattcccaggccctgtttctgtatctgtaaaatgaggatattaagtcagctctgcaaggcctttccaggatctgtgatgtccagaccgtgatagcagtgctggcagggcagctatccccctaccgctggaccagaggcaggcgagtgtccacacctccttctcctttctctgagctggtccctctcattcagagagttcaggggaatttcctgtcccacccagagctggttttgagcactctcccatctgcttctcagcaacctctccatcggcaggccctcagagagtaagagtaaggaccaaatgcatgttcttggaactttacactctgcaacgtggtaagagttaatatgatatgctgctccgtggagtaactccctgagcctcactgtttggctcttggtggatcggctgtgagacacaagcagaccctcaactctgtgagccactatgcctcacttgcaaaaggcccttacctgcttgaatgctctaggactgttgtttttagcttgttttattctttcctcttaacaaaattaatacacatttattgtgtaaatcttagatcacatagatattttaatatctcctaatccaatggctttttttcatctttttcaatcagatgaaagtaaaagcattctgatggagggggatcctggagccccgacctgttaattgccccatttctttctcctatccgagcccctaagaggttctggggactcctagggccctgcagagcacagtttgaaacttgctgccttaagccaagtgaaggcactataattcatggtagaattataggcaccctaacaggctacaggatgggagaggaagctgcctgtatttgggagcaaagaagccttctttaatgcgggcagacctctgagaggcatcagccccctcccctccctgctggcttccccacctcgtggagtcatggacttctggtgaaaagctggggtggggaggggcggtaagtcatggtctgatcacctacacaaagccacataggggaaggaccagggactcctctgacttttgccccagtgggaactttgggggacttttgaccaaaggaaagtggctgatgataagtcaccactttgcatgtgtggtaattcctaagtttgcctgcacatctggggcaacctgggaaatggaggcagggtggagggctgaggaccagccctccttgcaaacacttcccatgccatctgcttatcagtttgtccccagcctgtgacttcattagatgattatctcccaaagaagtgcccagagccatggactgattacctaatgtaagaagcagatattagaggattaatgttgacctagttagagacttgatacttgcctggcgtgatcttcctgtagaagtgacagtgaaggaggggatgccagggggctggagataatcttcagtcctgtctgctgaggatcagcaaatgggattgtttctcccaccccctccccctgaggcccattcaagaaggtcaaaagcaagctgacaactgatgccagtagctcacagtaaagccttaatttgtctagactcagaaagtgacaagggtttaagctgtctagtccaatttctgttctgtactggattcatgctacgtggctccatgtccttccaatggcagagaggtcattactccatgaaacaaccacacctaccctggggagctctgagtgatgcaacattctcctctttctttgtactgagctgaagtctgtctgtctcccttgaggtcacaaaaggcaacttagcctcctatccctggagtcagtcctgcctccatggaaagacactgagcagtctttccccagtctctgtgcatttggggtaaatgcgcttctgtttatctgtgttccttgaagtgtgatacctgggaataaacccccaaaccttacacttctgagcttgacagtgttcatctgtaatcgccccgatcctgtgacatcctgtgtggtgggtggcggtgatagccctattttaccaataggtaatattttgaggctccatgaggaggtgtgcctggaccaaagtcacacagcaagtgggaggcaaagccaggctctaacccatggctcctgagctggtggcatcttctctatgctgcctctacacaaggaatcctcccctaaatgtttcatacctgcttaaataacacagtcaggctttagtgcaggagtccaccaagtgctatgggaaaaacaggaatgggcaagactatgttcaaccaggagaatcaggcagggcttcctggaggaggtggcggtcgagctgagcagaggctgacagagagtaaaccggcccagttacagaggagggcaggaacgggcggacagtggcagactgaccaagctccccatgtgactgtagagcaccccctcagcaccagctgagacctgagtcacagcagcccctccgggcatccctgacctcagcccagtgtgggggtaggcagtgcctggcctgctcagatcctctttgttctgtgcaggggctgcagaggtggcactcatgctcccagcaccctcttaacagtcacattcccggaggccccaggtctcagaatggggccccccgctagggcccactgtgaccccaccacaaagggcctgggtagccagggtggccggaaacaccacacacgcagagactcctcagacccagacagaagaacgagtgttccctcagggctgggaatctgttttctctgtttctgtctcctcctcggaggaaattccactgcacactttatttttagcaatttgcaagcagtgaggccactcacacaggggccacttgtgacaccagacagggttggcccaggacagatcctctgttcttctcctgcaatgcagtctgattcctgattccctctcctgtcccctcggtccctggcctttgagtgaggccaccccaggcaaggacactatggtggggaggacggagcctgcacacggactccaggctcctgggctcccctcgcctgccccgttgcctcctgcaagtcactgatcgcccctgggcttcggcttctccacctacccgagggaagcagaacctcagagccccaacctccccctcatggctgtgaggatctgatgggacagtgtctacatgagtgccaggagagcagcaagcccatgcaggggctcacaactgtgagagagaatgcacaggtgtgcccagctcctctgctcacaagctcagcatgaccttaagccattccctctgtttctgcctgtgttaaggtgactctaatacagccccacctgcctcagatgattgtcacagggatcctatgggacaacattcaaacatattttggtcctgttcatttaggaatgttcctcaccaccttgaggaaatccagtgggaaaatggagttttagagagttcattgttaaagagtttgtgatgtgaggattaaatgagatacatgtatatgacagccactgagggattgggactgggagatgtcccggggcagtgcttaatccacaggaataagaatactaattagtagtaatactagtagtattactactattagtattattagtgttattagtagcagtagtattcaacaagtattcagtagtagtatggaataatttcaataaatatgagccattattactattaatttattattagtaataatggctcatatttattgaacactgtgttaggcagaataatgtcctccaaagatgtccacatgtgaatccccaggacctgtgagtatgtgacctcacatggctctatgcatttgccagggctgccataacaaagtgcacagactgggtggtgtaaacaacagaaatgtatttcctcgcagttctggaggccagaagttcaaggcacggtattggcgagttggtttcctccaaggcctctctctttgccttgacatggctgtcccctccctatgtcttcatgtggtccttcttcaaatttccccttcctaaaaggataccagtcacattgcattagggcccacccccaatgacctcattttaatttaattagctctttaaaggccctgtctccatattctgagatactggtggttaggacttcaacatctgatttgggtgggggttgctgagcccataacaatggcaaaacagactctgcagacacgattaaatgaaggattctgagatggggaggtgaccttggattatctaggaggcccaagtgtcctcagaagagggagatgagggtcagagagaaggggagatgctccactgctggctttgaagatggaggaagggaccacaagccaaggagtgcaggcagccctgagaagctggggaagggaggaagccatcctccccttgggcctccaggagcaacgcagtcctgctgacatttccatgttaggacccctggcctccagaactgtacgataataaagctgtgttgttttaagctgttaagtttgtggtattttgttacagcagcaatgggtaactaataccagtgcttacatgtattatctcatttaatcctcacaataaccctgtaagggggtattattattatccccattttgcagatgaggaaactgcagaacagaggagttagtaactatcccagagccacaaagctagtatgtgaagtgacagaaacaagctctgaaccccaaaaggctggctccagaggccacatcctgaactcccgtgcactctaaggaatgaataatgatgatggagaagcctctgaaagcctctcaagtcacccctgcccctttctccagcaactgttcaaggctcatcacagtccacatctgtacacgcatcacagaaggatgtccctacatctgaatagcatttcactccctaaaacagacatttgctgttcacacaacgccaggacagctccgctgctgaaagacacatcccctccacctgcggggtgatgtctggaatttcactcttagcttgatcattttcatgttcttatctcttttatgactctcccaccaagctttgacccttagaaccacagactattggaatcatggacctgtggggaggggtgggacctgaaaggctcccccaggtatattcaccaaggagccaggtctacacatagcatcttccctccactgttctcacatgtcaaaagctacatgtttggggaggtttcatcaccacagacttcccgaagccagcacggtctccctgccaaggccgccctctgcctgccttccatagaacatctgttttctattatttattgggaacaacttgtccctgaagccctgggcagttggtgggtgggggtgggggcagggtggcctttgctgggctgtgttctgtgtctcaacccaactgtactcattaagcccacagctctctggttatgttacttttaaagaataataactagtgtgactttttgtatttgctcagtccgaaagacctctgtcctctcctgctttcgtccaaatcccctttcacgtggttccatgagattattctctcaaaaaaaaataaataaataacaaagcgcttatagaatcaagattttatttatatgccataaaactcactcattttaagtgtacagtttgatgaatataaataatcatgtaaccgccactacagtcaaatggcaaatgtttctgcacgggataaagctgctttgtgtccctgcatagtcagtcccctccccacccacagctccaggaggcaaccactgatctacttcctgtcactctagttttgcctttgctagaagctcgtaagaatggaaacaggtagtatgtagtctttggtgtttgacttctttcacttagcataatgtttttgaggttcatccatgttattatttatgctggtatttaattccatttggttgttctgtagtatatatagaccaatttgtttacccactcaccagctgatgacacatttgggttgctttgaacaaagccgccatgaacattcacatacacacctttgtgcagacatatgttttactttctcttaggtaaattcctaggagtgaaatgtgtggattgtatggtaactttataagtatggtttataagtaaattattttataagtatgatttaactttataagatactttcatagattgtatctgttcattattcatttattttttttaagagagacaaggtctttctctgctacccaggctggagtacagtgatgtgatcatagctcagtgcagccttgaacccctgggctcaagcgatcctcccacctcagcctcccaagtagctgggactataggtgtacgccaccaagactgctaattaaaaaatttttttaagtagagatgaggtctcattatgttgcccaggctgtcttgaactcctggcctcaagtaatcctcttgcctcagcctcccaaagtgttgagcttacaggtgttgagccactgagcctggctatgcccattttttattaggtcatttgtctcttattaggttgtaagagttctctatatattctggatacaagcctttatgaagatacagtcatgtgccatgtagcagtcaacaccagaccacatatacaacgatggtcccagaagagtatagtactgtattcttactgtaccttttctatgtttagatatatttagatacacacgtacttacagtgttaacaattgcctacagtattcagtatggtcacgtgctgtacaggtttgtagcctaggggcaatacgctgtcacagagtttcggtgtgtagcagggtataccatccaggtttgtgtaaataatcctatgatgttcacacaatgatgacacatttctcagaatgtattcctgttgcatgactgtatatgttggaaaaacttttttcccatctctcctgggctgactcctgttaagaggtagtgatgtgcgtgggaggggccctgtggctgtgctgcctcccagctcggcctccttgggcaaatcccttcccctctgtgagcctcagttttttcatcagtaaaataggaataaaaacccaccctctcttccccaccatgctgtaaggagccctaggaagaattatggccatgaaagcatttggtaaatgcttcagacctaaataggctaacagtggggtcaaattgctattataatagcactgagaccctcctgtatcccttccctcaggcaggatgttatctggaagggaaagttgtgcggagtggacacacctcagtcaaggatagatggccaaggagggatgcagatgggaattgtgagcccaagattccccatgaacttcaggaggagggaggcatttactcatgcagtcagtgtgttctgagtgtctcagctgtgccaggcactgccctcagcactgggaacacagccatggccctcacagagcccccccgaccagtcggggcaaccagagagtgagtgatgattacggagctgtgtggactgtgccctgacaggagaaatagcagtgctgcccaggatcacagtaagggcccaggtcctgttttgaaggaaggtcatggaagggtggaagcttaaagggtggaaaggagatagccaaagggaacagcagtgtgcaaagtcatgtggcccaagccatctcctgccctggtggatcctggtgcattgaagagagccccagggtagccacagggatcgctataacattcagtgatgtgattattatttccaggctcaccccgaggtggctgaggctggaattgggtgcccctttgcaggtgtcggctgctccttcaaggtaagcatctgagtgtgagaaaggagatctatccactatggttccagacctccaggtctccccactgcagcccctccatgattttcccgtaacatcagtccactcatctggatgtcctttgtactaatgactttcccaagcatcagagcctactattaagtcatcacagtactcagggaagttcttcctaatgtcttacctaagcataggcagaacatcactaaaatgacccccacccccaatgcccctctccatggtcctgaatcatccttgcactccagggcagggcagaattagaagctgcaatgcatgtggctcatcgtgggcatgtctgatgccagggtcttcctctgaatccctcccactgtacagaaagccactcctttttgctgggtgaatgaataatccttggtgacctttgatagcagggcactccactgctcccctgtcctcactccacctctgttttcactgatcagccccactctcttgtcagggaagcccacagtctgtgcaagagcatgaggtcacctcccagacctcccacctaaacctgctgttggggttcatgaaacagtggaaggcccggctgggctgtggcctggagtctgggcccatggccctggagcagaacctgtcagacctgcagctgcaggcagccgtggaagtggcgggggacctggaggtcgattgctaccgggcaccctgctccgagagccaggaggagctggccctgcagcacttcatgaaggagaagcttctggctgagctggaggggaagctgcgtgtgtttgagaacattgttgctgtcctcaacaaggaggtggaggcctcccacctggccctggccacctctatccaccagagccagctggaccgtgagcgcatcctgagcttggagcagagggtgagtgtgggaggcaggtttgccttcaagcccggctgagccccatcctgtctccagagcggcagacaggcttcctcctaatcattcatcctgcttacagcagtcactccatcaaaacgtatctcccctttatcccacacccttccaggaagagcgctgagttagaagctgtagtcaaggtcataacctcccatccagtgcttcggttcctttgcttgaacttttgtgataagacaccacctccctgagcagctcattccagtgcaggacatattccactcttagcaagttcttccttgtactaagctaaaatcagcctgtctcttccctgcattgttcctggccctgcccctcagagcccacaagacaaatccaccttctagtccccatgacagcccttcagggatggagggtcagattctgtcctacctgagtgcttcccttttcaggctaaaagccccagcgccttcacgtcttcctcagagcatgctgcttcacattgccatcctacgctctggctcagtctccaaagaattctgtacgcttggagtatggtaccaggctgactccagataatccacttggccacagttcttggtccaacagggctgtcttctcccttattctagagcttatacttttcttttctttctttctttttttttttcctttgagacagagtattgctctgtcgcccaggctggagtgcagtggcgtgatcttggctcactgcaacctccactcccaggttcaagcgattctcctgcctcagcttcctgagtagctgggattacaggcgtgtgccaccacacccagctaaattttttgtatttttagtagagatggggtttcaccatgttggtcaggctggtctcgatctcctgacctcgtgatccacctgcctcggcctcccaaagtgctgggattacaggcataagccaccgcgcctggcctatacttttcttaatgtagccaatgaccattctaatgttgcttcttttgcagtaacattacatcattgtctcatattgagttaggcctggattttagttcctgcttcaccattaccattatctgcctcaccattcgcaattaccattacagcaggtgatcagagccacctgccgtgtgggtctgagcaagtcactttccctctcaggaccttccccatcagtaaaattaacgattaaattttctttaaggatgctcacttccattcatggcttccctacctgagcacacccaagaataaatttatattctttccattttattggggaaagctattagaagggccaggcgctgagttggagtggctgaggctttagcctttatttatgtaactcttgctccagttaaaaggcagcctccctgaaagccacaattataccttcatttcacccacaaacttcccagctctacttttacataccaggtactatgcaaggcatggacacaaagacacaatgagcatgggcccagctttcggtggaggagaccatctggtagggaagccagaaaaatatgtctcatgaaatcattgtaagggctctgtaagaacatattgaaagagagcagctaagctaggacagtggttgaaggcttcccagatgaggggccatatgagctggattcctggtggataaggaaaaggaaggccaggcagggggcagcacattcagatgcagacgcacacctgagtgaggcgtggtcagcaaaacacatctggggcagatcaatctccacatcccgccattcccatcccatccccaagccgggttctggtgttcctggctgaacagtcttccctacaggtggtggagcttcagcagaccctggcccagaaagaccaggccctgggcaagctggagcagagcttgcgcctcatggaggaggcctccttcgatggcactttcctgtggaagatcaccaatgtcaccaggcggtgccatgagtcggcctgtggcaggaccgtcagcctcttctccccaggtaacacctcccaggggcacagagacctgcctggggaaacaggccccacaggacccaggaagcaagcagtgaaaactgccagctctgtgacagacacgctgtgtccagtttaggccagtgcccattcaggccactcaccatgggcaggaaccatgctgggatcttcaggttggtgggtgaaccgtgctctgccctgtggctctcagccacacatagcggtggccccagctgactgacattcaggccctttctcctccctgaatgtcagtcccattctgcaaataggaatcaaaactgttacccacttcatgggtttgggatgtgaaggaaagtgtgctgtgggccacagtatgtgcagatgagatggatgtggatgatgattttcacaagtgaacaccgtggcctcagagagccgacagtctgaaataagattagagaactgagtaagacacatgcacttgtgtatgattgcaggtagcatatgtgaatgagtgtcttactcagttcttactcatttctggggcccctgggcttggcacaatgtcttgcataaagtaattacttggcaagtgtttctcttaactaaatgatatctgttaatataacagtgcatatatttgtgcaaaaaatgaggcagcagactgcgtgcagtggctcatgtctataatcctaacactttgggaggctgaggcaagaggatcatttgaggccaggagttcaagaccagcctgggcaacgtaacaagatcccatctccacaaaattttttttaaattagccaggcatggtggcctgcacctgtggtcctagctacttgagaggctgagatgggaggatagcttaaggagtttgagtctgcagtgagctatgatggtgccactgaactccagtccaggcaacaaagcaagaccctctcaaaaaacaatttttttttaacgaggcagcggagtgtgtcacaatcccagagcagggctgggactcctttcctgcaggagtagcgctcatcccactgtgttgggacagctctcttcatggggtggcctcgagccctacttgtagacctttttccctcaattcttttcaaagagggaaaaagcaagcagtacctcgtgcttcctgttctaccaaaacgtaatgggcaaagatgagtcagactgccagcctgtccctcctccaccctcttcctgcctgcccccaattcatgtccccagtcagcctctcccagaagggcgctctgccagaggacatgctctcatgggatggcccctttagctgcccagggggtttctgtgcatgttcaccaggtatgattcagccctcaaagggttttgccacctgagaatggctggcagaactgcgagtcaccccatgtacccccagcctccaggggaccccagccagttggcatagggcagaactgtgagtcaccccatgtaccctcagcctccaggggaccccagccagttggcatagggcagcagaaagaaactgctgctgggaggcaggaagcctggcccctcattcttgctgggtccccaacataccgtgagatggtgaccagccactttgtttttctcagcttggtttccagactgtaaaacataggttggttagatcagtggttctcagagtgtggtcctaggaccagtggcattggcaacccctgcaaacttgctggaagtgccaactctcagttctcaccccagggtcactgagtgagaaactctgagggtggggcccggcagtgtatgacttggatggccagctgacaaacactaagctagatgacccccaagagcccattcctgtctgacaccctactcgagaagaatgctgggttctaaccccatctttcatggttttgagccgctgaccttgggcatgcctgaccactggatcccagtcccacatctgcaaagtccagcacttcccaactgcctctggcttctgcgtttcagccttctacactgccaagtatggctacaagttgtgcctgcggctgtacctgaatggagatggcactggaaagagaacccatctgtcgctcttcatcgtgatcatgagaggggagtatgatgcgctgctgccgtggcccttccggaacaaggtatgggtgtgaaggtgatgggggtaaggtggggagcatggaagcctgagtcctagtcctggtttggcaatgaattggccatgtgacctggcaagtcccccaccctctctgtgttatcagtttccctttttataaaacaatcagatctagtaactagggctccctccagctccatgagtccaggagctaaaatgtctggaatcttcctgaaggttatatagaaataaaattcatggccaggtgcagtgccccacacctgtaatcccagcactttgggagactgaggtgggaggattgcttgagctcaggagtttgagacagcctgggcaacatggcaagacttcatctctgctaaaaataaaaaccatctggccaggcatggtggctcaagcctgtaatctcaacaatttgggaggccgaggcgggcggatcacttgagaccaggagtttgagaccagcctggccaacatggtgagaccccgtctctactaaaaataaaaaaattagctgggtgtggtggcatgcacctgtaatcccagctactggggaggctgaggcaggagaatcgctagaacctgggaggcggaggttgcagttagccaagatagcgccactgcactccagcctgggtgacagagcgagactccatctcagaaaaaaaaaagaatgtgggaactaaaattttcatttttaatgtaatccccaagattttctccaagaaataaattgttgttttgtattttgtaacttaaaagcagctattggtaaatttctgagatatagcaggagaccaaaacatgtttggaaagagaataaatatatgaagagagactggttgttttattttcaatgtattgaatatattagattacaatttattttctgagtggatgtgattaaatattcagacgtttagtgtatgattaacagtgagatagagatttctttggagttattaaatccatcctgtcttttacataatggacaaatcaagttaaaaaaatttttagatagcttagcttattttctggtgctgttgacctgcaagagaatatactttcgcatatacaggtgaaagttttgcaatttatgtatacaagaaattgtaggcattaaaaatattttattgataaaataataataataaaataataataataataaaaaccatcagctgggcgtggtggcacatgcctgtagtctcagctacttgggaggcttaggtgggaagattgcttgagcctgggaggttgaggctgcagtgtgccataaccttgccactgcactctagcttgggtgacagagtgagaccttgcctcaaagaaagaggagagagagagagaaagaaagaaatggaggaacggaaggaagaaaggaagggaaggaaagagggagggagggatggaatgaatggccagtggctgcccactcttcttcctccttcacatcgtggggtaaataaggaaaacttctgggaggaggtgccgtgaggctagcctgaactagcagaattttcaggaaaaaggaaggaggcaggtatcactacatattaatacatactagaatggccaaaatctggaacactgacagtaccaaatgctgacgaggatgtggagcaacaggaattctcattcatttctggtgggaatgcaaaatggtacggccactttgaaagacagtttggcaggatcttacaaaaccaaacacactcttaccaaacgatatagccagttgctctccttggactcaaaggagtttacttagaggagttgaaaacttatgttacacaaaaacctgcacaaggatgtctatagcagctttagtcataattgccaaaacttggaagcaaccaagatgtccttcagtaggtggatggataaataaactgtggtgcatccagacagtggaatattattcagtgctaaaaagaaatgagctatcaagccatgaaaatacagggaggaaacttaaacacatattactaagtaaaagaagtcaatttgaaaagactatgttctgaatgcttccaactatatgacattctggaaaagccaaagctatgaagataggccgggcacagaggctctcgcctgtaatatcagcactttgggaggccgaggcaggtggagcgcttgagcccaggagttcgaggccagccataacgaaaccctgtctctacaaaaaatacaaaaaattagctgggcattgtgatgtgtgcctgtaatcccatctactctggaggctgaggcacgagaatcgcttgaactcaggaggtggaggttgcagtgagctgagatcgcgccactgtactccagcctgggggacggagtgagacttggtctcaaaacaaaaacaaaaacaaaaacaaaagctatggagacagtaagatcagtgattgtccaagagtaggtgccgggagagatgaatagagcacaggggattttgggagcagtgaaactattctgtttgatactgttatggtggatacatgtccttatgcatttgtcaaaacccatagaaagtgaaataccaagagtaaatgccaatgtaaactgtggactctgggtgataattatgtgtcaatgcagcttcatcaattgttacaaaactaccactctggtggggatgttgatagtgggggaggttgtgcactaggtgggggcaggaggtatatgggaactctgtattttctaatcagttttgctgtgaacctaaaactgctctaaaaaatacaatctattaaaaattctttgccgggtatggtggcgcacgcctgtaattctggcactttggaaggccgaggtgggtggatcacctgaggtcagcagttcaagatcagcctgaccaacatggtgaaaccctgtctctactaaatacaaaaaattatctgggcatagtggtacatgcctgtaatcccagttacttgggaggctgagtcaggagaatcgcttgaacccaggaggcagaggttgcagttagccaagattgtgccattgcactccagcctggacaacaagagcgaaactctgtctcaaaaaaaaaaaaaaaaaaaaaaacacaccataattcttatagaggggtttgggggataggcatttcctgtgggtgaacagcagcattgcatgaggggagggtgtcaagaatagagacctcaggtctggggaaacaggtggggcagggcaggtgtgccgctttggtctggatgtgagtcagtaggttctcctacccccggcagttcccaaaggtgctggggagatttttaaaacaccagtgacagaatctcacccccgtaagtgataaggcctgagcatcaggatgaagtctccgcagggggtcctaatgtgcagggtgaggatgcttcagttggcaacgggaagccattcagcttcctgatggacatttcaggggcatgtgccagggaagagggtttgtgtcacttttagacaatcggcttctcaggggaacctccgtctgtgctgtgtataccagaagctccacaaatgtctcaggacatcgatgacagcccctcagtagaagacctctctgttctggcccttctgccttgccccaggaggttccagctgtagttgatgaagcaaaactttccaagccagagggggtgttacaggttattgcctccacccaccttgtcagtgcttcagtcacaccctctgcccccaacagccagtcacacttgactggggcatcagaaccttcccctgcttcctgctggctggagggaacatctgatcctcatcatggaacagcccctgaagtgcactcagaataccaggtgccgctggctccctgggtctggccatacgccaggtgcgctccttacttggtttctctgactcctaatccaaatgagccaagggtctgaggggctgcacaggcagtaggtgtggagcacagctctgagcccaagcctgggcctccaagctgcgctgctgctgtagggcctgatctcccacctatcccttccctgcaggtcaccttcatgctgctggaccagaacaaccgtgagcacgccattgacgccttccggcctgacctaagctcagcgtccttccagaggccccagagtgaaaccaacgtggccagtggatgcccactcttcttccccctcagcaaactgcagtcacccaagcacgcctacgtgaaggacgacacaatgttcctcaagtgcattgtggagaccagcacttagggtgggcggggctcctgagggagctccaactcagaagggagctagccagaggactgtgatgccctgcccttggcacccaagacctcagggcacaaagatgggtgaaggctggcatgatccaagcaagactgaggggtcgacttcgggctggccatctggttaggatggcaggacgtgggctgggcccacaaaggcaaagggtccagaaggagacaggcagagctgctcccctctgcacggaccatgcgacactgggaggccagtgagccactccggccccgaatgttgaggtggactctcaccaaatgagaagaaaatggaaccaggcttggaaccgtaggacccaagcagagaagctctcgggctaggaagatctctgcagggccgccagggagacctggacacaggcctgctctctttttctccagggtcagaaacaggaccgggtggaagggatggggtgccagtttgaatgcagtctgtccaggctcgtcattggaggtgaacaagcaaacccagagggctccactaggacttcaaattgggggttggatttgaagacttttaagtttccttccagcccagaaagtctctcattctaggcctcctggcccaggtgagtcctagagctacaggggttctggaaacattcaggagcttcctgtcctcccagctcctcactcaccttcagtaacccccactggactgacctggtccacagggcacctgccaccctgggcctggcagctcagcttccccaacacgcaggagcacacccagcccccacatcctgtgcctccatcagctaaacaccacgtcacttcatgcaggtgaaacccagtcactgtgagctcccaggtgcagccagaggcacctcaagaagaagaggggcataaactttcctcttcctgcctagaggccccacctttggtgctttccagaatcccgtaacacctgattaactgaggcatccacttctttcagcagactgatcaggacctccaagccactgagcaatgtataaccccaaagaaataatttttagaatctctttcgaagttttcctaaagtgtatggtttgggagttgtttgtactgagccaggtttgaaaaggccattgctgagtttgaggtggtgccaccagttttgcaggtggcatcagaggctggcatgctggcaggaacatcccctcttagccccagtcttctcttttctataatgagacccaccccagcttgcctccctccctggcttctctgaccctcaaaggagatgccacgcaggacagactggagagagaagcctgggcaatactgcccgcctgtcatggcctggtggtggcccacacctatcttctcaccttggaggccacacccaactttccaaagaccctgagacaagtcaggaccctactactctcccctgctgctttcctgacagcttactcttcctccacctgctgagcctgtgccagactccattgctcaaatcgttagggttgcttctataaaaatgggtcagtagcccttcctgttctctccagcccagcatacaggaggatcaaaggaggtgacggagcatcgtggcacggcagtctcaatgggtcagaaacccaggccagctgggctctaagcctggcatcctgtcatgcttagtccttcagctgaagatcagaggaagcctctcccttgccctctccagctctaggggttttcaggaggcccaactgcaataatggagcactagtgcttttatgtgcaatggtgtcgtccatgcacgacagcagcaaacattctggggctgctttttattgttcccacggctgacagcgtggcagcggagactgtggaggcagtggagactgacttcttcctgctgacagctggatgtcacacatgaaggtctggcctagcgagtgatgggtctaggccctgaaactgatgtcctagcaataacctcttgatccctactcaccgagtgttgagcccaaggggggatttgtagaacaagcccccatgagaaacagctgttactctacacttttgattgcctatttctgatggcaagagatacatactctcttcaaagagcatgagatgcagccattctttcagcaaagcttcattgacacctgcacctgttaactgtgttcgacattgaagggagaaaggcaagatgtgcactctggactcaagaaactcttagttcagtggaggaaatgagcagataagtagatcattatgattgagagtaggagaagcttagagaaagcacagaaccccagatccagctggtgaaggagggaaggcttcaggcctttaagctcagcctgagaatattgtgaaatgcagaggatggggaaaagggaagagtaccgacttgaaaacggagagctgtcttggctgagggcagggtctgtgtggcaggatgggggagggagtcagaagggtcagatgaactggagtgtagacagcatcagatgcagcagtgcccaccgcccccccccccaccccccgccctgcccacagagcacctgctggtaaccctgggcctattgaaagcaggatgagatgataatttaagacactgaatgatttcttttccaacaaagctctatgttaagtgcatcaaagatgtgacattgcatcttttacaggtgattcaagggtgggggaggcaagatgcaggcaaagccaccgtttcactgggtggattcagtaggtcccccacccccagcagttcccgaaggtgctggggagatttttaaaacaccagtgacagaatctcacccccgtaagtgataaagcctgagcatcaggatgaagtctccgcagggggttctaatgtacagggtgaggatgcttcagttggcaacgggaagccattcaggtttctgatgggcttttcgggggcacgtggcagggaagagggtttgtgtcacttttagacaatcagcttctcaggggaaactgtctgcactgtgtataccagaagctccacaaatgtctcaggacatcgatgacagcccctcagtag

SEQ ID NO: 12520 - DNA, 13160 bp, Human
ttgggaggcccaggtgggaaggtagcttgagcccaggagttagagaccaacttgggcaacatgatgaaatcccatctctacaaaaactacaaaaattaggccgggcgtggtggctcatgcctgtaatcccagcactttgggaggccaaggcgggtggatcacatggtcaggagttcaagaccagcctggccaatatggtgaaaccccgtccctactacaaatacaaaaattagctgggtgtggtggcaggcacctgtagtctcagctactcgggaggctgaggcaggaaaatcgtttgaacctggaaggtggaggttgtagtgagccaagatcacgccactgcactccagcctgggtgacagagtgaaactctgtctcaaaataaaaaaaaaaaaagaaaattagccaggcatggtggtgcttgcatgtaatcccagctactcgagagactgaggtgggagaatcatctcagcctgggaagttgaggctgcaatgagccatgatggtaccactgcaccctagcctgggcgacagagtgagaccctgtctcaaaaaaataaataaaacaaataaaatagggagattatcctggattacctgggcgggcctactataatcacatgggtccttacatgggaaagagggagacagaagagtcaaaaccagagagatggcctcatgagaagaatccgactggcattgctggctttgaagatggaaaggggtcatgagccaaggaatgcaggcagcttccagaagccagaaaagacaagatagtggactcttccttagagcctctcaaaaggaacacagccctgctggcacttttagtccaggtaaaaacttccagataaaaacaatataggccaggcgtggtggctcatcctgtaatcccagcaatttgggaggcctaggcaggcggatcacttgaggtcaggagttcaagactcagcctgaccaacatggtgaaaccccgtctctactaaaaatacaaaaattagccgggcatggtggcgcaggcctgtaatcccagctactcgggaggctgaggcagaagaattgcttgaacccaagaggcggaggttgcagtgtgccaagatcgtgccactgcactctagcctccatctcaaaaaaataaataaagacatagatgacagctgagaatttggaaattgattctttaaagcaacggttctcaaagtatggcccctggaccagcatcatctgggaacttgctagaaatgcagactcttgggccacatcccagatctactgaatcagcaactcggggggcagaggtagggtggagcctagcaaacttgtaacaagccccccaggtggttctaaggctcactgaagtttgagaagtactatgttaggataacggtaaggtttatgactggacagtggttcttaaagcatggcccccagataagcagtttcagcatcacctgggaacttaggcaaatcatcaggccccaccccagactcaccgaattggagactgtgttttaactagccccccaggtgctacggctgacgcacgctagctagagtttgaagaccactgcctaaagctctccctgcctgaccacccctggaaaagcttcactcttagtaggtatttgtacccttatttgtaaagcccgcttcttgggatttaaggacaatcagtaggatacctactgaccaatacaggtctggcttatagtaggtgttctgtgggagttcgttaaatgattaatttaatacaactctgaggaaattggtgaagtagatgtgggattcgaacctaagtccacccggcctccactattgggactcaagggagctttatttccgctgcccacgcgccgcctgcacgcccgttccctctcctcccgggagggggcgcgccaggaccctaagaggcctggctgggaggcgggacttcctgcctccgcaggaggcacttccggtccaaaccggaagaccgtgggtagctgcggcggggctgacccgtcccgagtgccaaagctggggttctacttgagatttccctcgtggtgccagggtccggcgagcatcacgccgaggcccattttccagacgaccacgacgaggccggggtcacgtaagtgcacgcatgcgccccctccgcgcggactgcgcgtgttcgaggagcggacccgcagatgtaggaggggagggacgcccccaatccccagtccccgcggcaggctcacgtttcgcagtccccggcctgtcgttattgcggatccgactgagttctgtagccttggaggtctaaagggtcctggagagcccgcagcgagggcgggaagccggccggggaagtcgaggctgccttgtctgagggcttttgtggggtcgtgctctccaccagcgccctccgcctgtctaggatcgtttcaggctatgcggttccaagagaaaatatttttgtttctattttatttttgagatagaaccttgctctgtcacccaggctggagtgctgtggcatgatcttggctcactgcaacctctgcctcccagattcaagcgattttcgtgcccagcctcctcggtagttgcgattacaggtgtacaccaccacgcccggctaatttttgtatttttagtattgacagggtttcactgtattggccggactggtctcaaacttctggcctcaggtgatccgcccgccttggcctcccaaagtgctgggattgcaggcgggagccaccgcacccggccaaagggaaaagatttttgtatagcgagattctaatgctagcgtttgcgtttcggtgcatgcgagagcactggttcagagctctgcctctgaatcggatgggaatcaagtcttggctgtggcagctaagagctgttggactaaagttcttgctgagccttcgtttcctgaactctgttaacagggacggcgatagaagagtgcagcatttagcatgcgcctggcagatagatgctggcgcttggtcagcgagcgctgctgttatttttgcccctgttatttttgttaattaaaaaggagggatgctatggctgctcatacttctagaggactgtatttaccaaagccttgtgatgtaatttttttttttcttgagatggagtttcgctcttgttgcccaggctacagtgcaatggcgcgatctcagctcaccgcaacctccgcctcccggcttcaaggaattctcctgcctcagcctcccgagtagctgggattacaggcatgcgtcaccacgcccggctaattttgtatttttagtagagaccgggtttctccacattggtcagggcagtctcgaactcccgacctcaggtgatccgcctgcctcggcctcccaaagtactaggattaccggcgtgagccaccgcgcccggccccttgtgatagaaatttatttttttcaacccctagtgcattttctgggaggcactgtgcttgacagtaggaagacgatgctcagatgcagtccctggctgtggagtaacttgagcgtcttgggggtgtagtctgtaaatgtatgatgacggtacttacgagccgggagagaggctgccccttgccgtctttctgactccatctccaccgctctccacctcgctcactctggctgcctcattttctcacacacttcactgctctaggattttcacagttgttgaccgttcggcctggaaccctcttcccagttgcgtacatggttctctccttcactaggttcaggctgtgctcaaacgccaccttctcaacgaggcttttcctggctggctttgctgaaaccacgccctcagcccactaccagatccccttctcctggacgggtggttggctttaatacagttctcactactgcttggccttgggctacatatttgttttttgttatctgcttcctcaaagaacatatgcttcccgtagtgcacttttcactcctcaggaactctggcgccccttaccagcttccagtctctcgaggtggccagtgtggtgcttggtccttgtttccaggatggacttccccagctccctccgccctgcattgtttctgaccggcccccttggtctgagcgacgtccctgacctctctttcatgtgcagctggcgagacgcactgactctgccagaggcccagccccagaactcagaggtgaggatgcaggcagggggccctggcagctccagggacatcccttccctgggtcccccgtctcacattcacatcagttgacaaggccacagagtggtggcattcacacgagtctgctgagacacaggctctgccacctcctctggggtacatgggctaccctgccatccctagacggatgcccccactatgccgggtcccttatgagaccgtgagaatgctgcctgaatcagtcggttgacccctcccttcctggaacggagagctgagttgagcgagaataaacaagtgaactttatccaatggataaggtgtttacaaaatgtgatcagagcttggaatgaaagcagaaggatgctgaaacagcatagtagggttgggagaggggaggatagacctgcagggtttctgctgcctctggagggacactggccctttgcttggaatcctcagccgcctagttccccttggaaacaccctgtctgggaatgaagcctggcagaggcaagtgggtgagcaaataaaaagagagacagtggagcagaggcttggggaacgggggtcagggatggcatccttacgagggagggtctggcgtcaaattggggctcctctgggagtctggtttcctagctcttttgtcccctgaatgtctgggccgaaacatcccaggccagcccagcaaagggaggtggagccgcctgccgggctcccagagtgactgcaaggtctcctgaatggaagtgaggttacgtgagatgtggaccagccactggtggcatgaggggcttccttctttgagagccagcacaggtggaggtcggaaacaggagctctggggtcaggctgcctgggttcacatcccagctcttctctttaccggctctgtcttctggggcaaatggcagtgtgcctcagtttcttcagcagtaaaatgacaatgccagtcatcccagcttcgcaggattgttgtgaggattggatgagttgataagagatgaatgcctgtgcacagcctggcccagggagggcattcatcatgatactgtccttgcgattgtcctcccttcagaatggggcactgcatgtgaccaaggacctgctgtgggagccggcaacccctgggcctctccccatgctgcctcccctcatcggtaagggtctcattcccccgggctcactccacactgctccacctattcttcccactgctcccgctcctgagaccttcctctccctgctaagcctgtgcctgctcaggacccttggatacctccagtcgcccagggcatctggccgcactcctgtgccctccccagccctttccgtaacctccttctcagatccctgggaccctggcctgactgcccgggacctgcttttccgcggagggtaccggtatcggaagcggccccgagtcgtgctggatgtgactgagcaggtgagtgggcccacgggggacagtgctgcgtagcctggagactgtgcttagtgacctggcctcctcttctccccagatcagccggttcctcttggatcatggagacgtagcctttgcgcccctggggaagctgatgctggagaatttcaagctggagggagcgggggtgagtggcccgtgactccaggggtggggactccctgctgtccttcaggggtgaactcgagggtgtgtgagcctgacaaggcctttccatgcagagccgcactaagaagaagacagtggtcagtgtgaagaagctgctccaggacctcggtggacaccagccctgggggcaagtggctgatgagaaaggaggagatggataggcatagctggtggtggggatgtaggaggtgctaggacgcacgtacagctttccgtcatacccacttcccccctgctccatgcagtctgagctgtactttcttataccagacttccaactccaaatcatctcaggggaaagcagatttacatttgtggagttcaggcacagctgcatccaggtgttcaaataatgttcatagagctgtgtctctctttcctgtctcgtccacttgcctctccctgcacagttccctagacaggctgtctctaggtagcagcaagatggcttatgatctaaggaaagagccagtgtccttcctgcggcaccagaagtcccagaaaggactttggttggcttggcttgggtctcacacccatctgtgaaccagtcactgtggcaagggcaatggaatattgttggtggccaggtctgggtcacatgattgcttccggggcatgggaacaggatggggtggtctcccaaaggaagaaattctaggtaaataagaaatgtgtccactgcacttggcctccttgggatgggacctgtcctcccctgagtgccaccgagtgatcctcctgctgttctctggtccccaggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcgtatcctttcttgcgagacaggagattccagcgggctcgcctctggtagaggaggtgctcttggcatggtccagagaagggcaggaatttggggggcttgcagtgatcatagctcgtgcactgatccttagtgagaggcccagatttccaagaggtcgttctgaccccaggtgacaatccccaattccttgggaaacctggacgcatccagctccagggacctgtccggcaagtggtgacatgcaccgtccagggagaaagtaaggcccttatatacactttcctccctcactggctgacctgctacctgacccctggccctttccatccctcctcagctctgctggccgtccgctctgactaccactgtgccgtgtggaagtttggtaaacagtggcagccaacccttctgcaggcaatgcaggtggagaaaggggccacggggatcagcctcaggtgaggggggtcaggttggtcggtgaggaggggctggaggcagggctgagcagcccgatgtgaatgcattcctgccctgtagccctcacctgcccggggagctggccatctgcagccgctcgggagccgtctgcctgtggagccctgaggatgggtatcgccgcttcctgtgaaaccccccaccctaacgaactgaactccgccctgttgagcatgtcgcgacccttgagccccttccccatcagcctgtccccctgcccacggcttgcctgtctccccaaggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcaggtacgggctggcggcagaggacccaccccgactgcgggagcggccgcagagcggtgagtcccaggctggctgcggcctgggcgaggacagcgtcaccggcctgggactgtggggagggctgaccctgtgtttatcttccagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccaggtgagtggcacacaacaccgccccgccccacctctgctctgtctcagatggtcactagaggctgctgcttaccagcggctctgctgggcccagacaaccacccagcaaaccaaactcaaccctggatgaatctgtggcccaaacacgcagtggatcccacagtcggtgctaacaggcaggtggggaagctctcccagggcctccccttagtagagcttcgaggtgcagccaggggtggagcaggggaggaggggcctcggggtggggcttccgtgcagagctggagagtttctgctgtgcaggaggcgggggctctgaggaagcaggtctgtcctccacccgccctcccggggacattcgtaggcgtgcctcgagcacaggctcccgggtcaggagagtgggggtggctgcgagaaggccaggcaggtttctgctggcaaggctcccccacacctcttctgagcacccctttcccacttgttctgtctgtccaccggactgtcggtcagaattggtgaaggaagcggcacctgttcagggctggcaggtgaagtctgagaggcacgtggaggctgatgggagatgctgctgcccctcagggctctgcactcacctggagagccacatggggcctggagggccactacacagctcagctcccaagttcggccacatcccccttccttctcgggccccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcaggtgagggtccaggccagggtgggcggcgtgtgggagatggggcggtcggggcctggacagggcctcagctgtctgtccttcctcaggagaaggggcgtcggtgccccgcctggcaggccccccccagtctcttccttccaggatcgactccctccctgcatttcctctgctggagcctaagatccagtggcggctgcaggagcgcctgaaagcaccgaccataggtgtgctggggtgggggagtgagcttggggggcgcagtggaaaacatcccctccccccgctaggccctggaggtcattgtcattcccgtcaccaggtctggctgccgtcgtcccgcccatgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcagagcagcggcagatgctccgtgactacatggccaagctaccaccccagagggacaccccaggctgtgccaccacacctccccactcccaggcctccagcgtccgggccactcgctcccagcagcacacacccgtcctctctagctctcagcccctccgtaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggacagggcaacaaaatacagtagtagtttcttttgtattttgtatattcgcctgaagatcatcccgcaaggcaggctggaggtgccggtgggcctgtgttgctgggattttagtctgtgctgggaggcagggctccgctgcgcctcagctgtgggggcctcaggcaggtccctcagttctcacgccttcctgtccagtggaatgggggccaggagtgctggctcctcgtgtttggtgagggtggagtgaggcccctgcagagctgctgatgaggtgggcacagcggccgttggcagctgctgttgtgggttgctttgtcaatctctgccccggtctgatgtttcctacagggagatgccttggatccaggttcagggactaaatacacttggcagctgaagatgaattggaatggtcacgttttttaggctggacagcgtcccgccacagctactacctgacactgagctcatgcagagagatgatggctgatgttccttctcccttgggacatgggtctggcacctgtgggctgtcgatagtgccctctgagcagagggtcacggtcatgtcagtttgggggaattctctgttgtgcctcacagactcccccctttctttcctccctccccttctcattttgatgtctaaagcatcaagtccctcttcctcggagtttctctagctgcagtggaagattctgttttcctgtggggaaaatgctcacttgagattttgcagggacccgggtctgtctggtttctgatgacatagtaagagaaaggtcttttttcaggttggctggtgaaaggaattgcatgtgactcacacaaacaggagctagcccaatcatacactgactcgcgtgggtgttaaaatgtttatcatgcctaagggagacatttataattaaaccatttatgctacatataactggggaaaactatgatgctttcggtgctgggaatgcagtgaggtcccacgtgggcagagcttggctgggctgggcaactccgacacacgtctctgggggtgtggcggcgctctcagtcggcactgtggaaggaagggtgacctgtgctttctccctgtcactgtgactgcaaggacaggggggcagccttggggttcagtccaggccaaattcagtgtcctcaactgggcgtggtggctcatacctgtaatcccagcactttgggaggccgaggcaaacagatcacctgaggtcaggagttcgagaccagcctggtcaacatggtgaaaccccatctctactaaaaatacaaagattagctgggcgtggtggcaggcccctataataccagctactggggaggctgaggcaggaaaatcccttgacgggtgcctgtaatcccagctacttcagaggcggaggcaggagaattgcttgaacctaggaggcagaggttgcagtgagccaagatcacatgactgcattccagcctaggccacagtgcgagactgtctcaaacaaaacaaacaaaaacaaattattcaacgtcctccaggcctgcccccgcccgaggctgcacgggctccagctcagactgcacttttctgtgctggttcctagagtggaagagaaggccactcagtgttcccgggaaatgcactcaggccgctccctgcttcctgcctgcaagtctggagtcagccaggcagctgtcttcaggaaaaagcctggccaccgatgcgtgctggatgagagtagcacggtctgggctccacacagcccccaatttgggagtgcacctgaaggcagatgctgaatgaaaaaacagtcccagcttgcttgttctcagcactaaccggctgctccccaaaaccgcatctgccaggcacatgtaccagcctgcagtatgaggggaggccccggtacattcagcatgtttttctgggtcttctgcagccaggcctctggctgccgtccctgcctggtgcccctttgcccctttgccttccctgccttgaaggccactaggactggcctgtgattcacccgggcctgggtcactgtgaagcagccacgcccttgtgtggctgtcacctcgcttgccccacactccccagcagtggtgttggtggtcccctccaaaagccctggtctagaaaggctgaggccagggatggtgaggagggggtggaaatgcacggtcattaggcccccgccccaggagatctgcatgaccacagggggattgtgacccccacacacagtcagactcggctgcccaagaggaggctggctcggtggcttcctggcccaggctggctaccagcaagtggcagcttcagacccgtgaactcaggaatgggaccttcagaggatctgtgtggtctgtcctgggtgacccctccagcaacatgaaagctcagggtaaggctgagtgactgccctgccccacccatcccaggccggggagccaacattgtctccactgtgctctcggccccacgctcttacccggagaagaggctgcaaggaagtcgctgtccctgtctccagtggaagtgagtggtgcagcatctctttggcaggtggggggcatcagtggctggccagaggggtcctcgtcgctgagctcctggatcaggggtcttggggacttggtgtcttgttttcggatttccgagtccctcttagcttcttttttaaagatgtctgtgaagggcacccgagccgcctttgaggtgtctttagagactgcaaatatatttgacagagtgtctgtggggaggttttccagcacagggagtgacgtgtagtccagttcagggtcactgtcatcactcaagctcgagatgacctcaatcttcggaaagcacatattctatttacagaagaaaaggtgtctgaaagtttctgttttcacaacagaatcgctctacaatgcaccatgccagttctg

SEQ ID NO: 12521 - DNA, 152481 bp, Human
accaccacacccggctaatttttgtatttttagtgaccaggtttcgctgtgttggccatgctggtcttgaactcctgacctcaagcaatccacccaccttggcctcccaaagtgctgggattacaggcatgagccactgagcccagccaaaagcgtcttattaatgcagagctagccaagcagtaggactggagttattactcaaataaatctccccaagaactcagaggctagggtttttatggataatttggtgggcaagggcccagggaatgggtactgctgattggttggagatgaaatcacaggggtgtggcaaacggtccttatgcactgagtcggtctctgagtgggggccacaggatgggctgagtcatgagtcacacaggtccaggtgagtcagtcggttgcccgaatgcgaaagtctgaaaaacatctccaaagaccaatctcagtttccacaatagagatgctatctataggaggaagtggggaactcacaaatcttgtgatctctcgccacatgactcctgagcagtcagattataaaaacgatgcgtaggttttagcagcgtccaggcccctcccataatcctaatctcacggcctttcgttagttttacaaaggtggttttggtctcttgtataaaaagcaggttaggtttaaggagtaactattatcatccttgtttcaaagttgaactataaactaaattcctcccccggttagcttggcctatgccccggaatgagtgaagacagccagcgcgtgaggctggaagcaagatggagtcagccacgctaaacttctgtcactgtcctaatctttgcaaaggcagtttggccaggaggctgtggggagaccttgtgggttttgccaggacctgggagattctcgatctatgtttggctgtccttctaagccagaagctccctggggttggggcctgcctggggtgagtccctccctccctgccatgcccagtctagccaaggtctagttcagggatcagggcaccacgtgggggaaggactgtgttccttgtgctgaattaggatttatggctttggggccggatgggaggcgtgcgcactgattcagtaggagcgctgctgtggtgtgtgtgtggttggtgggagcggggcgggcggggggcgggggggctggttggggggacaggggtaaaagcctatcagagggaggtcccatcagacaagatgggaccaagagtccagttggctctgctgcgactttcggcctgtcactgccttcctgcacatctcaggggtgggagggggacaaaggctgtaagagtaagaggtacctggcccaagccttaggactagaacccgggccaggcgggagtgaccagccgggacactcagggcctccgcgcgttccagctgggtgaccttgaccctccaacttcagccccctgcgcccggctgctctcccagtggtggtggggagcggtgggggtagacgggggcgcgcccaggcttttctaatccggcgctggtgggggagaaccgagggcgccaccgcccctccccgcaggtccggggccgaggggtgcggcgcgctctccccaccgcggtgcccaggtccccgggacgcaggggcgctgggtagcaaggggggtgcgcaggggcgcggggcgcggggcgggctaatcccgtatgtaaatggcagccaatggagggtggtgttgcgcggggctgggattagggccggggcgaatggctggcaatcttactgggattacagaacaaagagcctccccgcgctcccgctctccgctcctctccccgcgccgccccgccctccgccgcagcccgcgccgggggtgggggccgccgagcgccagccccccggccggccgattccccccccgcgccccctccccgcgcctccctccccgccctcgccgcgccgccgtcctcgcctccctctgcctctccttcccccattctcccggattaattaaggaggcagcggcaggaggctgagtcctggccgcgggccggggccggggcgccgctggcaggagcgcttggggatcctccaaggtaggagaaacttttgcggggggcgggcaccgaggcccttctccccttctcccccacccccgcccccgatcccctccgcctccgggggggggggtccccgcccctccccctctcaaggtgttacaggagctggggccggcttttgggtgcccggggaggcacgtgactgggattataattcgggcccggggggaggggagggacggccgccccccacctgcccgggaggggccgggagctgggagctgtcaccccctccctccttgccaccggctcttctggaggtggggggcgtcccgggccggcgcccgcaggctgctgcagttggcgaatgaggtcagtcgcgctgcccgcggtggcgggcgccggggtgggagcagagggggctgggaaggccgcggtccccgcctttccccccctccaccttctcccggtctgggccagcccctggcccgcgcccccaactcccaggcggagtccagtccagccaggattgccccagcagggtggttcctgtagtggatcccccgccccggccccggggagggggctggcctgtgtggtggtggccgctgaatcccgggtggaggggactcagaaggtggcagtggggggaccacaaagggttcagaggagtaagttggggatactcggtctgtgggtggtctctgagttcctgcagatgggtggagaggacagaggaggggccacagggtgctgaacacccacccgccccatcctaagtaccctgggcatgatgggcttgacacctctcctgggctcctcacccctggccagcagccagggagtgagaccctgcctcgcctggcgtgggcccagggaagggggccgctgtgccgctgagagttcgttccaccctcctggcagtgctggagggggctggagctctggcgtctggcctagtgaccctacctcccaggaccaaggtcctgcggtgggagtctcctgtgtccccatcccagctgaagcgagggtgctgggacataggggtctcgctgcagggcctgtgaggggagcactgactcttggatggagaatgtgccaaggggtaccccgggatggccctgggcctggcgggtgggagtggagggcaggcccccgcagtttttggagaagtgggcatttgctggggtttctcttagaagaggagaggggtgtctagaagccaccctggcgcgccgctgccatggtcggcctctgtgtgtctggctgccccgtggccaggactgttgactccttggcactggcccggggccttgggacttggaaggtgccccaagcagctcatttatttcagcagtgtcattccagaggggaagggcaccagcatcgattatttattctaagcaggaggaggtggctggaggctggtggctgctggcagggaggggctaggtataaggtagttaggtggccgtcatgaaccgccctatttggggcccaggagggtgtgagatagactctgacctcttctgagcaggcatctgcggaccaagggacaggcttggccccaaggtgacagggtatcggaacccccatcctgcctctggggtgtgggaggctcaagtccacacctcgttcttccacagcctgttctgagggtgacctagaaattggcagttctaactcagagggtcccacaggaccccacagaggaaactaggaaggaagggttgaaactccgcagccactcagagcctgcactcttaaaatgttcgagaacttaaggccgatggttgtaaaactgggtcttgaagacagctttgtagggggcacgctaaacctacttaaaaggactgttctctcgatgttgggagaagggtcatttatttgcagtatgctaatcacaaataatttttatctgttcattgaaggcagcctcccaggagcccggctagccttctgatgaggtggtagtcgtcagcacttggtgtttggcaatagtctgagtggcagctgtaatctagggtcttggaggtagctgtttttgcagcctgcttgactccagaggccaggccatccacggtttggtgacagcttggttgttggacctggggtcttgtggatggtgggtgatggcttgggacattcacgtcctaagcatgaccttggaaccatagactgcagctcccagatgattctcattcagggtctagtctctgaccactcactgcttcctcagccgactcataaatcctgtagtctggccgggcgcagtggctcacgcctgtaatcccagcactttgggaggccgaggtgggtggatcacgaggtcaggagttcaagaccagcctggccaacatggtgaaaccccatctctactaaaaatacaaaaaattagccaggcgtggtggcaggcatctgtaatcccagctgctcgggaggctgaggcaggagaatcgcttgaacccgggaggtggaggttgcagtgagccaagaccgcaccactgtactccagcctgggcaacagagcaagactccatctaaaaaaaaaaaaagaaaaaattctgtagtcttgccgttttcctgaatggcctggcttcctcctacccctggcctctgcacacacagttcctcttctctcgaaggttcttcttggcctttcccctgaggaggctggggggcttcctttattagccctgcctggctagggtagggggtcaggattatagaatttgcctcttttcctctccttcaggacttggcttggctgtggtatctttgggctgaagacttcctcgtcctcagggctggccatggttccacctttatatccccatgatgtcctctcttttttttctttttttctttttttgagacagtcttgctctgtgcccaggctggggtgcagtagtgtgatcacagctcactgcagcctcgaactcctggactcaagccaccctcccaccccagcctcacaagtagctgggaccgcagacaagggccactacacctggttaattttttattgtttgtagagatggggtcttgctatgttgcccaggctggtttcgaactcctgggcatgaggagtcctcccaccttggcctctcaaagtgctgggatgacaggagtgaaccaccgcgcctagccaacatcctttccttcctttgtcccaacattgatcttactcagatgtttacatctctctccccaattgcactagggacaggaagggatggaggcttgctcctcaaatacttgttaaatggctacatgtttgaatgaatgaatgaatgaaatcctgctcttgagccttgacctaaatggctaagcagactctctcctatttttcttaaatgctcatctctggggcaagttccccaccctggtaggagtcccagggtctctccctgaacttcctggggccccctctctccccactaccccagcctgtgtcttctcccaaccttaaccctgggggctttgctccccaatgtcatcctctctgtatctctcagttctctgactctcgccgtttgtaagtatctctctctcagatgcgtggcagccagggtcacagccaggttctttgggacaagccaggggtgtatgcccagctccatggggcctgcagaggcttcaggggacacccatggaagaagacctgcagggccaatttataaacagaggagcagagcaggacccagggcttggaatccatgctgagttacgtttttgtttttttttttttttttttgagagggagtctcactttgtcgcccaggctggcatgcagtggcgccatctcggctcactgcaacctctgcctcctgggttcaagcgattctcctgcctcaagtagccgggattacaggcatgctctaccacgcccggctaatttttgtatttttagtagagatggggtttcatcatgttggccagtctggtctagaactcctgacctcaagtgatctgcccgcctctgcctcccaaagtgctgggattgcaggcatgagacactgcgcccggtcctgagttcagttttgattggggggcttccgggataatatggggccgctaggacagggacccttagtgtgactggaagggaatttcctgaaggaattcatagcagaggtggagtggtgggaaggatggtttctgggggagaaggagatgcgtgaacctggccagaagacagtgtgttgtgacagatgattgctggtgagggggtaacagtctccaaggtgtagatgttgggggctccagatacggcaggaggggcctggcctctcggaatcccctcagccccatctcatagaaacatgtgctttctacccaggctccatactccggaagggaggcaggaccctgtcactttcttggcctactttggaagttctcagtcaggtatctccaggtgtggcagaggggctttggcctgtagggggtgtggtaatgtgggttttggaggcagaaagcttttcaggaaagccccctggtccatcacccccctttctttttttttttttgagatggagtcttgctttgttgcccacgctggagtgcagtggcacgatcccaactcactgcaacttccacctcccgggttcaagtgattctcgtgcctcagcctcccgagtagctgggattacagatgtacaccaccacacctggctaatttttgtatttttagtagagacggggtttcaccatgttcgccaggctggtcttgaacccctgacctcaagtgattggccctccttggcctcccaaagtgctgggattacaggttgtgagcccccaggcccggcctcatcatcacttcttcacccaccctattttggtagctctctctccactcgtcctgtggaactgatccattctcggtcccattcccttctctctgggccaatctgcacctaggtttgtggcttcatgagtatggagggtcgtgcagaaaggggccaggtctgtaggaacctgggttcatgccctggaaatttgcccatttaagataagttagggccgggtgcggtggctcatgcctgtaatccccagcactttgcacttcgggagaccgaggcgggcggatcacctgaggtcaggagtttgactagcctggccaacacggtgaaaccccatctctactaaaaatacaaaaattagccaggcgtagtggcgggcgcctgtaatcccaactgctcgggaggctgaggcaagagaattgcttgaacctaagaggtgaaggttgccgtgagctgagatcgtaccattgcactccagcctgggcgacaagagtgaaactctgtctcaaaaaaaaaaagataagataggtgtcctgaataagataggtgaaatgggtgaggatgtactttatcttacacggtcttagggagtgtctcaggcggtgaacagaactctctcgcccctgagctggggcctggctgacccagagctatttgtgtgcccacctgtcaccctctttcaggaccacctgcttcaggttgccagatttagcaaataaaaataaggatgcccagctaaaattggatttcagacaagcaaggactaatgcaatatttgggatgaacttctagctaaaagttacctgttgttgatctgtagttcagactgaactggaggtcttgcattttatctgccaaccctacaactgctgcctctggggcggtgagatggatggggtttggggaggggccagaggtgtgtgtggctgaccctggagttgggatcagggctcagtggaggccccggggatgatctggagcgagtttgaatcgagtggagctgattcactgaatcttggcttttttttttttaatttgtattgaaatgaggtctcactctgtcacccaggctggagtgcagtggcacaatctcggctcactgcagcttctccctccccggctcaagcgatccttctggctcagtctcccaagtaggtgggaccacaggcacacgccaccgtgcccggctaattttttgtatttttggtggagatggggtttcgccatgttgcccagttcctgagttcaagtgatctcaaagtgctggaattacagaagtgagccactgtacccagccagcagggtcctttttcatttttattttattctattttttgagacagtgtctcactctgtttcccaggctggagtgcagtggcgtgatcctacctcactgcaacctccaactcctgggctcaatgtgatcctcccacctcagcctctgcacctagctaattaaaaaaaaatttttttttttttagagatggggtcttgcgatgttgcccaggctggtctcaagctcctggcctcaagcgatcctcccacctcagcttcccaaagtgctgggattacaggcagtatccttctaatgtccttggtcaggcctcctccagcctgtggctcgagggtctagatctcctactggcctgggtggcatggagggtgtagtctaggtggcctgaggggtgcccagggatccccagtttgggaagtccttgtcttcagggatttctggccaatgtggtccgtatatttagagatgctgggaggagggggtgggaaattgctggaaacaccctattatacaccaagtaagattttcatgtaggattggcaaggcctgagtgctgggaaagtgtctgcaatggctacctttcaaagctgggagaccccgccacgggggcggttgtggacttgaggggctgaccccacagcacggaggctgctgggaattcctgcacctttgccatgctgccacctgaggcaggttcccagcacctgagctgcagcctctggagtgggggaaatggggggaaagtaaggggccggggtcatggggtccacgtccaccttccgcccgcctgggcagttttcttggatgtaaaagggagatggctctccccaacctgcctgggtcccagtgtggtgctgtagtccaagggacttggtgtgaccccgtggggatgccacagcatgggtgtgtgggacccccgggggcaggtctgtggtggagacagggtgggagggcctggcttgagggcttgcggtcctgggcacttgaggatgcagaagaggctgcatggttggggagggtaggtaagcagggggcagcttagccctttcccctcctgttccctgtgacagaggggagaccctccaggctgtttgtgtcttagatggttggccgagggtaggcctctttgctggctggggtctagcagggtctcaaggtgcattttctggctactggcagaaccaccatcaaagcaagtccgtatcttttcgtctatccatctgttgttacgccagccagtgaggaccttgcagaggcgtcaggcctgagggagtctcattaggtcctggtccccagcccccggctggcacatgagaagggcccactttatattatattttatttatttatttaagatggagtctcactctgtcacccaggctggagtgcagtggcgcgatctcggctcgctgcaacctctgcctcccgggttcaagcaattctcttgcctcagcctcctgagtagctgggattatgggtgcatgccacctcgcccagccaatttttgtatttttagtagagatggggttttgccatcttagccaggctggttttgaactcctgatctcaagtgatctgtccaccttgacttcccggagtgctgggattacaggcgtgagccactgtgtccggccccactttatattttattaaaaatatcgttgaggagtgaaggctatgctataccaggaacttgcctggctcacacccttatgtcgtccaacccccgtcaagacatagaacagcgctttgggaggctgaggcgggaggatggcttgaggccaggagtttgagactagcctagacaacatagtgaaacctccatctctacaagaagtacaaaaattagccaggcgaggtggctcatgcctgtagccccagctactcaggaggctgcggcgggaggatcacttgaggccaagaatttgagaccagcctgggcaacatagcaagaccccgtctcttaaaaaaaaaattagccgggtgtggtgatgtgtgcctgtagccccagctacttgggaggctaaggcaggaggattgcttgaccccaggagttagaacaatcctgtaacccctaaaagtttttgaagcccgtttgttcatccttgtctcttgtcctgaccccagcaaccactgatctgtcttctgtatatggttttccatttgtacaatgtcacataaatggaatcctacagtccacagcctctgaatctggcttcacacagcataatgcatttacggcattgctgggtacacgggtagctggtcccttctggtccctgagtagtgttccatggtgtggatatgccacatacctctagccactctcctctctagggaaatctagcaaaccggcttggccggccctgcatcagctcgggaccccccagaagaaggtggttcctctttctcattttcacaaaggcaccatctggctggcggggggcctgtggcctgcaccccatcactacccaccccccacatcaagagctgaccccaagccgggggagctgctcatctccgccctcagagctggaatttcatcttctgtttctggtgactcatactgtgagccccgcgatgaaattacacctgcctgccgctgccctccgggcctctggccccatgcgatcctcccgccgccatccaggtgggctctggagtaattgaggctatggggccaggacagctggaggttgagggcggtgccagggaggggagctgtctgtgccctggggtgtcttgcccatcatcttatgtatccccaccctgtgggagtctggggttcctggtggtgcgtctctggtcttcactcctgcagctgttttgcttggggtagaagtttcatgtttgcctgaaataagagcaggacttctgagggtagggaaggaaggtggtgaagccactgttgcaggcaggagcaggagttaggatcaaacggaacagggctggccgagtgatgtcacatctctgggctttggtttgttcatctgttcttattattattttgagacagggtctcgttctgtcacccaggctggagtgcagtggtgcaatcatagcttgctgcagtcttgaactcctaggctcaagtgattctcccacttcagcctcctaagtagctgggcttggaggcacttgccactacacccagctaatttttttattttgtagagatgggggtctcgccatgtcgcccaggctggtcttgaactcctgtgttcaagtgatcccgcaacctcagcttcccaagtgctgggattagaggggtgagccactgcgtcctgcctgttcatctttaagtgggagaacagaacactaggtttgcagggctgtgagactcagctgagggtaatgtgagtgtgtggattaccacagagccctggagggccccaggggccaccaaggagcgggtggtggggacatgtgaggctcaagcctcctgtgcccctttgggccagagtaggaccactgttgttttttgtttttttttttttgagacagagtctcactctgtcgcccaggctggagtgcagtggcgtgatcacggctcactacaacctccgcctcccgggttcagttgattctcctgcctcagcttctcgagtagctgggatcacaggtgcgtgccaccacacccgactaatttttgtatttttagtagaggcggagtttcaccatgttgtccaggctggtttcgaactcctgacctcaaatgatccacccatcttggcctcccagagtgctggaattacaggtgtgagccaccgcgccctgccctaggaccacttttaccagagttacctgttagagctctaaatacagttctggttgctaaatgtttggaatccactgctgcctgaggtcagccctgtgtgaacagtggctattctggtgaatgtttttgtggctagagcctagattatggtggtttacggactccagcctgtcacttgcctgaggctgagcctcagtttgaccctctagaaaatggaaccacagcaagtacctccacaggtttgccaggtgggcatgaatgaagcaggggagcccagcaagagtttgtcagtttcccattggcaaatccatgagtttcccagggctctcggcttcctaaggagatggagcttcctgggtgatcacatgtcttgcgtgggtgtcttgagagatttggggggtttttactttgtttttgttgttgttatttgtttgtttttgaaacagagtctccttctgtcacccaggctggagtgtagtggtgtgatcacggctcatggcagcccccctcctcctgggttcaggcacttctcccgcctcagcctcccaaatagctgggattacaggcacctgccaccacacccggctaatttttgtgtttttagtagagacggggtttcgccatgttggccaggctggtctcgaacccctgacctcgagtgatccacctgcctcagcctcccaaagtgctgggattacagacatgagcacaagccaccgcgcccagctggtttttactttgttatttaatttgttatttgtgaaatcgttgtggcccctctctaatgaaggttgccccaagtacctttcccctgtaccccacccttgcctcccacccctaccgggttccccaaagtcctcaaaggctggaccctggggccagcactcggtgggtagcctggaaagaggttagccctgtgcaggaaggaaggcccttgggtgctcctgggtggctccttgcagcagacaagacccaccgcccacccacctggctccagggtggtcctggcagctccaaggggtcttgtgactctctcagtctgatgtttctctcatgtttatccaggagctggtttttcaggcatggccgcttcttgcagtgaggccaggtggggagaggcagggctttggggaaggaggtggttacctctgctcccagggcacaccctggctgccagctgtgggtgcagccctctgggcaggtgggcaaaccacatcctccctctttgatcctggtccacctccccacctgccccgggccaccagctccctgagatattctcttctcagcatatccaaaggagagatgctcttggtggccctgggtcagaggccagggctccctcacttcacagcagggtgcagtggaaccatcagggtctttgaagccagacacacctaggttcaaatcccagcctgactgctgagctgctgtgtgaccacaggcaagtgactgtacctctctgagcctcatctgaaaaaacaaggatagttttcttatatagtattgccaggttcttgggaaaatcagtgtattcagttgcggggagctagctgccatctcagtgaagaacactttgtcagcttgtcacgtgatgaccccagaagctggccctgtgggagccccactcccccagacagtgaaccttggaccccatcattccaagatctgttcttattttctgcctgtctgggacacaccccctctgtccgtggggtgtggggtgtggggtgtggcatgcctcaatttatttattttttttgagacagagtcttcctctgttgcccaggctggagtgcagtggcaggatctcggctcactgcaacctctacctcctgggttcaagtgagtctcctgcctcagcctcccgagtagctgggatcacgggcgcccgccaccatgcctggctaattttttgtatttttagtagagacagggtttcaccatgttgcccaggctggtcttgaactcctggcctcaagtgatccacccgccttggcctcccaatgtgttgggattataggcatgagccactgcacccggacagcatgcctcggtttctgcttctgcaaactgggaaaacctcaaaggtagaactggttggtccccttggcctgccgaccccttagcccctcaaggtcacagtcagccatcccgcttgttagaggccaggccctgttctggggcgggggatacctgtggctgcttaggggacgggagacaatgccactcccaggtgtgtttgatggcagcctgcagaagtggctttctgcatggccctggaggacggtgatttggacagaagcgtagggccagagacaggacgtgacggtggggctgctgcattggctccaggtaaagatctgtatctgatggcctcactcccaggcagctcaggggttcccgtggctcctggaaaagctacagactaggcatggccaggccctgcctgtgtctctctgtgccagccacgatgagcctcatcgtttctaaaacgtactgtgctccgtctcgcttcctggaacgctgctgcctctcccctagagcgtgcgtaatgctccccggctgtgtccctgggctgatttctcgttgcaggtcttagctgggttgtcactcctctctgcaaagcttccctgacctcatctccctctccaggtcacgttaggtgcctcttgtctgtgtccccagccacagcccgcatcacaaacaagactataattgccctcgtgcttgtctgtcaccttcacagacagagtgtgacttccagtgggtcacggccccatcatcatgttgtcctccgcatccctgaccttagcaccctgcctgttgcggagtgggcatcctgtgcaaccttgtcaagtgaattagaagcaagctcggggtgggggcccatgaagggtgggggcctcctccaccctttttctttctttttttttttttttggagacagggtctcgctccattgcccaggctggagtgcagtggcatgatctcggctcactgcaacctccgcctcatgggttaaagcaattctgccttagccctccccagtagctgggaccacatgcacctgccaacacacccggctagtttttgtatttttagtagagatggggtttcatcatgttggccaggctggtctcaaactcctgacctcaagtgatccacccgcctcagcctcccaaaatgctgggattacaggggtgagcccccatgcccggcccctctccatccttcaatcccagctctcgttggcgctcctctacccatcccaggagctgcttctgccggcctggctgtggcgttcagaggcatctggagggcagtggcgatggcagtgggggcagcttgtctctctgagccgagtacagcccaatttggagcgtttccctccaggaaaggcagctgatgtgtgcagacagcacaagtgtggagtgccagaacagttaatcctctgggctatttatttatttatttattttgttttgttgttgagatagagtcttgctctgtcgcccaggctggagtgcagtggcgtgatcttggctcactgcaacctccacctcccaggttcaagcgatttgcctgcctcagcttcccgagtagctgggattacaggcatgcactaccacacctagctaatttttgtattttattttgtatttaattttttatttttattttttgagtcagaatctcgctctgtcacccaggctggagtgcagtggtttgatctcgactcactgcaacctctgactcctggtttcaagcgattctcctgcctcagtctcctgagtagctgggattacaggcgcccgccactgctcccggctaatttttgtatttttagtagagacggggtttcaccatgttggaccagactggtcttgaactcctgtcctcaggtgatccgcctctgggctatttagacacacatgcttgtgtgcatgcatgggtgtgtatatgcacatgtatgtgacattcctgaggccaccggcggtgacgaggcctgattacttgacgttctgctgaatcctgactactagcctggagctttactccccagtgtacacagctccccgagtcctggttagtggtaaagaggggactgtcccctgtcatttagggctgcatttggctacaggtaattaaacacccaactgtaaatatagcaaatatctaaatattaagccaggtcaggtgcagcagctcaggcatgtaattttagcacttcggaaggccgagatgggcagattgcttgagcttaggagtttgagaccggcctgggcaacgtagtgagaccctgttctctacaaaacataaaaataattaaaaaaaaaaaaaaaacccagccaggccgcagtggctcactcctgtaatcccagcactttgggaggctgagacgcgcagatcacaaggtcaggagttcaagaccagcctggccaacatggtgaaaccccatctctactaaaaatacaaaaaattagccgggcgtggtggcacgtgcctgtaatcccagctacttgggaggctgagacaggagaatcacttgaacctcggaggcagaggttgcagtgagccaagactgtgctactgcactccagcctggcgacagagcagcgagactccatctccaaaaaaaaaaaaaactgtgtgtgtgtgtgtgtgtgtgtgtgtgtgtgtgtgtgtgtgtgtgtagcctggcagactttagatattaaacctgacagttaaacaaaaaggagtttatttattcctcataagaaaatatggaagggccgggcgcggtggctcacgcctgtaatcccagcactttgggaggccaaggcaggcagatcatgaggtcaggagagcgagaccatcctggctaacatggtgaaaccccgtctctactaaaaatacaaaaaaattagccgggcgtgatggtgggcgcctgtagtcccagctactcgggaggctgaggcaggagaatgacgtgaacccgggaggtggagcttgcagtgaaccgagatcgagccactgcactccagcctggacgacagagcgagactccatctcaaaaaaaaaaaaatatggaaggtatttggaggataggatgggtacttatgagtaggtatttggaggctgggatgggtacctgtgagtaggtatttggaggctggggtaggagcgtggtgatgcttttcagggttcagtgatgtctccagagacttgattctgttcttctctaccatgttggattttctttttttttgtaagtttattttaaaactattcctttaaagtgtataattcagtgttttttttaaaatatattcacagagttgtgcagtattcatcactgtctaatttcagagcatttttatcatcctaagaatctccccccattaagcagtcagccctcattccctcctcccccatcccctggcaaccactaatttactttccatctctgtagatttgcctattctgggcgtttcttgtagatggaatcatgtaatatgtggtctttcgagtctggccttttctcagtgagtataatgtgttcaaggttcatccacattgtagcgtgagtcaatgtgcctttctttttatggccaaataatattccatttaatggatagatcatatttatctgttcatcagttatggacatatggggtgtttctactttttattattttattttattttgagacagggtcttgctctgtcacccaggctggagtgctttggtgggatcatggctcactgcagcctcaaactcctgggttcaagggatcctcctgcctcagcctcccaagtagctgggactgcaggcaccaagccaccacccctgactaatttttaaatatttttttggtagagacggcatatgtattagcaaggccctgtctctaccaaaaaagataaaaattatcatattctttattatgatatcattataccataaaattcaccattttatttatttagtgtttttagagatagggttggccaggctctgttggccaggctggagtgcagcggtgcagtcttggctcactgcaacctccatttcccaggctccagctattctcctgcctcagcctcccgagtagctgggactacaggtgtatgccaccatgcctggctaatttttgtatctcttgtagctgtgttgcccaggctggtcttgaacccctggactcaaacaatccacccacttcagcctctcaaagtgctgagatagataagcataagccaccacacacggccaaattcaccattttaaaatacgctatgcaatatttttagtatcatcatgaagttgtgtgaccatcgccaccatctaagtccgttcattttcgtcactctgaaaagaagcctgttacctcattagcagtctctccattccccagcaccccccactccagcccctggtaattgctaatggttgtctctctgggtttttgatagcttatttataacattcagccttcacctaccatatgactaggtatttacctatgagaaatgaaagctcaaattcacataaaaacctaaagaggaatatgtatagtggctttattcataattgccccaaactggaaacaattcagatgtcagactgcccagtgaataaacaaactggaacatccatactgtggaatattagttagcagtgaaaaaggatgaatgatggataccacaccaccacggggaaacctcacgagcattgtgctaagggaaggaagcagactggaaaggccgcttccaacctagttctgttcatatgtggggttttttttttcgagacggagccttgctctcttgcccaggctggagtgcaatggcgtgatctcggctcactgcaacctccgcctccctggttcaagcaattctcctgcttcagcctcccaagtagctgggacaacaggcgtgccaccacacctggttaattttttttgtatttttagtagagatgggatttcgccatgctggccaggctggtcttaaactcctgacctcaggtgatctgcccgcctcagcctcccaaagtgctgggattacaggcgtgagccaccgtgcccggcctctggttctagtcatatgatgttctggaaaatgcaggattagggacagggtttgcctgggagtgggagagtttttggggagatggaactgaaatgcgttttgattacggtggcagtcacctgactgtttgcatttgtgaaaactcatagaaatatggccagaggctcatgcctgtaatcccagcactttggaagactgaggcaggaggatcgcttgaggtcaggaatctgagaccagcttagacagccaaaaaaattagccgggtgtggtggcacacagctgtagttccagctactcaagaggctgagccgggagaattgcttgaggctgggagttcaagcctgcggtgagctataattgtgccactgcactctagcctgggtgacagagcgagaccccatctctacaaaaagatttaaaaattagccaggcaccgtggcttgcacttgtattcccagctactcaggaggctgaggtgggagggtggtttgagcccagaagtttgagaccaaactatgtttactgggtaacatagcaagacccctgtctctatctttttgaaatatttaaaaaaaaaaaaaaaaacaaaaaaaaaaacaaaaaaaacggccgggtgcggtggctgacgtctgtaatcccaacactttgggaggccaaggcgggcagatcatgaggtcaggagattgagaccatcctggccaatgtggtgaaactctgtctctactaaaattacaaaaattagccaggcatggtggtgggtgcctgtaatcccagctgctcaggaggctgaggcaggagaattgcttgaatccgggaggcggagtctgcagtgagccgagatggcgccactgctctccagcctaggcgacagaatgagactctgtctcaacaacaaacaaacaaacaaacaaaacagaacactcatagaactgtatgtcagaaagaatgaattttattgcatgtatattacactccaggtaaaaaggggcctggcctggaactggcctttccagagtaactccacttggagttcaccatctcatttgttctagttggtgccaccatcccttctaccaatggtgagttttggtctgtcaagttggccaacctgagttgtgcatagggccggggccagatgctgcagtggggcccccctctttccccttccttggacatcctaacccctcttggggtttcccgagcttcttggatggagggagccatagaatgttagaactggagggaacctcagaatatactggcctcttctctttttcagatggggaaactgaggcccagggctgggaagacacttgactaaggttctagagttacgaggatcaagatctaaaaccacatctggccgggcacagtggctcacgcctgtaatcccagcactttgggaggccgaggcaggaggatcacttgaggtcgggagttcgagagcagcctgggcaacgtggtgaaaccccatctctattaaaaatacaaaaaaaaatttagccaggcatggcggggggtgcctgtaatcccagctacttgtgaggctgagacatgagaactgcttcaacccgggaggcggagattgcagtgagccgagatcgcaccactgccctccagcctgggcaacaagagcgaaactctgcctcagtaaataaataaataaataatcaatcaatcaatccacatccatgactcttggtctgggcctccttgccctcctgcagatgcctctggagcctcccttgtctcctgctcctggttcgggaggctggacaggcccaagctggccccacagctggtgggaggctttgctgcagcgtaccctggacagggcagagttgggtagggaagggagagtggtcagagcatctgcaacaccgcagcggaggagaggagagagtgcggtgaaggctggcaagtggttgattatggggagctgtgagaatggttgatggccccccagggacagacaggagaacagagcactggtttctgctctttggagctcctgacatcacctggagtaacccccaagcctcatgatgtgttcaggtagatcccagcaaatgcagaattggggtcagcctggttgggatgacaaccagaagagcttcctaagggaaggaccccaggagaacctggtgggggcaggggagagatcttggccggtgtcccttcccaagggaggaacccagtctcagggacgtagtcccgccccctggtttattctggtattgctgtgtccaccagcctggggctgccaagagctctggaaacttctgtgaggttgggcgtggaggttgcatggtggcagctcagggcttttttttttttttgagagagggtcttcctctgtcgcccaagctggagtacagtggaacagtcatagctcactgcagcctcaaactcttggcttcaagtaatcctctcactttggcctcccaaaatgttgggattacaggcatgagccactgcgcacggctttggggattcttattggctgtgaaccccgtgattcattgctcccattttcttggtttagtgcccactcctgcagatgaggggaggcagactgaacctcctggagtctggggtctgggtggtgagcctgcccacttccaggaactgtccataacccacccaccatcctggacagcccgcaaccttggtagcacaggacacttgcccactgccctatttttggctcagaaaacgatatcttcagctgggtgcagtggctcacgccgagctgggcggatcacctgaggtcaggagttcgagaccagcctgaccaacttgatgaaaccccgtctgtactaaaaatacaaaaattaaggctgggcgcggtggctcacacctgtaatcccagcactttgggaggccgaggcgggtggatcacctgaggtcaggagttcgagaccaggctggccaacgtggcgaaaccccatctctactaaaaatacaaaaaaaaaaaacaaaaaaattaactgggcatgctgatgggcacctgtaatcctatctatttgggaggctgaggcaggagaattgcttgaacccgggaggtgagttcaaccactgagccgaggtcgtgccactgcactccagcctgggcaatgaagtgagactctgtctcaaaagaaaacgatattttcttacctatggggtcccctctggttttcaggactcacaatgcctgcaggaagcccacctcaggtctcactgtagcccccctggtggggaaacccctctgcctctagcagggcaggcagaaaagatgtgtttggaataaataatgagcctatgggagagccactcccatcttggtgcaaatatttgtgtgtgaatcactcatctggacagtgggactggattgtggttgacagtgagccatgcctggggggctgtgcaggggacattgtaggggtgcagggccatgtttactccagatcccagcagacttcactttgaagctggcccctgactctttgtgctgtgtgaccttgggcgagttgctcagcctttctgagcctctacatcctcatctgtaaaatggggagagtactgttgtgtttgtagtgttgctgaggtgggttgcgagatgcccatcagcagcacagctcctgccactgatggctgcaacgcaactgtgatttctcagaaatgtcatcccaggcccagctagccctgaggcccaggtggggttttgagggaaagggatctggctgggagcagtggctcgggcctgtaatcccaacactttgggaggttgaggcgggaagactgcttgagtccaggagtttgagaccagccttggcaacatagcaaaactccatctctacaaaaaaaataaaataaaataaaattagccaggtatggtggtgtgtgcctgtagtcccagatactcaggaaggatttgggacgatcacttgaggctaagagtttgagaccagccagggcaacatagcaagactccatctctacaaaaaataaaataagtagctggacacgatggcacacaccttaagtcccagctacttgggagtctgaggcagaaggatcacttgaacccaggagttggaggctgcagtgagctatgatcacgccattgcgatcataggctgggtgacagagcaagagaccctgtctcttaaaaaaagaaagaaagaaaagaaaaatgatactcaacccttgtccattgggcctgactctcacctcccacctctactttgtgaggaagggacagggtgttattatgtcttcattggagggtactggggcccagagaggggaaggaagttctccagcatcacacagccactcgaggctgagcctccactagacccagacctcctggggcctggcctcatgtgcgttcctgagactacagggttttggtgaggggctgccctgccatctgttgctgtaccctagggaggggagggtgtggcccgggctggactcctccaagttgctctgtccctgggttttggaaggggaggggccgcttcatgaaattgcaccacctggccaaggctcgggcaagcccaggttggatgcaggtggccaggcttttctgacaggtgagggcagaagtggaagtaatgcaggtgttcagagaaagggccggatgtgtgtgcatgcgcacacccagctacaaaacaaggggtgccattcctcagggaccaggccattaacgtgagccacccgtctgatgcgtagtcacccgccggggtgacgggggacttcctggactctgcggcctgatcctgcctgtctggtgacattcctgatctggagtacacattgggcctgcagtgggtgctttggtgtttgtggaatgaatgaatgggctggcggcacccactgatgagcatctgccaagatgtctgtgtgcgtggaggtggcaggtgtggtccaggtacccgataacggatagacacctgtacaaaacagcctcttctccaatgcctggtggtggtgagggatgggggtgtggctattttgcagttggatggtgtggacacttacaagtcaactaatcccgatgctctggactcctgtctgtaaaatgggatggcgtaggtgtgggctggtggtgcctggtgggtcccgcccaagccccagagaaggggctgatggcagctagttgttatttttattactaaatcatggctcagcccagcctggcctggcaagcccaagttcctggtggatgtctgcctcttccacgcccgcttggaagccttctgaacctccttttttttttttttttttttttcttttgagacggagtctcactctgtcgcccaggctggagtgcagcggtgcgatctcggctcactgcaacctctgcctcccgggttcaagcgattctcctgcctcagcctcccaagtagctgggatacaggtgcacgccaccaggctcggctaatttttttatttttagtagagatggggtttcactgtgttggccaggctgatctcaaactcctgaccttaagtgatccgcctgcctctgaacctcccagatttcatcggttccccaccgtactctcctgcctctagcctttgcccaagctgaccttggccccagtcttccccactgaacagccacccagcctttggggccagtgctcctgggccgatgccagccatccatcctggatgtgcccacgcctggtcactccccacatgaggagctgatgatctttggtcaccgtttataaactttagcttctctttcctcacccaggagctccagggcaaggagtgggcctgattcacccccgttcagggactgggtcctaacaggtgtggtgaaaatgagcacttagtcagcgtcccacagcatctaaaagacgggaacaagggctgaggatgtgggtaggcccaagactggaaatagggaagcctctggaatggggactagaagatgaaagggctctggaagatggggcatccaagtgtttaaagcaagaacggggctgggcgtggtggatcgcgcctgtaatcccagcactttgggaggctgaggagggaggatcacttgaggccaggagtttgagaccagcctggccaacatggtgaaaccccatctctactaaaaatacaaaaattagccacacatgccagtgcgcacctgtaatccccgctactcaagaggctgagtcaggagaatcacttgaacctgagagacagaggttgcagtgagctaagatcgcaccagtgcactccagcctgggcgacagttttttttttgtgtccaaaaaaaaaaagaggtgcggggagggccagagggcatttggggtgggacggggcagggcagggctgggtgactggaatggggtgactataatgaatgctttggagtaggtcagggcaggtggggaggccagatgccaggggagggagggggcatggggatccttccatctggggccaaggatggcaaggccctcagacaacttctagcccaggttctccattgacagatggagaaactgaggcccagggaggggcagtgctagtgctgaggttttacatagcaggtgggctgttccccagcccactgcagggcatagcctgccctgggacacctgtcctcacccgttggctcagtggttgcaggggcatgggtgggtagaggtcggggagtgagccggctcaggcgggcagggctgggggccccgtgagccagcgccccaggattagatcacccacgagtaatgggcttttttccgtccagccttttcccgacaagaaaaggcctgatgttcctcatccgtgttgttctgagaaggcatgtttatgtctggcaagcgaagggttcttgggagacaggatcccagggcccccctgcactgcctggccccaggggttggcaccgccccagagctggtttcctcccactgtctcctgacacccagcccccacgcttttcagatgcctgcctgagaacaaataaatacttctgcaccatgcacatgagctcagataagcctccggggctcagccagaactgggggcaccaaatgcccgggttccctgacccctagctgggtgccaagcctgcatttcccacccagcactccccaaccgccccttgcgtggagggacagagatatactgtgagcaacacgggacctgatgtcaggggtggacagcagctcggcgggtgatgtcagcttgagcaatcgtccccgtcatcactgctgttaagtgagcgggcacttggtgtccccaggcccagcgccaggccctgttcacacattctcacgtggggctctcacagagctgagagcagtagaattaccatcacccttttgctcagtggggagaggaaagtttgagcattgtgtgtgtgtgtgtgtgtttagagacagggtcttgctctgtcacccaggctggagtgcagtggtgcgatcatagctcactgtagcctagaactcttgggctcaagcgagcctcccacctcatcctcctgagtagctgggattacaggcacatgccaccacgcccaactaatttttatgcttttagtagagatggggtttcaccatgttggccaggctggtctcaaactcctggcctcaagtgaaccacccacctcagcctcccaaagtgctgggattataggcatgagccaccagccccacctttttttttgagatagggtcttgctgtattgtccaggctggagtgcagtagcgtgatcatggctcactgcaacctctgcctcctgggcccaagcaaccctcccaccccagcctctggagtagctgggactacaggcacatgctatcacactaggctaattaaaaaaaaaaaaattatagagatggggtctcactatgttgcccaggctggtctcaaactcctgggatcagaaacctggtggtcattccaggtgcctcccttgggaccccccgtcgccagctcctggtcccaaagctctgccccgtcctccatcccctgctgctgtctgcttcatgcctggctgtctctggcctgggctgtcgcagagacttggcaactcctggctccccaactccaagcatgacccgacagttcctccgccgtagcttcctgggatccccctcactgcccacgtctcacccccgccccacaccctgcagcgaggctgaccttccgaggtccttggcctcaccccaatggccacgctggtctctgcccaccacttcctgccctgccctgcacactccagccatgcagagctggatttgttccccacccacccacccactcccacagcctctggccccgctcaggcccgaccaggacacgtgggcggcccaggctggcggttgggtttcctgggcagccagtaatttggcactccttcaaacaggtctttatttattcagcatttatttctaggggaggtgggtgctgcggtggggcagggaaggcgcctcccttgtagaagagcagggcctgggcacagtgcctgtctcccctcctcacctgcaaacgccaactcccctgggagggtcccggcagctcaggtgtcacctcctccaggaagccccaccctgactgcctcacccgccgtcctgggcttcttccatgccacttatttttatctttcactgaagcataatttacttccagtaaagtacatgagtacatgaatcttttttttttttttttttttttggagacagagtcctgctctgtcatctaggctggagtggcgtggtcttggctcattgcaacgtccccatcctgggttcaaacaattctcctgtctcagcctcctgagtggcttataggcgcgtccaccatgcccagctaatttttgtatttttagtagagacggggttttgccatgttggccaggctggtctcaaactcctgacctcaagtgatctgcccgcctcggcctccctaagtgctgggattacagtcgtgagccatcgcacccagcccaagtacataaatcttaagcatcccgtgtgatgaattttcccccgacttgtatactcatgtaaccatcactcagctcaaatccttgcactgtgttttaatcttttttttttttcccagtagtctatttttttggtcattttccctgccagcctgggaatccttcaagggcaggagcacctgctgttgggccctgtgcggtgtgggacacagtgtgagagagtattggtgcctgtgagctggtggctgtgtccccacccctgtgattgtccccacgtgtgtgtgtgacggaggctgtggccgtgggaacatgtggatctgtgagcctggccaggggccccagtgcaggggcaagcgccccctcctccactggaagagagccttgtccgatcccccagccaagggcctttgcagggagccgtggccctgctggagagtccccgccggctgacagcccggagattagtctccaaggccacaacgccagttgccataggcacgcaggcccgcgtcaggactgcgatttctcatcctggtcacgcaggcaggcggccgcccctgcccgcctgccaggatccaggctcaggctttaaataacaagggtggaaacctgaaccgcggagccgtctgcccggcggatcctggcctcccctcctggtagagcaggcatggggcggcctggaccccgcatactgccggcggcggcggagtccctccgtgcccgccccgggggacgggagagaaatggagaaacctgagtttgggggctctctttgagtgctcctagtacctgatgcacagcccgagctgagaggagacagccccttttcctaaatcccgtcctccacgtggaggaaggacgccctaccttccagaagcctagatgaagggcagatggggcttcgcatggccaggcctcagatcggcttcccccagcccctccagggaagaggcaggaggctccctcacttccccttggaaggcagcatgaatccctgtacttcctggactgcccctttgcccccgcctggggccaactttcctgtcatggggtggagcagctgtgttggatggttggttttgctttttgttttgctctattttttatttaaaaggaaaatttttttagaaatgaggtcttgctctatcgcccaggctggagtgcagtggcgcaatcccagttcgatgcattcttgaactcctgggctcaagccatcctcccacctcagctttctgagtagctgtgacgacaggcgcgtgccaccacgcccggctcatattttaaattttttgttagagatggggtcttgcgatgttgcccaggctggtctcaaactcttggcctcaggcaatcctcctgcttctctggctcccagagtgttgggattacaggagtgagccaccacgcccagcctgcttttgtttttaaaggatgaggtttctgttgtttctttccaaattgtaaaagtaatacttaccttaggtgacttagaaaatacagaaaagtagagggaagcaaagtcaggcatggatcccaccctgagatgcacggtctggagtttgcatcccgggctgcactgtgtatgcccctgaggtcatcctgtccagtgttggaatcagcctctgctgggcatcaggttgcctgcacctactccttgtttatatgtgggtgtgtgtatctgtggatgtaccaagtgaaagctttggggaaacatctttgcatgtaaatctttgcatttgggataattaactcaggattaatttatagaattataagtcctggagcgaagggtgggaacagagttaaaattgaacttcctgaaacacgtcacagcgtcaccaaatcgcttggctgggaggactgtgtgcacccagggcccttctgtggggtgggccaggatttagtgtgaaactcatggctgctaggctgggaagagctcgaccacaggtgtggggttttgtctccagtgacattcccagctggctcttgcagcccctgccctagtgacagcatggggtgagggggccagaggaggctggaggtggagccctgcctctaggcggaactgtaccatctgtagttgcagggcaggattaaaaagggacagttttgctgtttgtttgtttgtttttttctgtcatctgactgggtgtcccaatacctgatgtctcctaaaactttttttttttttttttttttttgagacgggcctccttctgtatcccaggctggagtgcagtgatgcaatctcggctcactgcagcctcaacctcatgggatcaagtgatcctcctgccttagcctcccgagtagctgggacgacaggcatgcgccaccacacatggctaaattttaaattttttgtagagtcagggtctctctgtgttgtccaggctggtctcaaatttctgggctcaagtggtcctcctgcctcagcctcccaaagtgctgggattacgggtgcgagccactgtttctggccttatgcacacttttcattgagaacaaagttatttgttgtaagagaaacaccttgataactgttcacacactaaactacccaggtaaccagcacccagatcaagaaacagcattgacaagcccctctcacccccttccagttactaccactctccctgacccaccacgataaccgccgttccatctcctggcttcagaatgtggcctccttttgaaccttacataaatggaattctaccatgtgacctcagattctttcatcatccttgcgagattccaccgtggtgttgcgtgtctttgtggtttgctcatacgtctgatgccttttccaatagacggggcacccaggaggagtcagtggaaacacatgtaccgtggaaacagatcaggtcttgcgctgaaattcggatacctctgaattactgcccatcgtcaaagaaataaagtttatttccctaaaggatgttttgtggtgaataggaaagaatttgcaatcagcgtagctgttaagcccacaggagagcaagttgtattatgttgtgagcctgggttgggtgtgcagagatctggggttcagtctgacgcctctgggccgtggtttccctagatggacatgcaggtggttagatgaggggcccatctagctcagtgctgtgatgctaagcatatacttctcagtgctaagaggttgttttccaaagtgtttgaagtttgctcttaagatcttatttaggccggtcacagtggctcattcctgtaatcccagcactttgggagactgaggcaggattgcttgagcccaagaatttgagcccagcctgggcaacatagcaaggccccatctctaaaaaaaaaaaaattttttttttaattagctgggcatggtggcatgtgtctgcagttccagctacttgcgaggctgagggaaagaatcgcttgagcccaggaatttgaggctgcaatgagctatgattgcagcactgcactccaggctgggtggcagaacaagactgtctctacaaaaaaaatttttaaaaatcaggcatggcagcatgcacctgtaaccccagctacttgggaggctgaggcaggcggatggctggagtccaggaatttgaggctgcagtgagccatgatcgtgccactgcattccagcctgggtgacagagcgagactccatctttacaaaacatttttaaaaaaattagcagggagctactcgggaggctgaggccggcagatggcttgagtccaggagtttgagggtgcagtgagccataatcacgccattgcattccagcctaggtggcagagcaagactctgtctctttaaaaaaaaaaaaatcttatttaccaacttggctcatttctaagtggagcaaaaatgcagtgtctcacttctgctctgcctgaattacctccaggccagatttcttggtggaaggaaggagccgtgtagatacagccagagtctcccaggtgcaaagaccctctgagaggccttgataagtgggcagcttccactgagcagcccccagagatggagactcagtgcccacacagcagcttgttcttccattctgggacagttcttcccattaggaatgttcccttgtgttggctgaaagcctgtgtccctaaattctctgtcagcgtaacggcaatgaacctggacttgggtcttcaggaaccaaagccatggagtcaaggatttggagagatggtatattcatcaccgggcctaacatgatggtctttttttatttttaaattgagacagggtctcactctgtcacccaggctggagtgcagtagtgtgacctcagctcactgcaacctctacctcccaggctcaagtgatcctcctgtctcagcctcccaaagtactgagattacaggcatgagccaccacacccggccatccttctttttttttttttttttttgaattggagtctcactctttcacccacccaggctggagcgaagtggtgcgatcttggcttactgcaacctccaccctccgggttcaagcaattctcctgcctcagcctcccgagtagctgtgattacaggcacctgccaccacagccagctaatttttgtatttttagtagagacgagatttcaccatgttggccaggctggtctcaaactcctgacgtcaggtgatccacccgcctcagcctcccaaatgttaggattacagtcatgagccactgcacccagcctgtctttcctttttaaggctcagtaatattccattgtatggatagactgtggttttttatccattcatcatcggacgctgggacggtttctgccttttggctattgtgaatactgatcctatgaacatggctgtacagatgtgtctttgagactattactgttttattaacaacattgctgtaatgagggatctcaaatctggagtggatctgagaaatcgcctctttcaaccccttatccaatgcttgagtccttccttccagaatcccactgagacttcttctggcctcagatgcgtgggtgggagacatgccacctcccgacacctctgaccaagggcccggagctgggtggcttagggtgcaggaaagaggcttgtgagtgggatcatgccagagggatgtgcatcaaggcatcctctagctacagatgccccaggggaggcagcagtggggctgctgcaggagaaacctggaatggatgtttggacacactttcctcaatggccaggattgatggacagtggaattcatcagacgagtcttggagactgaggcctttaaaaatagatgcagctggctgggtgcggtggctcacgcctgtaatcccagcactttgagaggccgaggcgggcggatcacgaggtcaggagatcgagaccatcctggctaacacggtgaaaccccgtctctactaaaaacacaaaaaattagctgggcgtggtggcggacgcctgtagtcccagctactcgggaggctgaggcaggagaatggtgtgaacccaggaggcggagcttgcagtgagccgagatagtgccactgcagtctggcctgggtaaaagagcaagactccatctcaaagaaaaaaaaaaaatagatgcagctgggagcagtggctcacacctataatcccggcactttgagaggccgaggcaggtggatcacttgagggcaggagtttgagaccagcctgggcaacatagcaagactctgtctctactaaaaattttttaaaaaattagccgggtatggtggcgcaatcatgtagtcccaggtactcgtgagcctgaggcaggagaattgcttgagtccaggaaggtggggctgcagtgagctatgatcgtgcctctgcactccagcctcggtgacagagtgagaccctgtctttaaaaaaaaagaagaagaaagaaaagaaaatgcctcccatggaatctgtttctttttttttttgagatggagtcttgccctgtcacccaggctggagtacggtggcatgatcttggctcactgcaacctccgcctcccaggttcaagcagttctcctgcctcagcctcctgagtagctgggattataggtgcccaacaccacgcccagctaatttttgtatttttagtagagatgtggtttcaccatgttggccaggctggtctcgaactcttgacctcaagtgatccgcccacaccgccgtggagtctatttctgttaggaatgtgtttgttgcaagcaacctgagaaacagaggcttaggagagaggggtgtctcgtgtaacaggaggcatgggtgggtggtccagccgcaggcagctgctcaggcacatctgaggggcctgcgccatctctctctctctcctctggctgagggctttggtcatcctggcctaaagtggatgtcagccaccaggcagggcatagggagtaagggattgagccccccattgcctgcttccagggaaactctgctcttttgtttgggaatgcctcactggttagactgtgtcttgtggtcatctctggctgcaagagagtataggaatgggaggattttgtgttgtggcccctacagaagaggagagcaagggagaagttggttatatggggattgaggtaccagccacacagcatctgtctgcctcacaatcccagcacgttcagctgggcatggtggctcatgcctatagtcccagctactcaggaagctgaggcaggaggattgcttgagcctaggagttcaggaccagcctgagcaacatagcaagaccatgtctctacaaaaaaaaaaaatgaaaaaaaatagccaagcgtggttgtgtgctcctgtaatcccagctactcaggacactgagggtggcgtggggaagatcccttgagcccaggagtttgaaaccagcctggacaacatagcaagaccctgtctctaaaaacaaagaaatgagacgcattagacaaaagttcccaaaagttggactcagtgatgtagatgagagaattacaagataacttttcttttcttttttccttttgagatggagtctctgtcacccaggtgggagtgcagtggcgcgatcttggctcactgcaacctccgcctcccaggttcacatgattctccctgcctcagcctcccaagtagctagaattacaggcacccaacaccatgcagggctaatttttgtattttaatagagatgaggtttcgccatgttggccaggctggtcttgaactccggacctcaggttatcgaccgcctcggcctcccaaagtgctgggattacaggcgtgagccactgcacctggccagggtaacttctctctttgtctctattccctttctgaatatgaaagctttccagttctacttgatatcgtaagaaatactaagtcacccaaagtgtaacacctgttttttgcagtctcctatctaagaactaaccagacccgactctgcttagcttctgagatcagatgagatcaggctctttcagggtggtggggccgtagactgtttttgcaatctctaggaaattttttttaaagccagagaaagataaattatccacattacttaaacaatttttaaaaatatacaagaaagcctagcttatttaaagcccaaaacactgtaattccattggtaacaaagatgttaaacatttaaaatgtgattaaatctaaaattggtggcttctgaataaactgtagttttgaatttgatacagcaaatctgtggcaatgttgaacaaaacaacttatacataatgcatttttatattttaaactaacaaagatgcttcagaaatatagaggacatttttaaaagaattacttatattttaatcttttcaaattttccattttgtttccatcacttccatttttttcagaatattgtgcctcctcaaacatcatggtaagagggtggtgggactagagatggagccctcagcataaaaaataaagttagccgggtgcagtggctcacactcataatctagcactttgggagcccaaggtgagaagatcacttgaggccaggagttcaagatcagcctgggcaacacagtgagaccctatctctaaaaagtaaaaataaaaacttagctgggtgtggcgacacacgctgtggtcccagctactcaggaggctgaggcgggaggatcgcttgagcccaggagttggaggctgcagtgagctatgatcacacccacttcactccagcctagagacagagtgagaccctgtgtcaaaataaagaattgtagcacactcagaatcttcaaatcttgctctgggtatcaaaatcggatgtaggctcttcagctgcagttggaaaggaaattgtaaaatagacctgtagtcaaaaacaaatgggtgactttacaactggtaaagactgacttaagtaggatgtttttagctgcaaatgaaagaaacctctggctgggcacggtggctcacgcctgtaatcccatcactttgggaggccaaggcaggaggattgcttgagaccaggagttcagaaccagcctgggcaacatagtgagaccctgtctctaacaagattttttaagtgagccaggtgtggtggcaggcgcccgtagtcccagctacttgggaggctgaggctggaggattgcttgagtctaggagagatcaagatcgaggctgcagttagctatgattgcatcactgcactccagcctgggtgacagaagaaaaaaagagagagagagagaagaaaagaaactctagtcctgggggggtaaaaaaggaaagaagaaaagaaacctctactaagagtgccttaagaaatatggacttttgcctgggcgcggtggttcattcctgtaatcccagcactttgggaggccaaggtggcggatcacctgaggtcaggagttcaagaccagcctggccaacataacaaaaccccgtctctactaacaatacaaaaattagccgggtgtggtggtgggttcctgtaatcccagctactcaggaggctgaggcaggagaatcatttgaacccaggaggcagaagttgcagtgagccaagatcgtgccactgcactccagcctgggcaacagggtaagactccatctcaaaaagaaaaaaaaagacttttactgtttcacccaaagcttagagatggcagatctggggtcatacaggaccaagttcttccacgagttcaccctgccatcctcagataccctcacctcccgggctgattcttttcatgtctctagttggctgtcatggtcgggggtgtcacatgcaggagaaggaggacatccctggtttcagtccctttttttatttgagacggagtcttgctctgttgcccaggctggagtgcaatggtgtgatctcagctcactgcaacctccgcctcccgggttcaagcgattctcctgcctcagcctcccaagtagctgggattacaggcatgtaccaccacacctggctaatttttgtatttttagtagagacggggtttcgccatgttggccaggctggtctcaaactcctgacctcaggtgatctgcccaccttggcctcccaaagtgctgagatgacaggtgtgagccaccactcctggcctggtttcagttcctttctaagggcaaggacagctctcctagaagtccctcatgtctcagtggccagaattgggttctggcctctccttacacctgtcccagctaggggaaaaggagtgccttgctctgagccttggagaatcaccaaagttcctcccagggactgggagggcccagctgccccaagcactggttgttgggacaacccagcaaagtttgtcccatctttagataccaggacacaacggggggattctgttagcagggagtggggcagaggacttggaggacagcttttggggtcagatccaggactggaactcagattttttttgtgtgtgtgtgtgacagagtctagctctgtcccctgggttggactgcagtgctgcagtcatagctcattgcagccttgacctcccgtgtcaagctatcctcctgcctcagcaccccgagtagctgggacaacaggcacgcaccaccacacctggctaacttttttgtttttttgtagagatggggtctcactgtgctgcccaggctgatcttgaactcctgggcttgatcctcctgccttagcctcccaaagcactgggattacaggcgtgagccactgcgcccagtgagaccccaggtgtcttaaccatgaccccagactgccttctactgcactgcggctgggtgtaagaccccctcccgctgcccagcccagagcctggcctgagcagatacgaatggaaggccagggctgtgactggcagtgttcttcccggctacagtgacagtggtggtgggggagggcaggaatccaggacccccaggccactctacccccactggggagcctctgggactagagagggagtattcagagggaggctgaggctgctggggagaaaggataccccccccccgcccgccttccagaaggggagaaatttcttttttgtttgttctctcaagcttctttttcaagaaacaagcatatggcagcggatggtgcgggggccgtgtttgggtggggtgtgtgcctgcctttgccttttacgtggttgggtgtatttttttttttctccatcagctccaacgccccagctggtccatagggcagtgagacttgaatcacagagacgcttctctggtgtccagaaaaatccggctctttctagtggcgcttccaagggggaagagattggagagctctccagcaaacccaggcctgagctttgcagaggtctgagctgaggactgagtgtccaaggggctgaggatgtggactgtctttgtgaggtggggtacagccagtgaaggagccagtgttaatttcctgaagctgctgtaacacgggccacacagacttcgtgccttaaagcaacagaaatttcaggccgagtgcggtggctcatgcctgtaatcccagcactttggaaggctaaagtgggcagatcatgaggtcaggagttcaagaccattctggccaacatggtgaaaccccatctctactaaaaatacaaaaattagatgggcgtggtggcaggcacctgtaatcccagctactcaggaggctgaggcacgagaatcgcctgaaccctggaggtggaggttgcagtgagctgagatcccactgctgcactccagcctgggtgacagagtgagggagaaaaaaaaattctttttttttttttttttttttttactttgaggttcttgggtacaagtgtgcaggtttgtgacataggtaaacttgtgtcatgggggtttgttgtacagattcttttttcacccaggtattaagcccagtacccaatagttatttcttatgatcttctccctcctcccaccctccaccttctgaaaggccccagtgtgtgttgcccccctctctgtgtccatgtgttctcattgttcagctcccacttataagtgagaacatgcagtatttggttttctgttcttgtgttagtttgctaaggataatggcctccagctccatccatgtccctgcaaagaacatgatcttgttcttttttgtggctgcatagtattccatggtgtatacctaccacattttctttacccagtctatcattgatgggcatttaggttgattccatgtttttgctgttgtgaatagtgctgcagtaaacatacgtgtgcatgtgtctttattgtagaatgatttctattcctttgggtatatacccagtaagggattgccgggtccaatggtatttctgtctttaggtttttgaggaatcaccacactgtcttccacaatggctgaactaatttacaacagtgtataagtgttcctttttctccacaacctcaccaacatctgttattttcttgttcgtttgtttttgtttttgtttttgttttgagacggagtcttactctgttgtccagactggaatgcagtggtgcaatctcagctcactgcaacctctacttcctgggttcaagcaattctcctgcctcagcctcccgagtagctgggattacaggcacacactaccattcccggctaattttttttttttttttttgagacagagtctcactctgtcgcccaggctggagttcagtggcgtgatctcggctcaccgcaagctctgcctcccgggttcacgccattctcctccctcagcctcccgagtagctgggactacaggtgcctgccaccacgcctggctaattttttgtatttttagtggaaactgagtttcaccatgttagccaggatggtcttgatctcctgacctcatgatctgcccaccttggcctccaaaagtgctgggattactggtgtgagccaccacgcctggcccagcatctgtcattttttgactttaataatagccattctgactggtgtgagatgatatctcattgtggttgtgatttgcatttcactcatgatcaatgatgttgattgagtcttttttcataagattgttggctgcatgtacatctccttttgaaaagtgtctgttcatgtcctttgcccatgtttttatgagaacaagagaaatttctattctcacagttctggaggccaaaggtccaaaatcattaccactgggccaaaatcaaggtgccgacagtgccatgctccctccagaggctctcggggggaatctgttcctggcctcttctagctcctgggggctgccagcactcctgggcttgtggccgcatcactccagtcttcaaggccagcatcttccaatctctctctacttcgtcttcacttggacttctcttctatatggatgtccagtcttcctctaccctatttttaaaaaatgtttgtagagctggggtcttgctgtgttgctcaggctagtctcaaactcttagcctcaagtggtcctcctgacttgaagtgatcctgctgccttggcctcccaaagcactgagattacaggaatgagccactgtgcctggcatgacctcttcttcttcttctttttttttttttttttgagataggggtctcactgtcttgctcaggctggagggcagtgacgtgatctcagctcacagcatccttgacctcctgggctcaggggatcctcccatctcagcctcccgagtaactgggactataggcatgctccaccacacccagctaatttttttttattttttgtagagatggggtctcactatgtttcccaggctggtctcaaactcctgggctcaagcaatcctcctgccttggcccccaaagtgctgggcttacaggtatgagctaccgcgcccggccatgacctcttcttataaggatgcatgtgatggcatttagagcctacccggctaagccagaataatcccctacctcaagatccttaatcacatctgcaaagtgattttgccatataaggtaacacaggctctggggattaggacatggctgtcttttggaggtcatttttttgagcctatctcgggtctctaagggcaaactccagcagccattctagtagacaggttctcctgtgatagatgccggccaggtaaaggagacaaatggaagatcccagctgacccacctcggctctgtcccctctgaggggaccttattctcatttatgtggactccctaagccatatatctaggctggagtgcagtggtgtgatcttggctcactgcagccttgacctcctgggctcaggggatcctcccatctcagcctcccaagcagctgggactacaggcatgcaccaccacacccagctgatttttttattttttgttgagatggggtcttgccatattacccaggctggtcttgaactcctgaactcaagccgtgtccactctcccaaacagctgccccctcttggggggtacagcagcgtcagcctggtgtgccctcagggtgtatccgttatttatcttggactgcataaaccaatagcccaacattagcagtgtcaaacaacagtcatttcttcttttactcttcacattgtgagagttgtctgagctcagccagatgggtcttactcaatctctcctacaattgcagtcaaaaggttgccggtgggagttggaggctgcagtgagctacgatcgcaccacggcactccagcctgggcaacagagcaagatcccgtttctaaataaaaagttagcagggcttgaggtcattttgaagatgtttcacttgctggcccggggcctgagccgaggaacagctggggccccttgggcttctctgctgccccccggcccctccagcacggtggcctcaggatagtcgggcttcccacgtgtcagctcagagtccagggcaagggtctgagagtgagtgagtggctgggggaagtctagcgcctttggggacctggctgcagaggtcacgtgttggcgctgcccacacattctgttggttcaaagtgggtctttattcaaatcacattcaagaggagagaattagatgacaccacttgttgggagaagtattaagaacttatttatttatttttttcactttgggaggccgaggtgggaagatcctttgagcccaggagttcgagaccagcctgggcaatatagggaaactcccatttctatttaaaaaaaacaaaaaaccaaaaaacttatttatttattttttagagacagggttctcactctgtcactcaggctggagagcagtggtgtgatcacagttcactgtagcctccacttcctgggctcaagtggtcctcttgcctcagcctccccagtagctgggactacaggtatgcactaccatgcctagctaattttaaattttttttgtagagatggggggtctcactatgttacccagtctggtcttgaactcctggcctcaagcaatccttctgcctcagcctctcaaagtgctggattacaggcatgagccaccacacctggcctaagaatgtattgtcagatttaaaaccattgcaggaggatggaccagagaagagggccctggggccccagaatgggggtttatctgccagctggattccaggggtctgagtacccaggtgtctggggtgggagagtgggtgcaggctccaggtgggcgtgtcccctttgggaagggcgggacagggccctccagagcccaggcccaggctctgggctgaggctaggacagtctcagagcatttcccgctggacagccccagaatctgactgcagtctgtgccaagagcacttcggcgttctgctccactcctgccagccccaccacggacgtcacaccccatcgggctcccttgtgccttagtgcctttgcctgagctgtcccctctgtctggactgccccatccctcaccattcaccttcttcatggctcatgattcttccaaacttgcatcaacggcccctctcttcggaggcctttccaggccttgttatgtgtagcaggcccgggcacacacagatgaaagcaatcagccctgttctccaggagccagtgcatgggggctctgacacctccacatcctggaggaggagggaaggaggggctgagggagcccaaccgaggggcacaacaggaggtgttgacgagcccacaagagctaagagggagccagcagcggggaagggcatttcttaaaaagggcacagcaggtgcaaaggcctgagcgagagtgcaaggcccacccaggggcctgcagactggagtgtggggctctggagggaagacaggttcagcttgatctgtgatgtgactcctgatgggacagtgagcctttggagggtgaggtcatgccctgcgcgtctctgtgtcccagcacgactgtggctggggccagccaccttctctgtgaaggttttcactgcattcagactgtgctgggactggccccaggaggacttggactagcgtgtgtgtgagtgagtgtgcatgtgtgcacacatgtgtctgtatgtgtggacatgcatgtgagtttgcatgcatgtgtgtgcatatgtgtgtatgcatgtgtgagtgtgcatgcatatgtgagtgcattgtgtgcacaagtacgtgtatgtgtgtatgcatgtgagtggctatgcgtgcgtatgtgtatggggtgtctgcatgtgggtgtgcatgcgtgtgtgggtgtctgcatatgtgtgtatgcatgtgagtgggtatgcgtgtgtatgtgggtgtgcatgtgtgtgggggtgggggtgtgcatgggggtgtgcatgtatgtgcatgtgtgtgtgggtgcatgtgtgtgtgcatatatgtgtgtgatatatgtgggtgtgtgtgcatgtgggtgtcaatgtgtgtgcatgtgtgtatgcatttgagtgtgggtgtgcatgtgtgttcatgtgggtgtgcacgtatgtgtgtgtgtgtgtgttcatgtgggtgtgcgtgtgtgggtgtgcatgtatgtgtgggtgtgtgcgtttggggggtgtacatgtgtgggtgtgcatgtgtgtgggtgggtgtgggtgtgcatgtatgtgggtgtgcgtgtgggtgtgcatgtatgtgtgcgtgtgggtgtgtgtgtgagtgtgcatgcatgtgtgtgttgacttgctagtgctcacacttacctctggggcagagatgtgcttgttaggtgccccctccctctctccactccattccagcaaaggtcactgagtgtcctctctagtcttaggaacgacactcgacagtggacaatgagaacaaccaaacacttcctctcttcccccctccccccattttgaaaaattctattaaggccaggcatggtggcttatgcctataatcccagcaggttgggaggctgaggtgggaggattgtttgaggccaggtgttcaaggccagcctgggcaacatagcaagaccccatctctacaaaaaaatttaaaattagccaggcatggcggtgcacacctgtagtcccagctgcttggaaggctgaggtgggaagatggcttgaacccaggaatttgaggctgcagtgagctatgatcacaccactgcaatccagcctgggcaacagagtgagactctttctaaataaaataaaataaaatataaaaacagaactactatacaattcaacagttccacctctgggtatataccccaaatcattgaaaacaggtttaccaagtgatttgcatactcatgttaatagcagcattatttgcaagagcggaaacgtggagtgcagttgcacagtcacacctcactgcagccccaacctccgcaggctcaagccatcctcccgcctcagcttcccaagtagctgggactacaggtgtgcaccaccacacccagctaatttttgtattttctgtagagatggaatcttgccaggctggtctcaaactcctgagctcaagcaatcctcctgcctcagcctcccaaagtgctgggattacaggcctgagctactggacctggctggtagtcctatttttaattttttgaggaaccgccatgctgttttccacagtgcctgtaccattttgcatccctaccagcagcacacagggttccaatttccccacgttctcaccagctcttgtttttttcctgtgtgtggttttgtttgttttgtttgtttttgttttagacagagtttcactcttgttgccccgcctggagtgcaatggcatgatgtcagctcactgcaacctccgcctcctgggttcaagcaattctcctgcctcagcctcccaagtagctgggattacaggcatgtgccaccatgcccggctaatttttgtaattttagtggagatgggtttcaccatgttggtcaggctggtctcgaactcctgaccttagatgatccgcctgccttggcctcccaaagtgctgggattacaggcatgagccaccgcgccccgctttcttgtgttttttatagtaggtatcctggtgggtgtgaggtggagtttagatttgcattttgctaatctttagtgatgttggacatcttttcatctgttttatggccatttgtatatcttcttaggggaaaggtttactcaagtcatttgcctattttttaattggattattattattaatggagatgatgtctcgctctgttgcccaggctggtctcgagctcctggcctcaagttatcctctcaccttggcctcccaaagtgctgggattacaggcatgaaccactgcatccagtcttagttgttgagttttaggaggtgtctgcatatcctggatattaatcccttaccgatatactatttacaaatattttcacccattctgtggtttgcctttttattccattgattctgtccaaaacttctctttactcatagagcaaaggttgtatatctctaaaccaagcttcttcccttgcttctctctgtggaaacaacagggtattatccttccactcctgtacccagagaactcctattcactcttgaaaacccacctcaacagtcatcaactcagggaagccttatttgtcaggcccctcctcccccaaaactaagtaaataaaacatttaaataaaacataggtaacccctttccccattgtcaagctctgtgcctgcgcgagcttctctgcttgtccttctttcgtggtcctgtagttcttttttttttttttaaataagatggactctcactctttcacccaggctggagtgcagtggcaagatctcagctcactgcaacctccaactcccaggttctagcaattctcctgcctcggcctccctagtagctgggactataggcgtgtaccaccacccccagctaattttttgtatttttagtagagatggggtttcaccatgttggccaggctggtctcaaactcctgacctcaagtgatcctcccacctctgcctcccaaagtgctgggattacaggcatgagccatcgcacccagcctggtcctgtaattctctctggacacactggccctgtgagctggaggagggcaggcggagcctggcacagagcagcctcttggtaggtgttgagtgaatgagtaggggtggtgaggggaggccacggaaggcacccaggctgtgttcctcccactcccagccttgccacgacctaccaggtctccagctcctgctgagctcttgcagggtggcccctccccacttacagctcactgccttggactaggtcccagccaatggcccggcggaggtgtcctcactgttcttacccagtatgacctaggcgggagccaataagcacagggaatgagtatcaccctgagggttcaaaagtgtgcaaggaagggaggaagggaaggaaggaaggaaggaagagaagggagtgggggagggagagagagaaggaaggaaggaaagaaggaaggaaggaagggagcaatgaatgaatgcatacatcaaggaatgaatgaatgcatatacacaaaggaatgaatgcacacaccaaggaatggatgaatgaatgcacacactaaagaataaatgaatgcacacaaaggaattaatgaatgtacacaaaggaatgcatgcacacaccaaggaatgaatgaatgcacacaccaagaaatgaatgaatgaatgcacacatgaatgaatgcatacacacaaaggaattaatgcacacaccaagggatgaatgaatgcatacaccaaggaatgaatgagtgttcacaccaaggaatgagtgagtgaatgaatgcacacgaaagaaagaatgaatgtgcacaccaagtaattagtgaatgaatgaatgcacacaaaggaatgaatgagtgaatgtacacaccaaggaattagtcaatgaatgcacacacacaggaatgagtgaatgaatacacacaaaggaatgaatgtacacatcaaggaattagtgaatgaatgcacacacagaggaatgagtgaatgaacctgccacttgtggagagtgaaaaaagcctgagagatccccagatgagggagcccccatgtgtgcccctgccgttgagaggcctggacatgctggtgcatggtgtaagggcttgggcttgggctgagctggctcacaggcgacccatcaagtgtcacaaatgaccttgaaccgctgccacaaatgaccttgagcagcacgcttcccctcccgagccttagcctccccagatgtaacatggattagaagaaccacctcatggtgcttttctgaaaatttggtaggcctaacgtggtggctctcgcctgtaatcctagcactttgggagggaggccaaggtgggtggatcgcttgggctcgggagtttgagaccagcctgggaaacatagtgagaccctatctgttttgttaaaaaaaaaaaaaaagaaaaaaaatttggtggggtgatgggtgtgccagttggagagctgtgacatttgtttttttggttcaaccccaagccagtgcagacaagtgaccctccccagccagcgggccaggcctctcagtgtcaccctggctgaggttgttcgtgtatgtgtgtgtgtgtgtgtccctttctttactgtcctcattctttgcatcacgtgtgtggtcttttctgtctcatacacgcacacccgtcgcatttgcatgctctgacacacagacacacattgatgcttccttttttaaattttttatttttggaggcagggtcttgctctgtcgcccaggctggagtgcaacggcatgatcacagttctctgtagcctcgaactcctgggctcaagtgatcctcctgcctcagcctcctgagtagctgggaccacaggtgtggaccaccacacctggctaattttttttatttttgtagaggtggggtcttgctatgttgcccaggctggtacactcctgcttctttatgtatgtatgtatttattctctttttagaaaattatttcattgaatcgtcctttaagcacacacttttctgaagctctggggacacttggggagaagaggaggggagggttctagctgtcctgtagggccacattggtcctgggtgcaggacaagcccaggcaggagaaacggaccctgctgaggggtctcctctttgcctcttccctgggtcccagctgggtggtctcgcctgttcactgccgggcagggttgggcagtgcagagccgagcccaccgctgtgtcatcattccacgggggaaggggcttgaaggctgcgttgtggggtgatgggaacccggatttagttggtatgacccgagctcaggtttcagctttgcgacatccttgtggtggggtcttcaggtgggaattcctcctctgtaaaatgagagcttgtgagaattaaactggtcccggcatttgggaaacagccctgtgactccttccgtctcttccctccggagggggcggtccttgagctctactgagcccatgccagcgagagtcgtcatggccgagcccctgggccagattccaagttccatgccaccttggcacttacttttttggctccagtcctctttggctgtcccctctgtgaagggcatctaaggtggtggatgggggaggggagtttgtttgtttgtttgttttggttttttcttttttcgaaaaggagtctcactctgtcacccacactggagtgcagtggcgtgatctctgctcactgcaacctcgacctcctgggttcgagcgattctcctgtctcagccacctgagtagctgggactacaggcacctaccacagtgcctggctaatttttaaatttttagtagaggtggggtttcaccatattggccaagctggtcttgaactcttgacctcaagtgatccacccaccttagcctcccaaaatgctgggattacaggtgtgagctaccgcgcctggcctttgttgttgttttgagacagggtcttgctctgtctcccaggctgcagtacagtggcacaatcatagctcactacagcctcaaactcctggctcaagtgatcctcccgtctcagcctcccaagtagctggcgccacaggcatacacccggctaatttctgtattttttgtagagacaggattttgccatgtttcccaggctggtcttgaacttctggcctcaagccatcctcccaccttggcctcccagagtgctggaattataggcgtgagccaccatgcccggccagaaaggggagtttatttaaatgggccgagccaggagctttgtcttagccttgttcttctgtctacatgcccttttcccacctcccactaggctgcacttcactggggtaaatcggtcagaaccagctagtgggaacaacctgtaacacctgtttccagacatccaggctttgggctgcagaataggctcgcacctgttagctcactctctgctagcctcctaactggccctgagcgccaggtgcagggtgtttgggattggaaatcacagctggatttctgttagttcactgtcaccctggccccagggctggctagaaagtgggcgctctgggccggacttctatgggggtcccccagcctggaggcagccctgccttgagtcagggcagcactgattcagacgtggccacgagtgcttggctaatttttggctcagggtccgggcaggcctccagctcttggcggccggcaaatctgctgctgtctgggcaaggagtccctggcaagacggggcaggtggcaggcaggcagggaagctgagcttcttggagtctggaatagggaacatccctagaagatgacccaggccctgcacctggctgggtgtaagagtcccctgtgaacttaaaaatacagtgtccagggctgggcgcggtggctcacgcctgtaatcccagcagtctgggaggccgaggcgggcggatcacctgaggtcaggcgttcgagaccagcctgaccaacatggtgaaaccctgtctctactaataatacaaaaattagccgggtgtggtggtgcacgcttgtaatcgcagctacttgggaggctaagtcaggagaatcacttgaacctgggaggtggaggttgcaatgaactgaaatcatgccactgcactccagtctgggcaatagagtgagactccatctcaaaaaaaaaaaaatacagtgtccagggccccgctgcccagggagcggtcacctctgatgaggtagggcacaggagcccgggcactgaacagcaggtgttggcagcagctgagctaccagccgtccttgcttcacaggtgggcggagcaaaatcgggagctgggtgatgggacagatgtgacagtcgctcttctactattctcggactgtaacctgggatcttcccagtggacttccctccacccatcccagctctgccttttgggggcttcatgtctttctcattattattattactttaatatttcagcttttaggccgggctgtaatcccagcactttgggaggccaaggtgggcagatcacttgaggtcaggagttcgagaccagtctggccaacatggggaaaccccgtctctactaaaaatacaaacattagccaggcgtggtggtgggcacctgtaatcccagctacgggggaggctgaggcaggagaatcacttggacatgggaggcggaggccgcagtgagccgagatcacaccactgtactccaatctgggggacagtgagactgtctcaaaaataataataattttaacttttattttagattctcagggtacatgtgcaggtttgttacaaaggtatattgtacgatgctgagatttgggatacaagtgatctcgtcacccaggcagtgagcatagcacccaataagtcgtttttcagcccctccttttcccctctctccctgcttttggaggcctcagcgtctgtcattcccatctttatgtctgtgagtacccaacgtttagctccccttataagtgagaacatttgatatttggttttctgtttctatgttaatttgcgtaggataatgatgtccagctacttccatgttgccgcaaaggacatgattttgttcttttttatggctgcataatattccatggtgtgcatgtaccacattttctttatccattctaccgctgatggacacatgggttgattccatgtctttgctattgtgaatactgctgctctgaacagatgcgtctctcaccttattaagggaagttgactttttgaacccaaaggatggacatttgggatatttctcttccttgcgagtgtctgcgttttgggctgctgagagaggcgtctgggctcctgttcccattgctccctgcgttgcagtgtgaccaaccatcctaggtggcctaggactgaggggtttcccaggagacggaactttctgtgtaaacccaggaatgtcgagttgggcccagttggctgtgtgtcagctctgcgtgtgagcagctggtctgttccctgcatccctgtgaatgtgagaagcgtggtcttcctaccgcatggtgacagcaaggacaccagcaaggctggagacagacagccttcttccccgctgtgcactggctgaggcctggagctagtgcctttcttgtctctaagatagagtgatgctggaagaaggatagtagctcatgcgggccaatgctgccatcagaatttttacttttttttttttttttttttttaatggagtgttgctctgttgcccaggctggaatgcagtggcgccatctcggctcactgcaacctccaccgccggggttccagcgattctcctgcctcagactcccaagtagctgggattacaggcgcccgccaccacgccaggctaatttttgtatttttagtagagacggggtttcaccatgttgtccaggccggtctcaaactcctgacctcaagtgatctgcctgcttcaccctctcaaagcgctgggattacagacatgagccactgcgcctggccctgctatcagaatttttattttttatttaaaagacagggtcttgctgtgtcacccaggctggagtgcagtgttgccatcatagctcactacagcctcgagctccttgtctcaagcagtcctcccgcctcggcctcccaaagtgctgggactataagcatgaaccaccgcacccggcctctgccttcattttctgtttagaaccattcccactttacaaatgaaaaatctcgggctttcaggactcacccgaggtgctcctagcagacgtgggcctgggtctcatcttcccccgcttctcctgctgcattcttgctccaggcacgtggaacctgcctctccctccatctgaggccctttgcagggagtggctgtctctctccatgctccccaagtgcacccacctgggctgtggctcgggacagggggtcctacaagcccggatgaccgagacaaggagctggggatggcccacagcccagcccctcttccctctctgtgtccctccctcctggagtccctggttccttcctaaacggattagagcctttaccggaaggagccggccgctgtctggggcagccggggggccagggctagatggctgtctggtgcctcctgctttgccctgattcgatttgggcctcagcagctgggaggctggcagccctaaggcctttctgggaatggttcaagggacgggcttgcaggggatggcttgggggagggggacaccttccagcccccaggcaggcagacctctcagctggatcttttatgaagtctggtcgcatgcaagaccctcaagcgggcttcctgccacggaacatccccagccgtggccactggccacctcgtggttcatcagcgggtgtcatccaaggcctgtgtcccatccatggcctgtcatcccctccgcatcccttaatacagcagatttcaaacttctataaaattgcaacccagaagaagaaatgtcttttataaacatttagcagcaaactcaacatacattttggccaaacgcccaccggccagttgtttaaatcaatatttatccacagccaaaaagcagaggagagccagaactgaggccagagccgagctctgatgcatctctcatttctcgggatgtttctgtccctgtggttggacacctctggccttgtgaagtgtgatgcactgtcacatctcctgttctgtgtcattggccaatgatcatatatcatgacctgctggaaggcctgtctgtggctgggaccacacgccttgggccttatgcacactgggcactggtcgggatcctggggtgcaacagtggcaggcagacctggtttctgccctcaaagagcttacagatggcaggggcacccatggcggcagaagacaccccaggcctggtgccctttgtggtgccagccccatggtcctcctgcctgggccttccctaccccattgggtgcagaaactccctgtctgcaggtaggagacagagggtaggttttcaggctcccttgggaactgcagccctgctctctgccatcaacacccagcaggggccacacagagagcaccgggactgagcccatagaggggaaccgagaggcccctgcctctagtctctgccttctttgcttggattggtgcagggacagctgccttgagggcaggccctggcactggggcagcctgtgggtgccccctgggtcaagaaggagaggggcagggtagaaccaggagccaaaggaggctgatctttgcatctcatgggtgcccagctggacactgtcatacccaggaagcctgtgccatgccatggggacccacaactgggggccctggacttgagggggaggatgcagctctgtcccccaggaaccccattgcaacaggacacagtcctgccctggggagcccctgacctgagacaaagcagcctcggccctgctgtatctttccatacccctgatgccaagtctcctggctaggagggaaactgaggctggaaggcctcggcgggggtggcattggcctcgggagcatgtggcttgatgcagaaatgtgacggcagagctcagaggcatgcggaagggaggggaggacatcaccggctcctgacccagctgggcttcaggttgggggtacaggaggtgggcaagcaggttggacaattaaaagcttcgatgaggctgggtgagtggcttatgcctgtatttccaacactttgggaggctgaggtgggcagatcacctgaggccaggagttcaagaccagcctggccaacatggtgaaaccccatctctactaaaaatacaaaaattagccagacgtgtggtggcacctgtaatcccagctacccgggaggctgaggcaggagaatcactcgaacccaggaaggggaggttgcagtgagccaagattgcaccactgcactatagcctgggcaacagagtgagactctgtctcgaaataaaattaaatttaaaatttaaaaaagcttcaaggacaaccagcagatgatggcaggaccaggaagggtgcttcaggcagcgggaactgaacctgcacagactagggaagcatgaacatcggtacatctgggagtggcacagcttagagggcctggagcatggagtgtgagggggaactggagtgagggacaggagaccaggtaactagaataccaggctgaggagttgagagctaatatgggcagtagggagccatggagggtgtgtgagcgagggagggctgtggccagaattgcacacgccgggagaggtggcagttggggcctgtccaacagactggtcctggtgctgggctcagcttgggtgtgcagacttaggagggtgtgccacaaggtgtgagttatcctgccacctgtgcccaggcctgtgcaggctctaatcccatcacacataaagcccttgggcccagggaaggtcagccctggatacagaggcggtcttgggagtccgggggtcaggtggattggggtgggcagccaccatatgagacaagccccctgccttgtgcccaccaccactgcctcctccctccccacaggcgaccatggccttgctgggtaagcgctgtgacgtccccaccaacggctgcggacccgaccgctggaactccgcgttcacccgcaaagacgagatcatcaccagcctcgtgtctgccttagactccatggtgagtgtccccacccacccaagaggaggggacagggtgagcgtccccacctgccttgtagctcaagtcctacctcagctactcgaaggagctttcactgacctgaacctcagtttatctgactgcagctagggccacgatgcctgcatcaagggtgtgagatgtgagacttcagcgagatccagtacataaaaatctagccctggggccgggcacagtggctcatgcctgtaatcctagcactttgggaggccggggtcggtggatcactaggtcagtggttcgagactagcctggccaacatggtgaaaccccatctctactaaagatacaaaaaattagctgggcgtggtggcatgcgcctgtaatcccagctacttgggaggctgaggcaggagaattgcttgaacctgggaggtggaggttgcagtgagccgaggtcgtgccattgtactccagcctgggtgacagggcaagactccgtcttaaaaaaaaaaaaaaaaaaatctagccctggaataaacactggctctccgccctcgtccccttgtcccttcacccctcttgccattcccactttgtccctgggatgaaccacatgcctatctcctagcaggtgacctgggggataatgtgtggggagccattcactagaaagatgtaatccccaacgttaaagcaagagttctaactgcatctcgggcaggaagagagaaaccgagctttgtataatacatcactcccctggcgctattgcctacatacctagacctataacaatttatcccaaatgaggacatcataataccattttcctctagccttttcctggggggaagttctgtgatggaagtgttaaaaaaaaaaatctggcccagcacggtggctcacgcaagtaatcccagcacttttaggggccgaggcgggtggatcatttggggtcaggagttcgagaccagcctggccaacatggcaaaatcccatctctagtaaaaatataaaaattagctgggcctggtggcacatgcctgtaatcccagctactcgggaggctgaggcaggagaatcacttgaaccctggaagtggaggttgcagtgagaagagatagcaccactgcactcccgcctgggcaacagagggggactccgtctcaaaaaaaaataaataaaaataaaaaaattagactggcatggtggcacattcctgtaatcctgcctactcaggagggatgaggcaggagaattgcttgaacctgggaggcagaggttgcagcgaaccgagatcgtgccactgcacttcagcctgggcaacagaggagactctctcaattaaaaaaatttttttaaataaaaataaaattaaaaatctgtctaacatcagttagctgcgctcctgcattttaggatgatgaagcacagagagggtagtaccttgcccaaagtcacacagcatgaccagttttgttttgttttgttttgttttgtttttgagacggagtttcgctctgtcgccaggctggagtgcagtggtgtgatctcgactcactgcaacctccgcctcccaggttcaagcaattctcctgcctcagcctccccagtagctgggactacaggcccccaccaccacacgtggccagataatttttgtacttttagtagagaccgggtttcaccatgttggccaggatggtcacaatctcttgacctcgtgatccgcccacctcagcctctcaaagtgctgggattacaggcgtgagccactgcgcctggcccagcaagaccagtttttagagcgaacttctgggtacaaagtctccccgaaaaataaaggacctccttcaagctgttcctgctgtaggtggctcaagggctgcttaagtggtgtttggggcagcggtgggagacacccctggaaaaggggctgggtgccacactctctccatgatgacccctcccctatgcagagtgactttcatgaggagggggccccaggagctcagccctgtgtcccaaagtactgtgagcttggcattgatggaggtgtggctgatgtgggcagtgatgggcgatgccatggccactagtgacatgtggctatttgcaatttttttttttttttttggagatagggttttgctctgtcacccaggctggagtgcaatggcgcgatcttggctcactgcaacctccgcctcctgggctcaagtgattctcctgcctcagcctctggagtagctgggattacaggtgtgcgccaccacacctggctaatttttttgtatttttagtagagacggggtttcaccatgttggccaggctggtctcaaactcctgacctcaggtgatccacctgcctcagcctcccaaagtgctgggattacaggtgtgagccactgcccctgattcatttaaattcgaattcgttaaaacgaaataaacaactcagttgttcagttgcaccagcctcattttacgtgctcagtagtcagaagtggctggtgtctatggattggacagtgcagaggtagaatgttttcatagtcatagaaagttacactgggttggccaggcgcaatggctcacgcatataatcccagcaccctgagaggctgagtggggcagatcacttgaggccaggagtttgagaccagcctggccaacatggtgaaactccatctctactgaaaatacaaaaattagccaggcatggtgatgcatgcctgtggtcctagctattcgggaggccgaggcaggagaatcgcctgagcctgggaggcagaggttacagtgagccgaggtcgtgccactgcactccagcctaggtgacagagcaagactttgtctcaaaaaaaaaaaaaaaaagttctacttggcagcagtggtctagtgagtgtttcagagcctccttggaggagcacatgaccctatagttatcctagcagtgcgaacaagacaggctcccccgtccctgggccttttaagggtttcctgagggaccctatgggtgacaatgatatttgcttagcagtaacttaagtccagcctcctccaaatgctagggtcttttggtgacctgtagggagggtgggctgaagggatgtgccttcgtcacccgcccccaatctcatcctcttccccaccagctctgggtgcctttaggtgggtgagttttctgccatggtctcggcgtcttcagctgagcggtgactgtgggatgaagcagctctttcagctgtgatggatgagaaacagctggatttatttgttttattttttgttaatagtctacagtgttcccgcgcagaaagggaacagcaagcttttgttttcatcttagaagaaaatgaatgccctgtgttttaattttccagtagggaccctggaggacaggcttcctggccccacgccgcgtgcaccttcctaaccagagcgactccaggctggggctggcacaataggcaagattatggcccagagaggttacctgtcccaggccacgcagcacagaactgcgtttggaagccagactttatagctgccagcactacctgactcagatgaaaaccagcatttattagacacaactgcctgccacaggcttcacagtcagggttttcctggtggggtaggtcagagacctgagatgctggtggtcttggttgtagggaccccctacattaaggcctctgggctatggggctgcagacctcgactctggggccatgaggatagccagctgcctgtatacccatatagggtgtcccagtttagagatctttttcctccaaccattgaatccccatacccaagcccagtggcactgtggaactgggctgcttgtccccaattctatagacgtggaaactggccacgcagagtggctcacgcctgtaatcccagcactttgggaggctgagacgggcagatcacctgaggtcaggagtttgagaccagcctggccaacatggtgaaaccccatctctacttataatacaaaaattagcaaggcgtggtggcgggcgcctgtagtcccagctactcgggaggctgaggcaggagaatcgcttgaacctgggaggcagaggttgcagtgaaccaagattgtgccactgcactccagcctgggcgacagagtgagactgtgtctcaaaaaacaaaacaaaacagatgtggaaactggagcccagaggagggacgtgacttgctcaagtcccacagcagaagtggccgaggtgggattgcagccccagtctgtccagtccccgcctgtcctgcagttcttcccacctcctcctcatccaggacttgagaggggccaagaaaacccagcacggcattgtccctggggctggggctaaggggggcctaccccaaggaggaggaccttggagggaggagcagaggacacttgtcctcctccaccccccatcgccaatgcctgcagggccatttcattcagtcccactacagaatctgagaccaagaacagtagaggggccgtctgtccctggagctgctgctggggtctcaggcagctgggagctcacatcccacccccgaagtggatactagaggtgttcggagtatggggagcccttccgctcacacagcctgcccttcccacagtgctcagcgctgtccaaactgaacgccgaggtggcctgtgtcgccgtgcacgatgagagcgcctttgtggtgggcacagagaaggggagaatgttcctgaatgcccggaaggagctacagtcagacttcctcaggttctgccgtgagtaccccagggctccggagggccgggcccgccatttcccgagggcaggcgctctagcccatctctgggtccccaaccctgtctagccagggtggcggtgtgtggggagtgaacctaacaagctaggttgtctgagattcccgatgtggtgttattgaggcagcccctgagttgatagagactggctgggtgaaccccagggtaggccagagccagccacttccatctgccttttccagatggggacaccaaggccaaggctgctgctcagttcttcctcttaactatgtattcctgaacacaaggaccaaatgcacttatgccaacacaattttttttttctttaaatgagacagagtcttgccctgtcacccaggctggagtgcagtggcacaattttggctcactgcaacctctgcctcccaggttcaagtgattctcctgcctcagcttcccgagcagctgggattacaggcacctaccaccacgcccaactaattttgtatttttagtagagacggggtttcaccttgttggccaggctggtctcgaactcctgacctcaggtgacccgcccacctcagcctcccaaagtgctgggattacagatgtgagccgccatgcctggccatgttccaataagatttattgaatgcctgctgtacatagcatcttttctgatgctaactcacctaccctgacatcaacctgagggggcaggcactgtcatggctatagtcagggttaacatcttaggccaggtgcagtggctcatgtctgtagtcctagcacttcgggaggctgaaatgggaggatcacttgagcccaggagttggagaccaggctgggcaacatagcaaggcctctgtctctacaaaaaatttaaaaattaaccaggcttgatggtgtacacctgtagtcccagctgcttgagaggctgaggcaggaggatcacttgagcctgggagttcaagactacagtgagctacgatggcacccctgcactccagcctgggtgacagtgagtccccatctcaaaagaaccatggtatagcatgaggttaagagaacgggccgcctgggtccacaactgctgtgcctcaacccactcatctgtgaaaggggaggacgggtgggtctgagggttaaacgaattggtaccttgcaagcacttagggcagtgtctggcacttggttcacactcagtagacaccagctgttgttactattattagtattcacctcacacccctaagatcagctgtttcagggaagggcatcccccagcgctgggcctagcattactggggtgcagccgcatccccagccagccccccacccccctcagccctcagagcctagaccttctccagggccaggatgggggactgggccgggtagaatggacagcagcaggtcgtgtggcaccccagccgcccagagcctgaggcggtgcacctgccttctagagccacgcagagccgctatttatagcaccaggaactcggctggtttatttcaagctccgcagatcccagaggagaataggctccaagctgggagggggccgcaggcccctcctctcatctcctttccaatgcagcttctagaacattccccaaggatccaccaacactctccggtccccaccctggcccagcctggcatgaacctgctgtttgcaacccacggcctccttggagcaggggttggggggtgcctcccaaccctctgccggagggttttctctccctccggcagagcagaaaacggtggcatagattggtcaagacagtgttcgtgtcagagcacagaaaggcatggatggggccgggcatggtagctcacacctgtaatcccagcactttggtcaggagttcgagaccagcctggccaacatggtgagaccccatctctactaaaaatacaaaaattagctgggtaaggtggcaggcgcctataatcccagctactcgggaggctgaggcaggagaatcacttgaaccctggaggtggaggttgtagtgagccaagcttgtgccactgcactccagcctgggcaacagagcgagactctgtctcaaaaaaaaaaaaaaaaaaaaaaatagaaagacacagatggaacattcatcgaacctcagttctgagctggaatagctggcctcccgtgaacattcacagactgaggctcagagagagaagggactaacccaaggtcacacagcaaattagaggtgaccagaggtgaggcccagccctgggaactctgagatgaccagccctggccctcagtggggtggttggaatagggcttgctcactcattaattcttcattcattcattcacttgtgtatcacattgtgtgccagtctccgcagctcagcacagggcagcgacatcccagctcgaaggccgggtggtgagacgggtgctcactgtggcctcgcgtgctctgtgtcccacaggagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagtaagatccttcctcattccatttgggggccccagggagggtgggagcctcggtccccacccagcagagggggccccctcctgtcccactatgggccctgggcaaagccggaccccaaggcatggggctactggctaccccagcccttcctcatctctgcattcccagacacagaagttctgctccagccgttttccaaacctccacccctactgtccctgccctggctcaagtcactgccacctctcgcctagaaatagccccaggcttgccacggtctccctgcttccagaccagctctctacacctgccctgcaaccaagggtatcttctcaaagcacaagtctgatcattaatgaagctcttctctccacagccttcgggggctccccatcaccctgagcatggcacaggggcccacacacccatcctcatcccctccacaccttcttctcccactaggtgacagggccctactgacctctctacagaaccacttccagttctccagcactcgctggtgcatttcacatgccctggacttcgcgctgttacatcttttgagactgcctttcccctcctgtgtctggcagacacctgcgtggcactgaggctctgctcctggaagccccctcacagtgggtttaggcccctctcttggcacccacagtgccctgtcccctctccagcccaagagctctccagagtcaggggctgtgtctgccctttctagctgtctccagcctacagttcagagcccagcaacagcaggtgcttggagaatgtttgttgaatgactaagtgaaggctgattgctcagccatgtctttcctgcaggaagaggagacctggcctcccttgggaagcgtcaggttgcagagggcctcagggccccagtggtggtcttcacacgccctgggaaacatcgggcaggtccctttggtgctcagggtcccacctcattcatttctgatttggctttatcccttctcctactgtagcctttggttttatggagcaaaggtctgtgaggaaacttctgctgttcttatgtcagaaggaggggtacccagaggccctgggtggtcacactggccaccctgggatgggggacttgccacgcatggttggctgtgcctctgtcgacacttttgccagctgcagggccccgcgcccctgcccgccttgccctggccccccttgtccactttgggcagaattcaaggaggctatgagaggatgggcctctttctggctcagggtgggggctgtagcatggaggtgacaacagatatcccagtgcccagtcctcagtccccagcctgcctcccctcctctgtgcccccgagcccccatctttgttcctgcgtcttctcagtctgtctctttctcctctctcctgtctttgttgttgttgttgttgttgttgttgttgttgttgttttgagatgaagtttcactctgttgcccaggctggagtgcaatggcatgatctcggctcattacaacctccccctcctgggttcaagcaattctcctgcctcagcctcctgagtagctgggattacaggcacctgccaccacacctggataatttttatatttttagtagagacggggtttcaccatgttggccaggctggtctcaaactcctgacctcaagtgatccacctgcctcggtaatcccaaagtgctgggattacaggcgtgagccaccacgcccagcctctcccatctttttctcaatcccctatttttgctccctctccacttcctcttcttcttactttctctcccccctctcggtctctctcccttcctccctacacctttttttttttttttttttttttgagatggattctcgttctgttacccaggctggagtgcagcggctcactgcaacccacctcccgggttcaagcgattctcctgcctcagcctcccaagtagctgggattacaggcatgcaccaccacacccagctaatttttgtatttttagtagagacggggtttcatcatgttggccaggctggtctcgaactcctggcctcaagtgatcctccctcctcagcctcccaaaatgctgggatgacaggcgtgagccaccacgcccagcccttatagctttttccttgcagcctggctcatgcaagtccccacttctccgtctcttctgccctcttttctcctaccggattgtctgcctctgctctgtcctctgggcccttgagtccccgatttcccctccagccaggtgcccagagtggagaggggcttggtcggggagggcagcagggaacctgcttggtgggggagccccagccccccagatgcagacaattgggccttgtccacaccacccacccccagcctgcaggcggttattctgcacaaagtctgcagttatgaggggtccatgggaaccccgcaccaaggggagccactcagcactgcccccactctggggcacagcagccccgaccccagcctggctgccctctcataccaggcccctctcctggactctcccctacaggcgaggccctgggaagggccagtgtggtgccactgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggtgagtgaggtagccggcccggggctgggctggggctgggccagggccgggtcagggccgggggctggaggccacttagccagaggggaagggacttgagatgcccgtgggggaccctggtggtgaaagctcccagtctgatggtggaggtgaagtgaaagcgaagtcatagaacaggatctgagccaggtcattaagccttgaagtcttcccagggaagttgcattgcagagagacttgaagagacatgacttgggacaaaatagcaccaaagtggtcgggtacagtagctcatgcctgtaatctcagcactttgggaggctgaggtgggaggatcacttgaggccaggagttcaagaccagcctgggcaacataccaagaccctgtctctgccaaaaaataaaaataaaaaaaattacccaggtgtggtggtgcacacctgtcatctcagctgttcaggaggctgaggcaggaggcttgcttgagcccaggagtttgaggatgcagtgagctgtgattgcgtcactgcactccagcatgggcaacagagcaagaccccatctcttaaaaaaaaaatatggcattttaggtgtcagaaacgggagaaccatgtcctgtgcttgctcaggttgtaaatctggggttaattagggatccaggggagattaggttgttgaggctggtctgaggcagtaccagttgtcaggagagccaagaaggcagcctgagggcttaaggttgaacccatctctgctaagtgccccaggcaatgcagaggcaggaaggggaggggtgcagcaggagacaggaggcaatcaaccgcacctggcgggatctgaacagtggattggagcagaggggcagggcccaggtcctccggtggcctagctctgtggccctgggcacaccattcccacctccgagcctgcatccccacttgtgaagtggaagagcagctcctgtcctgccctcctcatggggctgttatgttctgcagagggcagggatgcggggttttcgggggaagagctgcaatgtgtgaaacagatgtacaaagctgtccatgtgtcctctcctttactcaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggtaacattgctgctgggatctccaagtctagggggtgggacagaggtcactcatgcaggggacagcctcccagggcaggtcaggatgcctgggccctcttaggttggaaggagccatgtctgggcatgggagtgggactggacagatggtgtcctggctgagacccccttggaccttgggtctctgctcagccatctgtgaatgatgtccttggccttggactaagaggacgcctgcgaggactccctgggtcccagctactcgggaggctgaggcaggaggatcacctgagcccaggagtttgaggctgcattgagctatgattgcacacctctgcactccagcctgggtgacagcacagctctgtctcaaaaaaaaaaaaaaaaaaaaaaaaaaaaaagcaccagcgatatttcaggtgtcaaaggtgggagatccacatcacgtgctataaaggaagtaagcatactagtcatcctcatgcattccatgaggacccattccaactgaatgagcacccactgcatacccagcctgattaagggcactgggggaagtaggtcctggaagtaggtcctggggtgaacaggacaaaaggaacaactgcaggtgaggagcacctggattcatatcctggctcctctacttagtggctaggcatcctggggcaaatctctactctctgagcctcagtttcttcctctataaaatggggatgctagtggtacctgcttcccagaagtgttatcatgattaaatgacagatcggtggcagtagcatctcctgagagagggttagaaatgcatattctcaggcaccactgcagtcttgctgaatctgaagctttggggatgggacccggtagtctttttggataactctgccaagtggttccaatgtgctcaagtttgagagttgctgaattaaagcgctgggtcttgccaggcatacctgtaattccagctctttgggaggctgaggtggaaggattgcttgagcccaggagttcgagaccagcctgggtaacatagcaagatcctatctctaccaaaaaaaaaaaaaaaaaaaaagcgtttgggtctaatgcttggcctgtagtaggtgcttgtaagttatatatactattattattattattattattattattattattattattattattataagggggaaaaaagcccaaatatgtgggctgaccagggcttcgaacttatacatgtaaaacaagtgttcttacctggaaaaggtaacctccgacatccctttcttgttaacctggctttcggctagcagattctggtgcagaatgtcttagacctctggtcaggggccttgccttgagtttgtgatcacaggaatcagttattggatgtccctggcagatgaggctgttaccccagagccagggcctgtgcactggggccagatctggggaaccctcttgggtcccacctggaaccttcttccttctctcccttgtccaggacagaagcccactgggcctggtgggcctctcatccagaacgtccatgcctccaagcgcattctcttctccatcgtccatgacaagtcaggtaggacagcgcccacgaagcaccccggcctgagtgggaatctgaggttggaggtggtgcttattgaaatggaagtgtatctcctgggtctttgtgaaagaaaggaggaacagctctgctcaaggggctgcaagtaaactggggtgtaatagttatctattgctgtgtgataaactaccccaaactaggcatggtgtctcatgcctgtaatcccagcactttgggaggctgaggcaggagggttgcttgaaaccaggagtttgagaccagcctgggcaatgtagcgaaatgctgtctctacaaaaaataagaaaaattagtggatgtggtggtgcctacccgtagtcccagctacttgggagactgtggtgggaggatcacttgagcccaggagttggaggctgcagtgagctgtgatcgcaccactgcactccagcccgggcaacagttagaccctatctctaaaaaaagttgtaacaaaaaataaaataaataaccccaaaatggagcttaaaacatcaagtgtttattacctcacagtttctgggggttgggaattcgggactggccgagttgggcagtgctcggtcagggtctttcatgaggatgcagtcaaaatgttggctggggctgctgtcatccaagagctcaactggggcgggaggagacgcttctgagctcattcacacggctgttcgtaggaggcctcagtcccccaccatgtgggctagccttgacggggctgcttgagcatcctcacaacatggccactggtttcctccagagttattgatccaaaagagaggaacgaggaagccacgtggcttttatgacccatccttagaaattgctgtcatattctatctgttagaagccagaaacatgatccagccttccctctgtgggagaggaattaaactccaccttttaaaggcagtgatatatttaaaaaaaaaaaaaagtggacagatttttaaagtatcacacagaaggcctgagtgtaggaaagtttgggattcagttataccaagaaggaatgcagtaggacttgccagcagttttgctttgagggcctcagcctcacctccaggaaaaggttctgtaagaaaacccagtcctaggccaggtgcggtgactcacacctgtaatcccagtgctttgggaggctaaggtgggaggatggcttgaggccagaagttctagaccagcctgggcaacttagtgagaccccatctctacaaaattttaagaaagaaagaaaacccagtcccctgggatcagaatggaggaccctcccccccaacaacaacccaacctgtcactgccccaaacaaggtccagccctggcagggaggagatgtgaatgtccagatggaacagtatcatgacaggcccatgggccagggacacaagctgggatagaatctcactgggttatcacaagcaagatactcagtttctttgagcctcagttttcctatctgcaaaatgggactaatatctctgtttaaaacttgtcataaggaattaaataggatattattatatatataaagtacttagcacagataagcacttaacaagttaaagttgttacttttactgattataaatgaaccaatgatcacttgttattattcaatcaagacagaggttttgagagagagaccagcagagctgagagtttgggggaagccaacaaggccagtgctgagtgagacctcagatgtaggaggtacaagggttagattctcaagatcaagactcagcccttagccagacatggtggtaggcacctgtagtcgcagccactcaggaggctgaaatgggaggatcgtttgagtccaagagttggaggctgctgtgagctatgatcacaccacagcactccagcctgggcaacagagtgagaccctgtctgtaaaaaagaaaaaaggaaaaaacacagccaggagtgttggctcatacctgtcatcccagctgcctggggggccgaggcagagggatcacgtgagcccaggagttcaaggctacagtgagctatgattgcaccactgcagtccagcctgggcaacagagtgagaccctgtctctatttttttaaaaaaatttaaattaaaaaataaaatactcgacctcaggccggacttggtggctcacacctgtaatcccagcactttgggaggccaaggcgggtggatcacctgaggtcaggagttcgacaccagcctggccaacatggtgaaaccccatctctactaaaaatacaaaaataagccaggtgtggtggcaggtgccctgtaatcccagctacttgggaggctgaggcaggagaatcgcttgaacctgggaggcagaggttgcagtgagctgagaccacgccactgcactccagcctgggtgacagagtgagtcaccatctaaaggaaaaaaaaaaacataagactcgacctctttttctgctgaagggactgctcttccagcctcctgtatgtctggggcaggatgggctcgggatggacaggctgagcctgttctgacaccacacccgtgggagaggccagagacaaatgttagggcaggaacgggcagacgggggaccatcagagcaccctgaattcgtgtatggtccgaggtgggagagggtggaaggactgggggctggggccggcctcgggggctctgggggtgaaagcccggtggtcatggccggtggagggcgtgtgaccgtcccgtggggccctgctcacttgtgcctcctgtgttttgatagagaagtgggacgccttcataaaggaaaccgaggacatcaacacgctccgggagtgtgtgcagatcctgtttaacagcagatatggtgagtgggcggcgcggcccgccgtgtggccccagcagccgtgttgagcatctcattacgtggcaatcactcgtgttccccaacacggcagcgggagccatatgctggctcccgcgcgccggcaccgctaatgtcatccgtcgcgggctcctcctgtctgggtagggggtggttgtgtcaatatttcccttccagattcttcagggggcggaactgatggcaaagccccagacctgggctcagtggcggggagcgggacaggttgggggcagagattacccatctgggggccgggcgcagtggctcatgcctgtcatcccagcactttgggaggccacggtgggaggatcacctgaggccgggagttcaagaccagcctgaccaacacagtgagacctcccatctctacaaaaacaaattttttaactaggctgggtgcagtggctcatgcctgtaatcccagcactttgggaggcagaggcaggcggatcacctgaggtcaggagttcaaggccagcctggccaacatgccagaaccctgtctctactaaaaatacaaaaattaactgggtgtggtaatacacgcctgtaatcccagttactcagatcctgaggcaccagaatcactggaacctaggaggtgcaggttgcagtgagtcgagatcgtggcattgcacttcagcctggtgacacagtgagactctgtctcaaaaaatataaataaatacaaattaaaaattaaaaaattaaccacacacctgtggtcttagctacttgcaggctgaggtgggaggattgcttgagtccagaaggttgaggctacagtgagctacgattgtacccctgcactccagcctgggtgacagagcgagaccctatctctacaaaaaaacaaacaaaacagattgcccatcaggggaactatccataaggcccagaaaaatctctgttggcctcatgtgcaagtcccccacagtaacacaccatttcccacctcccagctttacctgtgctgtgccctctgtctggcacagtcttttcacattttagggacaaattcctaattgttctttgagactcgtcttgggagtcacctcctctaggaagcctttgggtccccagcctgggccaggtaggcctgggtaccctgatggttccctctctgtgacacattgggaacttgacgccccctgcctgccgctgtctccctgagggccaggactgcacccaacccctctctttgtccctagcacccaggacagagtcaggctcatagcagatgtcagcccaccgcactctggaaagaaaacacaagtggtaggcgctgtggctcatgcctgtcatcccagcactttgggaggccgaggcaggtgaatcacttgagctcgagagttcgagaccagcctggccaacatggtgaaaccccgtctctacaaaaatacaaaaattaactgggcgtggcatggtggcatgcacctgtaatcttagctactttgggaggctgaggcagaagaatcacttgaacccgggaggcagaggttgcagtgggccgagatcacgccactgcactccagcctgggtgacagagtgagactttctctcaaaaaaagaaaagaaaatcattaaggaaagaatttaaaaagaaaaaaaaaagaagggaggataattccaaggaagaaacagtctcaataggctgggaagtcaggggtggcttcatggacgaggtgtcttgtgaccacgtctggggcagcctctgcgtgtgggctggaccttccacattgacatggggctgaacaagactctggaggccttagtgaggagcctgggatagccagctacctttgatgtggccaccctggcccagccacgcctcctcactcctcagagctgcaaagggctgtctgcacctgcccctgagtctctccccgccccaggcaggtgtgagccaggcggaggttgggggaggggaaccagggaggagccggctctgcctgccttgggagggttctgcccaggccagtgttctggcctgtcccacgctctggactttccaaaatgccaagccttttccaaatgtcagttcctgagtcacatccaaagagtgttgggtgtggagtggtcaagatcttgttccccataaagccggagctccctctggggagctgcgtgggggagaaggcagctgcccagtactggggaccccacgggtggtggggacggggtctggcagcccaaggcattccactggtcgtgggtgagcaaaccctgctcccagctctaccagccaccaaatctgggtgaattgggccagtgacagtgtgggtggtacaaaggaggaagaaacagaaaaattagaattgggggaaacattaggcttcaggaagtctcgaggacatgtcctctgggatgatgctgggaccaggtgaggggccgaggagggtgcatggtggcactgcatgaaggcagccccttcccaaggggcaacagcagggttcgggggttggccctctgtccactgaatctccccagtgctgaaaagacaagccccaataaaccagatgaaccagacggagacaaattcacaggcactcaaaggaccaattgctcaagggctggggctgggggtggctgctgatgtgggaggtgggggggaagtggggagagatgctttgccagctgttgagatttcgaaggtttcatttgacaacgagctaagtgtgacatctcagtgggatctggatgccaaagccgccaacgcagacctgggccgctgcatcaacaggaaaacagtgtcagaggcacccaagggagggcccaagcagggctggagggaggtccagctctgggctggcacttacaggaacacagacaaagcatagtgtggccagagaagcagggctaggacagggaggggcctgaggaacagccaggagatatgggagcctggagggaggacagtgtatcgaggccccgtccatggtcatacggggaggcaagagtgaagtggatactcaggtcaggggaagggtgacccatgaaagtacttgcttaaggccaggagcggtggctcatgcctgtaatcttagcactttgggaagctgaggcaagaggatcacttgagcccaggagttcaagatcagtctgggcaacatagcaagaccccgtctcttcaaaaaataaaaaagtaaatagctgggcatggtaacacatgcctgtagtcctagctactcaaaaggctgaggtaggaggatgactttagccagaagtcgaggctgcagtgagcaatgattatgccactgcacttcagcctgggctgttagcaagaccctgtctctgaaaaagaaagaaagaaagtaccagcttgtattaggaacatagtaggtgcttaaaaagtatttggtgtggggccggggactgtggttcactcctttaatcccagcactttgggaggccaaggcaggcggatcacctgaggtcaggagttcaaaaccagcctggccaacatggtgaaaccctgactctactaaaaatacaaaaattagctgggcgtggtggcacacgcctgtaatcccagctactcgggaggctgaggcaggagaattgcttgaacccagtcagggagtttgcagtgagccaagattgtgccgctgcactccagcctgggcaacagagcaagactccatcagggaaaaaaaaaaagtatttgatgaatgaattaatgaaaacgtgtagctggggtcgaagtgaatgactgaaatggcacaagtctgggaaaacagagcaagtagcctgggcatgagcctggattctgtctgcttggctgttggcagagccgtcagcttctggggtgtgttttgtttatggcgctggtgaatgaagggcgtgccaagctcctccctggaagaaggcacacacctgtgctcacctgtgcaactactcgcctgccaggagctaatctcaagcttgggcacttcctttagccatttgtatattcactatgcagaaagcacttagtgtgtgcccagccccattgaggtcgcagtggcaaggcagaaaacaaaacccctactctttttcagacagtctcgctctgtcacccaggctggagtgtagtggtgcaatcacagctcactgcatcttcgaactcctggactcaagcgatcctccagcatcagcctgccaagtagctgggactacaggcccaagcccggctaattttttgtatttttatagagatggcttcttactgtgttgcccaggctggtcttgaactcctgggctcaagcatttcccaacaactgtagccttccaaagtgctgggatgacaggcatgagccactgcacctggccaaaacccctgttcttatgcagcttcctttctagacagtacacatagagatgagtgtggatgtagtgtcaggtgatgaccagtggatgacagacacagcaggggagggaatgagggatggaggaggctgtgttaggctgccaaagtgctatttgagcaaacacctgaaaggagggagggagggagggagggaaggaaagatgggtggatggatggatggatggatggatggatggatggatggatggatggatgaatggatggatgggcagatggatatacagccgggtgggtgggtgggtggatggatggatggatggatggatggatggatggatggatgaaaggatggatggatgaatgggcagatggatggatggatggatggatggatggatggatggatggatggatggatggacggacaaccgggtggatgggtggatggatggatggatggatggatggatggatggatggatggatagacggatggatggatggatggatagacggactgatggatggatgtttatggatttctaggagaaagggatctgagcagacagaagagcaggtacaaaggcattgaaccgagtgtatgctcctggcctgtaggggaagcaccaagggggcggcaggggtagggggagcacacagaggcatgaagggggcagatgaggccagaggtgatgaagtcacatacgtaggactttggctgtcaccaaatgagatgggagccactggacattttttatttttattttttgagacagggtctcactctgttgcccaggctggagtgcagtggcatgatcttggctcactgcagcttcgaactcctaggctcaagtgattctcccacctcagcctcccgagtagctgggaccacaggcgtgcaccaccacacctagctttttgtattttactttctgcagagatggggtcttgctgtgttgtccaggctggtcttgaactcctgggctcaagccatctgtccacctcagcctcccggagtgctggaattacaggcatgagtcaccgcacccagcccagccaatttcctaacagaaaagtgatatgattttgacatttctgcaggatccctctggccgctacatggccagagtggagtggggacggtgggaggtgatggggaccgcagctcccgggtcctgtgtgtccagcagcctgtctaacactcagccttgctgtttggttgtctttccagcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggtgcgggtggggctgggcgcagtggctcatgcctgtaatcccagcactttgggaggccaaggcaggcagatcgcttgaggccaggagttcgagaccagcctggtcaacatggcaaaaccccgtctctattaacaatacaaaaattagccaggtgtggtggtgggtgcctgtaatcccagctacttgggacgctgaggcaggagaatctcttgaacccgggaggcagaggttgcaatgagccaagatcatgccactgcactccagcctgggtgacaaagtgagactctgtctcaaaaaagagaggtgcgggtgggcgtaggggtctggccttctgctccgggcttggcttgggctccgggttttggggcatgtgggctaagcaggggcctggggaggcaatgatggggcaggggcagaatgaatgggttctctaacttaacacagagaataagacgagtctgagagagaattctgttatagctccttgtgtagctgtgtggcctattccttctgggccttttgaggattgaatggaaaatgcaggcacggtgtctggcctaatcaggcactttgtaatttttttttttttttttttttgaatagagatgggatcttgctatattgcccaggcctgcatagcctgagtgtcagagcaaggccctgtttcttaaaaaaaaaaaaaaaaaaaaaaaggcggcaggggtggggggaagggacaatgatggcccccccgacccaagttttcctaacataaaatgaaaaagtggatgaaacacacctgacatgtagcagatgtttaataagcatgaggtgttttttcattgtccttatttcccttgtgaattaaaacatcattaagtgcatcggtgcacctgaagacatttccgacctgggcgtccttgggcaagttacttaaccactctgtgcctcatttacataaaccaggcctgataccagcccaggcaacatggcgagaccccatctctgcaaaatatttaaaaagttagccaggcatggtggcaggtacctgtagtcccagctacttggaggctgagatgggaggatcacttgaccacaggagttcgagactgcagtgagctatgatcgtgccactgcactccagcctgggtgacagagtgacaccccatctcaaaaaataaaaaataggccaggcatggtggcctggattacgcctgtaatcccagcactttgggaggccaggatgagtggatcacctgaggtcaagagtttgagaccagcccggccaacatggtgaaactccgtctctactaaacatacaaaaattagccaggtgtggtggcgcacgcctgtagtcccagctactcgggaggctgaggcatgagaatggcttgaattcgggcgacagagattgcagtgagccaagatggcacaactgcactccagcctgggtgacagcgagaatccatctctaaataaataaattaaacatagaataaccaggcctgataattgtccatgcctcatagtgttgatcggagagtaaattaccagatgtggatgaaatgcttagaacagtggctacagcttcagagcctccaagtacacttttttctattacacaccccagcctcatcatttaaccatctgagatcatgctggcaaaagtgagtcaggagaggagggcttaaaaaggagccaggggctgagcacagtggcttacggcctgtaatcccagcactttaggaggccaaggtaggcggatcacttgagcctaggagttcaagaccagcctggccaacgtagcaagaccccatctccaaaaagaaaaaaaaaaagtggggggagccaggaggtagagtctctgccctggcccaggtatctgcagggtatgcaccatctgggagtcagaagtgctttctacaaggcctgagggtcttgttattggtggtacagctctctgccccccacctctgccccaaccccaactcatgccaagttctggcctcctacttctcatgtctgtattcctactgggatacaatagaatcccccagggctgtgggttcacacctcaggggcagatatattggttctagctaagccagaacttaggaggagaaagtatctggagaagatttctagaactcagaactgtgcttagaggctggccagcgaccccttggtcagtgcctatcatgtgggccttccagtccgggcagcccgtgagggcatctgaccgctccctgacatctgcctccacccccaatgcccccccagggaatggtgtaagtccctgatgctgtctcgaacccacatctccccgaccctgttctccctgataaataaataaaactgtaaataataaaactgcaggctgggcacagtggcttacacttgtaatcctagcacttggaaaggctgagacaggaggatcacttgaggccaggagtttgagaccaacctgggcaatatagtgagaccctatttctacaaaaaataaaataaatagccaggcctggtggtatgcacctgtagtcctagctactgaggaggctgacggaggaggatcacttgagcccaggaattggaggctgcagtgagctatgatcacgccactgcactccagcctgggcgacagagccagaccctatctctgaaaacaataataaaacgacaaccaatgctgactgtgtctccatcactgggtggggctgaggaagcaggcctcagaaaggaagccagttttcccccaaaattattccctgaggctgcctctgggcctgtggatccagatgtgtgggggccttcaggagtggcaggggagtggggcctccagcgtgaaaacagaagtcaccgtcagccttgcacccccggctctgcctcccaggactggtgtttttgcctctgttttaatttcctgctgggtcctcccttggacattgtcaggtatgcaggctgggacatcccttctttcctcctacattccccctagagcccaaggctctgtccgtggtccagccactccatggcagggaagctgtacctccataatcagctgcctgagggcccctgacccaccaccaggcaccaccctggtggggctgaggttagaagggaaagaatgccagaactccagtcctggaggcaggagagtgtgtgagcccagccccgccctctcagactctcagacctttatttcatcctcattttcctggctagaggttccatgcatcatttttttttttttttttttcagatggagtctcactctattgcccaggctggagtgcagtggtgctatgtcggctcactgaaacctccgcctctcaggttcaagcaattctcctgcctccgcctcccaagtagctgggattacaggcatgcaccaccacacctggctagtttttgtatttttagtagagacggggtttcaccatgttggccaggctggtctcaaactcctgacctcaggtgatccacctgcctgggcttcccaaagtactgggattataggcttgagccaccacgcccggctggttccatgcatcttacctggatgacttgggtccctaaatgggcccctgggtgcccagcctcccctcctccaatacattctctgataatctgaccttgtcatgaccattggggcacctgttgcccacagggtagaggccaggtgcctgaggacagcactgaaggccgtgcacctccacctccagcctccagtcacctcacctagctcactgctctctctcctgcaaagtctctcctgcttccctccctaagggaagggctggccgctcactgcttgggcccccttgatttctaagacacctgtgaagggtcccacaaggccaggcacagtggctcttgtctgtaatcccagcgctctgggaggctgaggcaggaggatcacttgaggtcaggagttcaatgtggacaacacagtaagaccctgtctctacaaaaaaatttaaaacttagctggcattggtggcgcatgcctatagtcccagctacttgggaggttgaggtaggaggatcgcttgaacccaggagttcaagtctgcagtgagctatgattgcaccactgcactccagcctgggtgatagagcaagaccccaactcaaaaaaaaaaaaaaggatcccacggttcaccttgtgctgccacgatcggttggcagctctgctctgtgccgtcctgtgcctgtcactgagtaagatgcaggagaagttgggcaaaagccctcaggataaacgaataagtcattcagagtaggtgctggtgggaaatgggcttgagtcactcacctggggccagaagaggcccccagggagttgtgagcagattagaccctccaagaccgccccaggggttggcccatgctttccctaactgtgcaaaaatggtttgggataggctgggtgccgtgggtcacgcctgtaatcccagcactttgggaggctgaggcaggtggatcacctcaagtcaggagttcgagaccagcctggccaacatggtgaaaccccatctctactaaaaatacagaaattagctgggtgtggttgcacacgcctgtaatcccagctactcaggaggctgagggaggagaatcccttgaacccgggaggcggaggttcatggggaacccagcaggaaattagaatagaaccaaaaacgccagtcatgggaggcagagctgggggagcgaggctgacaatgactcctgttttcacgctgagagaccccactcccctgctgagatcgcgccactgcactccagcctgggcgacagagcaagactccatctcaaaaaaaaagttaattaattaattagattaaagtacaacaattagcagggcatggtggtgcacgtctgtagtcccagctactcaggaggctgaggcagaagaatcgcttgaaccctggaggcggaggttgccgtgagccaagatcgcaccactgcactccagcctgggcgacaaagtgagactctgtctccaaaaataaaaataaaaataaacggtttgggatgttctgaggttccagacatgccctctcctgcctgcatgtctgccggatgcccaggtctgtagctgtgcatgtgtcactcagtgaccatcaccaaaggggactggaggcatctccccgagccctgggagagtcctccagcctgcactgttctcatgcctgtctctcttctctccccaggatgtttgatgagcgaattttcacaggtatgtggggaccatctagtccattctgaagtttccggattggttccccaacagaacccgagctgccaccaccctggacttggtcctcctgagcgcctcccctcaggcagggagggaggctgggctgtggtttctgtgtcctgggacagaaatgggtcccaggcttctaggtgctgacagactgtcaggacaacccctcccagcttcaaatgccctggacagagagtactaaagctggacgctaaccggtgccaggttggtgaacctgagcctgtgccaggctctctttgaagctgccagcatattttattttaatctgattccaacaatcctatgaaggtggctccactccactactctcacgtgcagacagaggaacggaagcccagctggtgagcacgggtccctgctgcatgcccagcagtgtgactccagagcccatgcagtggcccgtgggccagcacacctgtcccaggaggaagatgcgggctcttcccggggtagcaaaagcatcacggttcttggggtgatcctggcaccccagttccggtcccgcctcccaccagctgtgtgactttgggcaaggtcttgtgggcttcagtgtccacgtctgtgagatgaggataagggcgccttcctctgggctcctggcacgatgacatgagagcctggtcttgtgatgcagccatggggaagccccggcccttttctgagggctcagcccccatagtgtgttggagggcaggagaaccatctctggttgctgcctcccattcctcctgccccttgctctcccaaatctctggccacctctggcactagggctgctgttcctccttctggcgtcagagtctctccccaggacccgttcctggctgttggctggacgtggcgcccacaaggacaggcagaggccaggccctatccccgggattcccccagcttcacacacagacctttacccaggggctctgcagcaagaggaggccagagggccttcaccctgacctccctgactctccccacagggaacaagtttaccaaagacaccacgaagctggagccagccagcccgccagaggacacctctgcagaggtctctagggccaccgtccttgaccttgctgggaatgctcggtgaggccccgcccctggccccggaggcccgcggccagccctgctctgggctgaggcagtgttacctgcaagggggtacccagggcggctcccaccacaccaccacccctcgaaggtgcaaagggagggcaagggaaaacagactccacctacttccctctgcctagagaactctcacatagagaactctcccgcccccaacatctagccagatgtcacctctctcagaagcctctaaatgcccacactaggccaggtgcggtggctcacacctgtaatcccagcactttgggaggccgaggcgggcggatctcttgaggtcaggagttcgagaccagcctgggcaacatggtgaaactcccatctctactaaaaacaaaattagccgggtgtggtggtgcgcatgtgtaatcccagctactcgggaggctgaggcaagagaatggcttgaacctgggagggagaggttgcagtgagctgagattgcactactgtactccagtctgggtgacagagcaagactctatctcaaaataaatacatgcccacaccaggccggacttggtggctcactcctgtaatcccagcgctttgggaggctgaggtgggtggatctcttgatcccaggagtttgagaccagcttgggcaacatagtgagacccttgtctctacaaaaaataaaaagttagctgggcgtggtggctggtacctgtggtcccagctacttgggaggctgagatgggaggattgcttgagcctgggaggtaaaggctgcagtgagctatgatcgcaccactgcactccagcctgggcaacagagtaaagaccttgtttcaaaaatacaaacatgcagctgggcatgatggctcacgcctgtaatcccagcactttgcgaggctgagccaggcagatcacctgaggtcaggagttcgaaaccaacctggccaacatggcaaaaccccgtctctactaaaaatacaaaaaaaattagccaggcgcagcggcgcatgcctgtagtcccagccactcgggaggttgaggcaggagaatcgcttgaaccctggaagcggaggttgcagtgagccaagattgtgccactgcactccagcctgggcaacagaacaagactccgtctcaaaaaaaaaaaacaaaaaaaacatggatgcatgtatacatacctactacatgcatacatacctactacatgcatacacacctacctacatgcatacatacataccaacaccaggtctgatgcctgtcctgagtgcccaccagaccctgcccccagcactcagcttggctaccatccaccaacaccccccaagcacattctgacctcttaggggcaggggtgggccgtttatcccagaatccccacatcatatcaggcctctccctgcagttccctgggagggagggaattaaccaaatcatctgtcccagggttcctgccaccttcattccccagccccttccccagatttttaaccctttccaggccctgcaggtctcagtcccccacaagcagtgatcaaacccccagtgtgccaagcctaggatccccagagctcccagatggtgaagaagggggatccccagatggttcaccccaggagagtgagcaggtgcctggctcggccacccctggagattgtggtccctggagacaagacacggggaatctgtcttcctggtggaggtggggagcaccatcctggagggccaggggccgatggggacagggatgccttctgcagtggcgcccgcggtgggccctgactgcctggaggggcaaggctggggcagggtggccctggacttggctgacaggtgtcatttcctgcttcccttcacaggtcagacaagggcagcatgtctgaagactgtgggccaggtgagaaggaacagggcccgctgtgtgtgtggtgggccgggagggcaaccaccagccctacccggcagccttggggaggagctcaactcagcccatgagcctggagtgctaacgagcctcctctgcccacctgcctccactaggcctcgcagagctgaggtgcaaggcatgctgggagcttactggggtcagggacatggagagctgggtgctggcatcaccactgcctcctgtcgatgcccagacccaggctgcaggttcttggaccagcagcctcccctctggggggcctcagtcaccgggtctgtaaatcggagcccctaagcctggcctgagggctcccctgacctccaattccagtttgggcggagccagggggctgacatgacttgtcctaggtagggcctcactaacaagttacagacaccagaatgttctggaaagagtcactctgcccagtcgggatcatgccagacttgacaggattcttcctttcctccttgcaggaacctccggggagctgggcgggctgaggccgatcaaaattgagccagaggatctggacatcattcaggtcaccgtcccaggtaagggacgggcatctgaccaccccctgcagaaatcagggccggaccgttagcctcctgagggtctgccctggtgaagaagtggcctccaggccgctgtttctctctgtggattctgagagccatcggggtactgtgaatgctttttctggccacatctgtcccctgcgttgtgaatcagtgttctcagctctgaccttccagaaggtcccctcaaaacttcacctccctggcttggcttccctgggatttgtgaggctggacagaagaaaaagccatgggtgtgagaggctctgagtttgaccctaccccctgccaagcctcattttccacatcttcagaggagaggatagatttgggcgctggagcctcagtacggggtgactgttagaagccaagagggtgctgggcacagtggctcatgcttgtaatcctggcattttgggtggctgacacgggaggatggcttgaggccaggagttcaagaccagcctgggcagcatagcaacacccacatctccacaaaaaatacaaaacattagccagatgtggtggtgtgtgcctgtcggtgtagcttctcaggaggctagggcaggaggatcacttgagcccaagagttggaggctgcagtgagcagtcatcccaccactgcactccagcctgggcaacagagcgagaccctatctcaaaaaaaaagaaatgactgggcgcagtggctcacgcctataatcccagcactttgggaggccgaggcgggcacatcacctgaggtcaggagttagagaccagcctggccaacatagtgaaaccccatctctactaaaaatacaaaaataagccaggcatggtggctcacgcctgtagtcccagctactcaggaggctgaggcaggagaatcgcttgaacccgggaggcggaggttacagtgagccaagatggcgccactgcactcctgcctggacgacagagtgagactccatctcaaaccaaaaaaaaaaaagagacagaaagaaaaggacccttgtctgtggggagactgggctgggtgggccctgagggactgtgacaggagtatgacaggcagaagatacccgtgtcattcggagttttgtcttcagacccctcgccaacctctgaggaaatgacagactcgatgcctgggcacctgccatcggaggattctggttatgggatggagatgctgacaggtaagaaatggacctgggctggtggtgcttgggactcagctctccagggagcaaagggaaaggggtgggccaggccgtccccaggtgtttcttggtgtcagccgtctgtagtagaggaaacccaatatatgcctgaccctaatccaaggctgggttccttttggaaacctcaagtaggctctatttatttatttagagacggagtttcactcttgttgcccaggctggagtgcagtggcacgatctcggctcaccgcaacctctgcctcccaggttcaagtgattctcctgcctcagcctcctgagtagctggaattacaggcatgtgccaccatgcctagctaattttgtatttttagtagaggcgggctttcgctatgttggtcaggctggtcttgaactcccgacctcaggtgatccacctgcctcagcctcccaaagtgctgggattacaggcgtgagccaccgtgcctggccataggctccatttataacaaggcccagcgtccttcccaggagccacctgttggaattaatttgtccatttatccaacaactatttattgagcatctgttgtgtaccaggtcctgtgtaaggggctggagacaaagcagtgaaccaagcagaagtccccacctcctggggtgcacatcctcatgtgaagagatagatggatagtacgcaaataagtaaaataggcagggtaaggtggctcgtgcctgtaatcccagcactttgggaacccaaggtgaggggattacttgaggctgggagttcaagatcagcctgggcaacatagagagacccatctcttaaattttttgagatggagcctcactctgtcacccagactggagtgcagtggcgcgatctcagctcactgcaacctccacctcccggcttcaagcagttctcctgagtagctgggattacaggcgcccgccaccacgcctggttaatttttttgtatttttagtagagacggggtttcaccatgatggtcaggcaggtctcgaactcctgacctcaaatgatcctcctgcctcagcctcccaaagtgctgggattacaggcgtgagccaccacaccttgcctcaacaaatatttattgagcacctgctatgtactaggtcctgcgtaaggggctggggaaaaagcagtggaccaaacaggtgtccccacctgctggggtacacatcctcgtgcggagagataaacagtaagcaaataagtaaaataggcagggtgaggtggctcacgcctgtaattccagcactttgggaggccaaggcgagggtactgcttgaggccaggagttcgagaccagcctgggcaacatagcaagactccatctctaaaagatttttttttaattgactgacacagtgtctcacagctataatctcaacactttgggaggccaaggcaggaggattgcctcagcccaggagcttgagaccagcctgggcaacatggtgaaaccctatctctacaaaaaatacagaaattagttgggtgtggtggtgcgtgcctgtagttccagctacttgggaggctgaggtaggaggattgattgagcccaggaggttgaggctgtggtgagccgtgatggtgccactgagtaagaccctatcttaaaataaataaataggtcaggtgcattggcttacaactgtaattcaccattttgggaggctgaggcgggcagatcacttgaggtcagagttcaaaaccagcctggccagcatgatgaaacccccttctctactaaaaatacaaaaattagctgggcatggtggcgcatgcctgtagtcccagctactcaggaggctgaagcaggagaatcacttgaacccaggaggcagaggttgcagtgagccaagattttgccattgcactccagcctggacaacagagcgaagctctgcctcaaaataactaaatagatagatagatagatagatagatagataaaaattagacaggaacggtaggacctatgtgtagtcccatctactcaggaggctgaggcaggaggatcctttgagcccaggagttggagcctgcagtgggctatgatggtgccactgcactccagtctgggtgccacagcaagacaccatctcaaaaaaaaaaaacaaaaataggctgggcatgaagaattgcgtaatcctagcactttgggaggccgaggcaggcagatcacctgaggccaggagttcaagatcagcctggccaacctagtgaaaccccatctctgctaaaaagaccaaaaaaaaattagctgggcatggtggcaggcacctgcagtcccagctacttgggacactgaggcaggaaaaccgcttgaaccttgggaggcggagtttgcagccgagatcacgccactgcactccagcctgggcaacagagtgaaattctatctcaaaaacaagcaaacaaaaataggcaacaaggcaggatgcttaggatgtaacactaagcaaaagaggaaaaattgattgtgctttgcttacaactgtgttgcaaacgtaatcactggggacaaacaagggtagagcaaaacagtagcagtgttaggcaaaatgatttgcgttttttattttctaaatcagttatgatgcacttctaatactttggtaatgaagaaaaaaatatgatttgtccagcacaaactgggcatgaccagacttgacagcagtctgtggcgtagctatccagagagtttggttgacgccaagctcaggctgagatgacagcatggcgtggcgcctaaggaattggcacggtgcccagctgggtttgcagtggccttagaaaacaccatagaagcctccatgcagcactcacagccagaggctgggtggcactgcaggggttgggggccttggatgagcacagcatcattgctgtttgtttcacagagcagaacacaggctcagcaaggctcatccacctccccaaggtcacacagccttgggctggaaaacatgtttcccatgcagggttccttcccaggcaccccagtcaaacctgatgaattaagaaaattctggctgggtgtggtggctcacacttataatcccagcactttgggaggccgaggcgggatcacctgagatcaggagttcgagaccagcctgcccaacatggcgaaactccgtctccactaaaaatacaaaattagctgggcatggtggtgcgcacctgttatcccagctatttgggaggctgaagcaggagaatcacttgaacccaggaggcagaggttgcagtgagccaagatcgcaccattgcacttcagcctgggtgacaagagcgaaactctgtctagaaaaagaaaaaaaaagaaaaagaaaattctgatggtagtcacatctgtaatcccagctactcaggaggctgaggcaggagaatcgcttgaacccaggaggtggaggttgcagtgagctgagactgcaccactgcactccagcctgggtgacagagcgagactctgtctcaaaaagcacaaaacaacaacaaaaaaagaaaattctgagatgtccaggaccaccatggattagaggattttgcatttgtgtgctttttctgtttacacatatttgatatgaaacagttaaatgatacagaactgtgtaatacattgagcaggtgcagtggctcatgtctgtaatcctagcactttgggaggccaaggtgggaggatcgcttgagcccaggagttcgagaccagcttggacaacatggcgaaaccctgtctctacaaaaaattttaaaaagtagccagccgtggtggtacatgcctctagttccagctattgaggagactgaggcgggtggatcgtttgatcccaggagtttacaaccagcctggggagcatagcaagaccccatctctacaaaaaaaaaaaaaaaaaaaaaaaacaattagctggatgtggtggtacctacctgtagtcccagctattcaggtggccaaggagggaggatagcttgagcccaagaggttgaggctgtagtgagctgtgattgctccactgcactccatcctgggcaacagagcaagacccaggaaaaagctccagtcacatcctcctcaggcaaccactagtattcctagcatcttccttttgtatgtttttatctatgtgctaattcatgtgatgactattttaaacaaattgtcccttgtattctcacctggaagtttttttgtttgtttgtttgtttgtttttgagacggagtctcactctgttgcccaggctggagtgcaatagcatgacctcgctgcaacctccgcctcctaggttcaggcgattctcctgcctcagcctcccgagtagctgggattacaggcatgcgccaccatgcccagccaatttttgtatttttagtagagacagcatttccccatgttggccaagctggtctcaaactcctggcctcaagtaatccacccatctcagcctcccaaagtgctgggattacaggtgtgagccaccgtgcccagccgaggactttgtcttgttcccacgtgtcctcagtgtctagaacagactagcttgggaggtgcatgcaaaatgatctcagcctgctttcgtgtgaaggccagggtaggcacctgtatggaatcggggtccctgatcccattggagtgggtgccatgcttcagagttggggccccctggcctgccattccccagctatctggcctgacgtcggcagtgcatggcttaggagatgatgaatgtggcttcccggcatcctctgttctcttttagacaaaggtctgagtgaggacgcgcggcccgaggagaggcccgtggagggtgaggccctgtctacccctgacattttacacccacccccaccccatctctcttcccctgccgcccacctccccttggcctctgggtctcttcgttctctccacctcatctctctccagcaccctggtgtgggggtgggaatcctgtgggctgcctgatatgggaggagatttaaggatttgtcttctagaaccaggaagttcctggtcaaaggtgagagcagttcccactgctaaggaaaattgcaagcctttgtttttattacacaccctgctgctttgcgcaaaggttttaagactgggaactgagcctcctctatctgagcaagtagattagaggcctgaaagcacaaaatttgctttgtgtccagcagacacgcccattctcaggaacgtgagaattccctccctgctgagaatggaagtaggacagagagagagggaggccagggtgagggtgggtctgtttcatctctgtagtatcctggaatggaatgagtgagtgtcagaggagagaattgtcacttccccaaacccagcctggcaggaggaaccatgaagtcttaacacagttccgctgccacctggtggcagcctgctcaatttgcaggcttagtgggtacccactagttctatcacatgctacactcagtcacatacctagaaagacccatggtcactcctagtccacagaaccttccaaatcttcattcaggctggcggtgccctagatttgatttcgcaaacaagaatgtgagcccaggaattgtggacctgtctgcgtgtgccatttctgaggaaataagttacccaccgccccagccccagccttcccccattccaagatcccaccacagggccaatgttggtaccagcagagcaggaacatcagccgagaagctgccaccaaccagcctcaacagactgccttttgccttccagacagccacggtgacgtgatccggcccctgcggaagcaggtggagctgctcttcaacacacgatacggtgagcaagaagtgggacagggtctgggggcatcccggcccccctccagccgccctgtttgcagaagggctttggtcgcatccccttgcctgttcccatcccagctgttctctgggcagggacaagggagagagggaagggaggagctgggacccatcatgaggatggggacactagagaggctgtcactcaggctccctggctcactcactcacactctgcctcagtcgcaggttggagaggccactccctcccctgtaatgtcgccagccctcagccctccgccctcaccctcatccctccgccctcaccctcatccagggtcctcaagaagactcataataagaataagataagataacctcagtggtgtgccgggcatgaggctaggtgattccccatgtttttctttttttttttttttttttttgaggcggagtctcactctgttgcccaggctggggtgtggtggcgcaatatcagctcactgcaacctgcgcttcctgggttcaagaaattctcctgcctcaccctcccgagtagctgggattacaggcacctgccaccatacccggctaatttttgtagttttaatagagacagggcttcaccatgttggccaggctggtcttgaactcctgaccttaagcgatctacccaccttggcctcccaaagtgcagggattataggcttgagccactgcacccggccccctgtgttcttgtatcccatctcacaaaatccccgtgtcctaagacccactttacagatgaggagaactgaggcctggtaaaggggtgtgactcgtccaaggccccacaccactcagtggcagagatcgggttcgttccaaggcgtggtgttgtgccacagcagcgtgtggggttgcttatggtggcaggagggacactcggggggccttactggaagggcgaggcccagtggactcggggaagcaatgccgaatctcagcagccattagtggtggcttctgtactgcctgggcatgagggcatggacccagcgtgggccttggggtaaccctgggttgagttcctatcccctggctctgctgttcagtggctctgtgacctcagacaagtcacgtcccctctgaactccaggttcctttcctgcaggctggggggccactctttccacatcccaggaaagctggcaggccctcaaaagggctctggcagctttgccccccgacacaggcacgggacacaggggttgaggctcctggccctgtggcaccgggtggccctacagcagccatgtctctgcagccaaggccattggcatctcggagcccgtcaaggtgccgtactccaagtttctgatgcacccggaggagctgtttgtggtgggactgcctgaaggcatctccctccgcaggcccaactgcttcgggatcgccaagctccggaagattctggaggccagcaacagcatccagtttgtcatcaagaggtaaggcccaaccaggtccatgggagacagcaccggccctgctcagcaccaaggggcaggagcagcaccaaattgccatcaagcaattcttgtgcctcagccacctgaatagctgggaccacaggtgtgaggtgtgtgccaccatgcccagcctttttttttttttttttttttgagacagagtctcactgtctcccaggctggagtacagtgatacgaacttggctcactgcaacctccgctctggcttcaagcgagtctcctgcctcagccccttgagtagctgagactacaggtgcgcgccaccacgcccggctaatttttgtatttttagtggagacagggtttcaccatgttggccaggctggtcttgaactaccaacctcaagtgatccggccacctcagcctcccaaagtgctgggattacaggtgtgagccacggcaccaggcctttcttttctctctctcttttttttttttttttttttttgacagcaaggtgttagatggggtttggctgcagttggcagacatgaggctccccaggcctgccagacccaaagccaccgaactgacccctctcgcagtctcaggagagcagtgttcagtttccccagatgcagaatgggaacgtcccatcagctcacgggttctccaggctggcgtgttggtgtcctgggccgggggctgggagcaatgccctgtcgtcccagaatgggaaggaccagcagtggcttctacaggctgtttctgtttccttgagcgtgttgtgtttttgccaatgagggcccgggacagcacccatggacataccctgtgtgcccagctgggataaaaagtccctttgggcccgggcgcggtggctcacgcctgtaatcccagcactttgggaggctgaggcgggtggatcacgaggtcaggagatcgagaccatcctggctaacacggtgaaaccccgtctctactaaaaaaaaaatacagaaaattagtcaggcatggtggtgggtgcctgtagttccagctactcaggaggctgaggcaggagaatggcatgaacctgggaggtggagcttgcagtgagcggagattgtgccactgcactccagtctgggcaacagagcgagacttcgtctcaaaaaaaaaaaaaagtccctttggagaaggtggtggcagttattgagtaaaaatgtggttgggggatttcaggaacagtggctcatgcctataatcccagcactttgggaagctgaggtgggaggattgcttgagcccaagagttcaagaccagcctgggcaacatggcaagactgtgtcactataatttttttttttaaactctggtgtggcagcacatgcctgtagtctcagctactcaggaggctgaagcagaaggatcacttgaggccaggagttcaagactagcatgggcaacataacaagaccccatctctacaaaaaaattttaaattagctgggcatgatggtgcacacctgtaatctcagctactcaggaggctgaggtgggaggatcacttaagcccaggaggggtttggaggctccagtgagctatgattgcaccactgcactccagcctgggtaacagagcaagactcttcctcaaaaacaaaaaaaaccagggaatgggaggatcatatttccattttgtgtttgttacttctgtgttactgtaatagcacatatttaggcttggtttacagctgggcatgacggctcatgcctgtaatcccagctggcatttgggaggccaaggtaggcagatcacttgaggtcaggagttcgagaccagcctggccaacatggtgagatcccatctctactaaaaatacacagattagccaggtgtggtggctcacacctgtaatcccagctgtaatctccctgtcatcaggagactgaggcacaagaatcacttgaacccgggaggcggaggttgcactgagctgagatcgtaccacgacactccagcctgggcaacagagcaagactctgtctcaaaaaaaaaaaaaaaaataggcttggtttggttgaaagtggcaagaaagaagagactcttaagggtttgttcctccaggagaatagatagttctcaaactgggagactcacagcgtcatttttcatacagtggcgaggagatccgctgggacagggagctctactgcagggcctgctctgtgccaggagggaggctgctgctccatgacacacaaagagcagatagcaaaaagctatgcaacagggctggagagcaagagtcatgattcgtgcagtagaagcaaaggcttcagcaggccaggatgaatgcagccacatgcccggtgtgtctgggcatattaaaaggaagattgagccaggcatggtggctcatgcctgtaatcccagcactttgggaggctgaggtgggcagatcacttgagatcaggactactgaaaatacaaaaattaaggccgggtgcggtggctcacgcctgtaatcccagcactttgaaaggccgagttaggcagatcacctgaggttgggagtttgagaccagtctgaccactatggagaaaccccatctctactaaaaaatacaaaattagccgggcgtggtagcaggtgcctgtaatcccagctactctggaggctgaggcaggagaattggcttgaacccaggaggcagaagttgcagtgagccgagatcacgccgttgcactccagcctgggcaacaagagcaaaactccatctcaaaaaaaaaaattagccaggcatggtggcatgcacctgtaatcccagctactcaagaggcaaagaggagaatcacttgaacccgagaggcagaggttgcagtgagccgagatcgcactcctgcatttcagcctgggggacagtaacactcttgtctcaaaaaaataaaaagggaagatcacatttcaggtggtttaaggataaactcatgatagacatatagcccatcagatgtgtgaaaacagggaaataaagattcacaagagaatatgtgtaattatagtacagtaattggctctactatatacatgtatagtactgtactggttgaaggagggcttctttcaacaaattctcagcctgagcaatgtgtgaaaccccatctctagggaaaaaaaaaaattagccaggcttggtggtgtgcacctgtagtcccagctacttgggaggctgaggtgggaggatcgcttgagccaggaggtcgaggctgcagtgagccctgattgcaccactgcactctagcctgggtgacagagtaagaccctgtctcgaaaattttttttttttaatttttttaaaaatacattccgtccaggcgtgatggctcacgcctgtaatcccaacaccttgggaggcccagataggaggatcgcttgagcccaggaatttgagagcagcctgggcaatgtatcaagaccccatctctacaaaaaattttaaaaattctcacacctgtaatcccagcactttgagaggacaaaacaggagggtcgcttgaggccaggagttcgagaccagtctggtcaacatagcaaccccatctctattttatttttaaaattaaaaaattagccaggtgcagtggtgtgtgtctgtagtcccagatacttgggaggctgaggcggaaggcggaagaatagcttaagcacagagggtccaggctgcagtgagctatgatggcattactgcactccagtctgggtgacagagcaagacctcgtccctttaaaaatacaaagagaggccggggcatggtggctcacatctgtaatcccagcactttgagaggccaaggcagatggatcacttgagttccagagtttgaaatcagcctggccaacatggtgaaacaccatctctactaaaagtaccacaaattagctgggcgtggtggtgcacacctgtagtccgagctcctcgggtggctgaggctcaagaatcacttgaacctgggaggtggaggttgcagtgagctgagatcacatcactgcactccagcctgggcgacagagcgagactccttctcaaaataaataaatatagggtttataaataaataaaacacaaagagacaaacaaactaaaaaaccatcctggatgcctgccaggtcccgggcttgcagcccagcagtaaatgccaccaagtcctgccctggagttgccgatgtcacccagacaaaatcaaaatgtcatgtcaggtagagataactgctgtgacaggatataatgcagagtgagggggagagagggacaggaggaacctggataagaaggtgacattgaagcggtgacccaatgaagggagagggccagccaggtgcataaagagtgtgggagcaggccaggcgtggtggctcacacctgtaatcccagcactttgggaggctgaggcaggcagatcacgaggtcaagagttcgagaccagcctgaccaacatagtgaaaccccgtctctactaaaaatgcaaaaattagccgggtgtggtggcgtgtgcctgtaatcccagctactcgggaggctgaggcaggagaatcacttgaacctgggaggtggaggttgcagtgagccgagattgtgccattgcacttcagcctgggtgacagagggagactctgtctcaaaaaataaataaataaaaataaagactgttgggacagagaaaaagtcatgcaaagtccctgaggcaacaacgtgcttgggtgtttgaaagcttgcaaggtgcccttgcagctggtacagggtgagtgagggaaggatggtgaggttgaggcccaagaggtagcaggggaccaggcgtgtggcccacgcctgtaatcctagcattttgggaggctgaggcaggaggattgcttgagctcaggagtttgtgaccagcctaggcaacatggtgagaccctatctctataaaaaagaaaaataggccaggagaggtggctcacgcctgtaatcccagcactttgtgggggttgaggagggtgtatcacctgaggtcagaagttcgagaccagcctgcccaacatggtgacaccccatttctaaaaattcaaaaattagccaggcatggtgagggggtcctgtaattccagctactcaggagactgaggcaggagaattgcttaaacccaggagacagaggttgcagtgagctgagatcgcgcccctgcactccagcctgggcgacaagagcaaaactctctctcaaaataaataaataaaaaggtagcaggagccagatcacatggattttgggccagcttaaagagtttgaattttattttattttttaaaaagtcttaagagacagtgtctcattctggtttgtttttatttttgtttttgctttctatgcctattccctcaaaccataaactaggggcacccgggcagcttgaggtcaggtgccaattcaacagcaagtcctcatgaatgacattttttatggctttgtgcagagacaccttgtgctcatgagcattggttttttgttttttgtgggttggtttttttgttgttgtttgtttgttttctattttttgagacagagtctcactcactctattgcccaggctggagtgcagtggcaccatctcagcttactgcaacctccgcctcccgggttccagcgattccccggcctcagcctcctgagtagctgggataacaggcgcatgtcactacacctggctaaattttgtatttttagtagagacggtgtttcaccatgttggtcaggctggtctcgaactcctaaccttaagtgatccatccaccttgacctcccaaagtgctgggattagaggcgtgagccaccatgcctggccttttgtgggttttttttgagacagagtctcactccaggctggagtacagtggtgctgtctcggctcactgtagcctccaccttccaggtttaaacgattctcctgcctcagcctcccgagtaactgggattacaggcgtgagccaccatgcctggccatgagcatttgttttaagagacaagtctttctttagcccaggctggagtgtagtggcacaatcataactcactgcagccttaaactcctgggctcaagcaatcctgcttcagcctcctgagtagctgggactgcaggggcacgccaccacacctggctaatttttacattttttgtagagaaggggtctcgctatgttgcccaagctggtctccaactcctgggctcaaagcgatgcccctgcctcagcctcccaaagtgctgggattacaggttgagccaccatgcccagccttgagcactttttaaagtcacgatggctttctccacctgtcatttggaaagggagacaggtcagtgcagtggccgacgggagaggccgtctggtgggtttgaggccagctcctcctgttactccctgtggccttggcagccggctgtgctatttaaggggaagcactgtcgctactctggcctgggactcaggggctctgcccagcttctgcctctctaagtttactgctgggaagtcacttcccctttcagaacctgagttctcccataaagaggaggggcctaaatgcagtccgaagccttttctagctcctgagactgtggttcaaggcagggctatgcttcccctcccagccctggccccgtgaccccagctctgtgcctggcactgtacagaagcctaagagatgcccaccgccagagcgggcaccaaatcctcatctactggggaccccaggggtgccctccctgagagtttggcctttgggctcactcccaggcagagactcctcggagttgctgcttgattacccctgtgacagagagctcattacctctccaggcccattacctctccagagagctcattacctctctgctccatggcctaccctgccatcccccgacagcccccttctggccagcatgattttcccagtgtcctctacccaccacaaaccccagccccacaacaggcttgctctaacaggacaagttgtgctgaagatggggccttcagaagcagtgctgtatgacaaagaaggttgactcatgtctggacagggctttctggagtctgtggagctaaagacattagcataatacagagctgggcttggtcactggtgcttccgactgcagtaacacagcagctctcagacgtgagccgtagatctcagacctttccagaagcttggagttcttgcttcgtagtgggccccgactgtttctactcttttctttcattttgagacggagtcttactctgtcacccaggctggagtgcagtggtgctatctcagttcactgcaacctctgcctcctgggttcaagccattcccctccctcagcctcccaagtagctgggattataggcacctgccaccacacctggctaatttttgtatttttagtagagacgggtttcaccatgttggccaggctggtctcagactcctgacctcaagtgatctgccctcctcggcctcccaaaatgctgggattacaggcgtgagctactgcacctgaccttgtttctacactttaaaccagctccacgggaggccacctgaggccacctgctccaatcccaggcagtgacaatcgtgcaatgtccctggagcaggagtgagatatcagatggacctgttcaggactggggggggtctcactcccagctggatccttcaagcccagcgcagccccccagattccacatgtggggcggcagggactccaggcctgaactatgcatagccagaagggtccattgcagggctgtgtagactgaggcccagagaggagggctgagcagtcccagagatgcttggagggacctctgtgatagcctcgcttgtgttttccaggcccgagctgctcactgagggagtcaaagagcccatcatggatagtcaaggtacccagcgcggggtcgggagccatggtgtgggcgggcaagggagggccccaggcctctgccaccagcccctcctcctgctgcctctgtcctgctcccatcctggccctggcattctccccacacccccacattgggtttcccctaacgatgccatcttgggtcccaggaactgcctcctcacttggcttctctccccctgccctgcccccagagagggattccggggaccctctggtggacgagagcctgaagagacagggctttcaaggtaaggttgagctcacggggaggtctgttgtcccagcaccaggacattgacctggtttgggtttggagggccaggctggaagtggggaggagctggcccccaacttcagggcctaagggaccaggcaagccaggttggcagcccaggcccggctgtaccctgccagctctgtgttagagactccaggggagagggggtgcctacaggtggacggtcgggggagcccaggagcctgcctgccccctccctgccccaccccccagaggtagctgacacgcccactcctttttcagcaatcagctgtggtcttagtgctttgaaatcagaataggagccagacgcggcacctcacgcctgtaatctcagcacttgggaaggtcaaggtgggaggatcgcttgaggctgggagctcgagacaagcctggacaacatagaacccgtctctatgtctatttttaagaaaagaaatcagaggccgagtgcagtggctcacgcctgtaatcccagcactttgggcggccgaggcaggtggatcacttgaggccaggagttcaagaccagcctggccaacatggtgaaaccccgtgtctaccaaaaaaatacaagaattagttgggcgaggtggcgtgcacctgtgatcccagctactagggaggctaaggcgggagaatcgcttgaacctgggaggcggagattgcagtgagccgagatcatgccactgcactccagcctgggtgacagagcaagaccctgtctcaaaaaaaaaagaaagagagagagagagagagatggtggtctgggatccctccagcacatgctggcacttgtctttgtttgtttgtttggatggagttttactcttgttgcccaggctggagtgcaatggcgtgatctcagcccactgcaacctccgcttcccgggttcaagcaattctcctgcctcaggctcccaagtagctgggattataggcacgtgccaccacacccggctaatttttgtattttttagtagagacggggtttcaccatgttggacaggctggtctcgagctcctgacctcagatgatctgcccacctcagcctcccaaagtgttgggattacaggcatgaaccactgcacccagctttttttttttttttttttttgagacagagtcttgctctgtcacccaggctggagtgcagtggtgcgatcttggctcactacaacctccacctcccaggttcaaggggttctcttgcctcagcctcccaagtagctgggattacaggtacgcaccaccatgcctggctaatttttgtatttttagtagagatagggtttcaccacattggccaggctggtttccaactcctgccctcaggtgatcctcctgcctcagcttcccaaaatgctggggttacaggcatgagccgccgcgcccggtcacacttgggcgtttttaatgaacactttctgggtgagggtgtcttggtggctcatgcctgtaatcccagcacttttggaggctgaggcaggcagatcacttgagcttgggggttcgaggccagcctgggcaacatggcgaaaccccatctctaccaaaaacacaaaaaagaaattagccaggtgcggtggtgcacgcctgtggtcccagctactcagaaggctgaagcaggagaatcgcctgagcctgggaggtggaggttccattgggagccgccaggcccatcccctgtgtctgtggggactgcccatcctcctccatctgctagatcagctgggcttccattccctcgcttgtctccagccccctagtgacttcatgaagcccccgccccctgcctgccagcccagggcacaggactccgtactctatggtgtccctcccctccggggcttatttattggtttggtggttttcaaatgtcatcaattaacttaatttccaactcatcactgttgtggcaacagtgcatgtccttctgaaaaaaagacatctccatcaacatgtcggtgctgaaggacctgaggggcccactccaaagatcctttaattgccggagaaggagttccccataattagaaaatcatcttccttaaaagtcaccaagtgctttttcactcaacagcccaaacccataatcgttttgcgctttgcagaaaattatgacgcgaggctctcacggatcgacatcgccaacacactaagggagcaggtccaggaccttttcaataagaaatacggtaagcagtgcagaacccccggggagggacacgcagctgctgtgcacagagaagtgggaggcttcccagttccagccgagggcatttctggggaaacaattcacccctttacatgtatttcttgagcatatactacgtgccaggcactgtctcaggcactggggatattgctgtgaataaaacagacacagtccctgtactcatgagccttgcagaccaatgaggtgagatacactttcaagaactacacacagaatttaatagacaagggcccggcacagtggctcctgcctgtaatcccagcacttttggaggctgaggcaggtggatcacttgagctcaggagttcgaggccagcctgggcaacatggcaaaaccccatctctaccaaaaacacaaaaaagaaattagccaggtgcagtggtgcacacctgtggtcccagctactcaggaagctgaagcaggagaatcgcttgagcctgcgagggggaggttgcagtgagctgagatcgcgccattgcattccagcctaggcaacaaaagcgaaactccgtctcaaaaaaaaaaaaaaaaaaatggagcatatgacatgggagcatattggtgtggctttttctttcgtttcttttttttttttttttttttttttttttttgagacagggtctcactctgtcacccatgctggagtacagtggcgtgatcatggttcactacagcctcaaactcctgggctcaagcaatcctcctgcctcagcctcccaagtggctggaactacaccccactgggcactaccatgcccaactagtttttagaaatttttagtaaagacagggtcttgctgtgttgcccaggctgatctcgaactcttagacttaagagatcctcctgccttggttccccaaaatgctgggattacgggcataagccaccatgctggccttttttttatgttctgatcaaacagctcagattgtaatgcctatacctttccacagtgctacactacataagagctttctcgtaccattcactctcctgcacgcatgtctttccatcacatccccgcaatcccatgtacacacaccccacgctgcctctcactcctgacgggcaggaccctgcctctcgcccacaggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggtactcagtgggaagggtgagggtgaagaggcaggactagctcagatgggagcttgcacctgcgaatccttagcctttccctaggtcctgccctcccccctggacaaggtggctctcctggcaccatcctgggtcctgggggtggttggagagggactgcaggccagcccaagtgaagggagcccttcagaagtgggactggtcacccccccatggcaagggcagcctttgagggcatcttcaacctgttcagcaacacccgctcactgcacccccagcccccgggaaaggtattcagcccccatcagagggatttgcccaaggtcccggggccagccagggcaaagcctgcacaaggcccaggtctgcgtcctgcagagtgacactgccaatgccagcaccctgccacattgtctcagtgtcccgcacacacagagccccagggcagcttgttaaaatgcagattctgctgctgtaggtctggggtgctcccaggggagaccgaggccactgaatcccaggggtgtcttcctcatcccccaggccctccccatgacacccctgcctctgtttctcttctaggcctttccaaggactcatcccaaagcctggtaagaggcactggctgtggagggggcactgggaatagggcccgatcgtggtgctggggactggagctaagcctgctgtggggcacaggttctggggtctgggaacagaagccaggcccctgcctttcttttttttttttctgaggcagagtccttctctgtcacccaggctggagtgcagtggcttcatctcggttcactgcaacctccacctcctggattcaagcaattctcctgcctcagactcctgagtagctgggattacaggcaattgtcaccatacctggctattttttgtatttttggtagagacggggtttcaccatgttggccagggctggtctcaaactcctgacctcaagtgatccacccacctcggcctcccaaagcgttgggattacaggcgtgagccactgcgcccggcctaggcctctgcccttctgtttagccaccttacctgggctcctgccccaggtagatggaggaagactaagcttgaatgtggccccagatcctgggacagagaaaggggtggtggcgtcagtgacttctaagttttacccagtctgggttcaggagggaggggccaggccgagtcagtgcacctgctcctcctgataaaggggctctggttgacctcagtgaataggcgaggttggaggtgagtgggttcctaaccgcagaaggaggggtgtctgcatggggaccacaagcatgttggtaagatgtgggtggcgcctaccctgccttaaacagtgcagtgcctctcctgaccctttttaaaaaaatattttatatatataataaaatatatacataataaaaaatatatataataaaaatattatatataattaaaaatatttatataattaaaatattatatataattaaaaatattatatatataataaaaaatattatatagagagagagagagacagagacagaccaagtctcactttgttgcccaggctggaatgcaatggcactatctctgctcactgcaaactccacctcccaggttcaagctattctgcctcagcctaccaagtagctgggattataggtgggcaccaccatgcccggctaatttttgtgtttttagtagagctgggtttcaccatattggctaggctggtctcaaactcctggcctcaagtgatcctcctgcctcagcctcccaaagtgctgggattacaggcatgagccaccacacccgacctcctgaccctttttaaggcacccatccacttctgtctccaccatggactgtgtcctggcctcccaaacccagatttgcaggggctgtccctgcagggtgatcccaaacccagatttgcaggggctgtccctgcggggcgacatgccacttggcaagcactaagggctggccagagcctccagggcgggccaggcacggtggctcacacctgtaatcccagcactttgggaagccaaggcaggaggatcacttgaggtcaggagttcgagatcagcctgaccaacatggtgaaaccccatgtctatttaaaatcccaaaattagccaggtgtggtggcgcacacctgtaatcccagctacttgggaggctgaggcaggagaatcacttgaacccgggaggcagaggttgcagtgagccgagatcgcgcgactgcactccaccttgggcgacgggactagattgtctcaaaaaaaaaaaaaaaaaaagaacttagggtacagtgatgtggcggctgctgacaggccacgggaacccccagaagggggatcaggagggtgaggggtagttggagagggtttcctggagtaaggatggccctgcttgggcctcaggggaagatgggactttgagaggcagagaggagggtgggtttggcggggtgaacggcaggggttggggggtcactggatgccagaagtgtgtttccggagctctcggaggggcagagtggtcagatgatgttggaaaggtggagagagtggaagctgcagcagcacagtgcagtgagtgtggctccagtggacacccggctgagaggtcactgggtttctggccctgcactggtgctttatgcgggtgcctttcacacatattttgggaggtcctgctgggacaaggtggtattctagaggaactagggttacagcagagtgcagacagaggaggcatctcatttagtcttcatagctaggaggttgacgctagagcccaccttacagagggggagactgaggctcggtgtgagtgatgtgttaatactctgtgtcccagggctagcaggtggtcgtggcctcagccctcagggatggacctgccagcccctttccaggcgttggcacccaagccaggtatccaccaggtatccacacttactcatgccactagtcatgctgggctgggaacacgtccaggctcctgggagtctctgagggttcaccagaggtcactgagtgctacttctgcaccagaatgggcttttctcaaactctccctcacacggttcccgaagcctggcctgggccagcaccggcagttccagggtgaatcggagtggaagctggggtctgctgggggaggcaggggaaatagcagaccccttcatctggaggcaggtgtcccagggcaggtggaggggtggcagatagttgcagagaggcgggtggctggggacagtgcccaggagtcagccttcagggtcttaggcagcatgtgggccatgggaaagtgccgcctcattcaagtccctgtacccgcctgactagccatgggaatctgagccttcacttccttaccgccaagatggacaagcacacctgcctcaccatgtgatctgaatatgggaaaagatgggcagtgctaggttagctgggaggactattttccgccaattgccctcttttttttttttttttttttttttttttttgagatggaatttagctcttgttgcccaggctagagtgcaatggtgtgatcctggttcactgtaacctccgcctcccaggttcaaatgattctcctgcctcagcctcctgagtagctgagattataggcgtgtgccacagcatccagctaaatttttgtatttgtaggcaccctaacacaatgaaagtccaggctggttgaccaggctggtctcgaactcctggccagcctcaagtgatccgcccatcttgacctcccaaagtgctgggattacaggcgtgagccaccgcattcagccgcctttctttttgtcctcgtttgcaaatacagaatggaccttagtctgcaaactcagaagtgcgagacatgtatttttatttttctaaaattgaactggactcctaccaaaagcccccaatgcagagtggcagaaactttatctgagtccattttggatcatcatttcccttgagcttgcactagggcctggaaccttctgtgaggcccactcagtagacacttccacaccgcagagagactgagcatgagaaggtccgtgcttgaaaaaggcctaacggtgggatctcggtgcaaagatgggagagtggaaaccgagtggtgaagagatgactgtggcacccagcagggaattcccaggagggtgaggcttcgggaactttccagggggacaaaccctgttaagaatggctctagggcctggtgctgtggctcacgcctgtaattccagcactttgggaggccgaagtaggcagatcacgaggtcaggagttcgagaccagcctggccaacatggtgaaaccccgtctctactaaaaataaaaaattagctgggcatggtggcgggtgcctctaatcccagctactcgggaggctgaggcaggagaatcgcttgaaacttgaaggcggaggttgcagtcagccaagatcacaccattgcactccagcctgggcaacaagagtgaaactccgtctcagaaaaaaaaaaaaagaatggctctaaaccaggaacagtggttcacccctgtaatcctagcactttgggaggccaaggtaggaggatcacttgaggccaagagtttgaggccagcctgggcaacataacaagaccccgtctctacaaaaaaattaaaaattagccaggcacggtggcacgcacctgtagtctcagctactcaggaggccgaagcaggaggatggcttgagcccaggaggtggaggttgcagtgagctgagattgtgcaactgcactccagcctgggtgacagagcatgacgccatctggaaaaaataaaaataaaaagaatggctctgagatttttttaggtcacttattgaaggttcccatggaagcctttcctaacagaaccaccccgagaaggtaaaaattctgaaagagattgtgcttttttgtttttgttttgttttgtttttttgttttaagatggagtttctcttcttgttgcccaggctggagtgcaatggcacaatcttggctcactgcaacctccacctcccgagttcaagcgattcgcctgcctcagcctcctgagtagctggaattacaggtgtgcaccatgacactcggctaatttttgtattttgagtagagacggggtttcaccatgttggccaggctgatctcaaacttctgacctcaggtgatcagcccgcctcagcctcccagagtgttgggattacaggcgtgagccaccgcacctggctgagattgtgcttttttgaagatgaatcagtcattaaattgcaagagccccactgcaccctagagctgtgagcctccccagtgtagggtgagagtacagccactcctggactggttttgttctgggtcaaaagagatgactcaggccagacgtggtggcttatacctataatcccagcattttgggaggccaagatgggaaaatcacttgagcccaggagtttgagaccagcctgggtaacatagcaagatcccatcctgcaaagacatttttttaaattagccagacatggtggggacgaacgactgtattcccagctactcgggaggctgaggcgggaggatccctcgagcctaggagttggaggctgcagggagccataattccagtgtgtgtgacagagcgaggtcttgtctctaaaaaagagagagagagagagataagcccagaatgtctttaatattttcccagctgaggacatcacgtttgccttcagtgcctcagtttccccactaaaatctagaggccctgcctgctctgacatgctgagtggcgggcaggcgtctagcttgagaggaaggcatacttggacttggaccaagcctcagagggcagtgggtgaatttcaggcctcaggtcaagggagctgtgggccaggggtttctgggggccaggggtactagaaagcaccagactgaactggaggggacctggtggggggcctcgggttgcagagggatgggggggactgggtcccccaactcataccagaaggaactccagccctgcccgcaaggggctgagacaacccacgctcgaccctgggggctgaacgccattggtagctggtagctctatactgcccaaccaggccacacccacctgcctgcagcggcactgaattaaattagggagactgccaggcgcggtggctcatgcctgtaatcccagcactttgggaggccaaggtgggtggatcacgtaaagtcaggagttcgagaccagcctgggcaacatggtgaaaccccaactctactaaaaatacaaaaattagccaggcatggtggtgcactcctgtaatcccagctacttaggaggctaaggcaggagaatcacttgaacctgggaggcagaggttgcagtgagccaagatcgcgccattgcactccagcttgggcaacagagcacaacccggtcacaaaaaaagaaagaaaaaagaaaacccaggacagctaacgggggctgttcaggatatgctgggaagaagcggtggtgactaaggcgggagaaaccctctacccaggtagctgctgtaatattccatccgaagaacattctagtaggtcataaaaacctaaagggggtcgggcatggtggctcatgcctataatcccagcgctttgggaggccagtgcaggaggattgcttgaagccaggagttggagatcagcctgggcagcatagtgagaacccatctctacaaaaaaaattttttttaattagctgggcatggtggtgggtggtggcgcttgcctgtagtcctagctacccaggaggctgaggcaggagggtcacttgagcccaggagtttgaggctgcagcgagctatgatcacaaagctcacatcacctcacttcaacctgagtgacagagtaagaccctctctctaaaagacacacaaacacacacacacacacacacacacacacacaccctaaagagaaatgcaaatatatgcccatggtagaaatttggaaaatacagaaatctaacaacccagatggctgttcatttttatgatgatacatttcttccagatttccccccaagcttattaattttacatctcactgttcttctttctataaatttacacatttaaccttaaaacataaacatgttcccatgtctttaaaaagctctgttccctcttcaggctgtatcatggttatgtaactaccctgtcccccagttatggacatttgagcagcccctcacaccacagacacctaacactcacgtcacacttttttttgagacggagtctcgctctgtcccccaggctggactgcagtcgtgtgatctcaactcaccgtaacctccgcctcccgagttcaagcaattttcctgcctcagcctcccaagtagctgggattacaggtgcccgccaccatgccaggctaattttcctattttagtagagacggggttttgccatgttggccaggctggtctcgaactcctgacctcaggcgatccacccgcctcggcttcccaaactgctgggattacaggtgtgagccaccatgcctgaccacgtcatacttacgatttgccggttacaaagcccactcacgttaccacgtcatctccccaagtagctggccttattggaggggactgaggctcagagagattaagcagctttctcaaggtcacacagtagtgtggtagagatttgaacctaagtctttaccattttattatacttcggaacccagggcaggctctaccactagcctagggcttgttgtgtgtccctgaagtgggttgcagccacgccctctttcccaccacccctctggtctcatccacacagggtggctctttgctgtcccctcctggctaccagcagctattacactggtcctgcctgtgtaaacctttaggcttgtagttaatcctttgagttcatttatttgtacaacaaaaatgtatggagggccaggcgcagtggctcacgcctgtaatcctagcactttgggaggctgaggcaggcggatcacaaggtcaggagatcaagaccatcctggccagcatggtgaaaccccgtctctactaaaaatacaaaaattcgctgggcatggtggcgcatgcctgtaatcccagctacttgggagcctgaggcaggagaatcgcttgaacccgggaggcagaggttgcagtgaactgagattgcaccacagcactccaacccggcgacacagcgagaccctgtctcaaaaataaaaaagaaaaaaaaaaggagagagaggtggaaagtccgcaggtgaagcccagggagaaacttactgaagggggtgattggttgcaccagcctctgctgggaggtcagtcctaatgcctgagagtagacggaggtgctaagcaacaggttgcagtgggatggttcagagcaattttgggggaagtggtggggaccagagtggaatagtgggctcaagagacaatgagaaaggcaagtgattgaatctgccaaggaccaagcaccaaagtgccagctcactgccaccctcagtaaagactaacttgccctttcccccaactcccctcccagaagtagcttgctctcctctgcctgccacacatcgggggggtcaggtctaaaaggatcaccttttagagggcaggagagaatgaacaagagttgagagtggaatggctgcagagagggctttcttttttttggtggagggaggggacagagtctcgctctattgcccaggctggagtgcagtggcgtgatctcggctcactgcaacccccgcctcccgggttcaagtgattctcctgcctcagcctcccgagtagctgggattacaggcgcgtgctatcacgcccgactattttttgtattttttagtagagatggggtttcaccatgttggccaagccggtgtcaaactcctgacctcaaatgatccacctgcctcagcctcccaaagtgctgggattacatatatgacccaccacacccagccaagagagggttttagaggtaggaacagcagctgcatgatcttcagcagattcagtagagagggaagtgagctgtgggagaggaaggaggatggggggaatggcaagaaaaggagcaccctgcttagaaagggaacggagctgggtgtggtggctcacgcctgtaatccagcactttgggaggccgaggcagtaggatcacttgagcccaggagtttgagaccagccacataacaagactgcatctctatttaaaaaaaaaaaaaaaaaagaaggagaaagggccgggcgtggtggctcacgcctataatcccagcactttgggaggcccaggcgggcagatcacaaggtcaggagatcaagaccatcctggctaacacagtgaaaccccgtctctactaaaaatacaaaaaattagctgggcgtgatggcgggcacctgtagtcccagctacttgggaggctgagtcaggagaatggcgtgaacccgggaggcggaacttgcagtgagccgagattgtgccactgcactccagcctgtgcgacagagcgagactctgtctcaaaaaaaaagaagaagaagaagaaagagaaagaaacaggatgggtggaagagggttgctgaatgctcatgcaagctcctgtctgcctgctccttctctcagggagggacaggggagggtgatgagtcagtggactaaatgtccccatggggatgaaggacagttggggtcaggtttctagagggagggctggaaggagggaaggagatggccagagaaggatgtgggacacagaggtgccgccatggatcaccaagaggttcaggactggccagagggaggagaagaggtcaaggtacgtgtggggcacttggatgacgcatctgtgcctgcacacagctgaaatccccaggaaataagacgggagcagggtgggtttctgcagccaaggtgagaccaaaatgccagctcactgccaccctcagtaaagactaacttgccctttcccccaactcccctcccagaagtagctcactctcctctgcctgccacacatcggggggtcagggaaagctccccctccctgaggagctggtgttccctaggccaggggccagtccctgcagagattaggagctgggaaatcccctcctcccatcccgcacgtccacgcgtgccagaccctgtgctgtgggcttttcacacacagcctcttagacgcttagcctgtgaggtgggtgctgttgtccttccttcccattttgtaactgagcaaacagcctgaaacagacaaaaatcaggtagttagcatgaggccaaagccactccctggtctatgctgttctgcggcctgagcctggggtggccaggtggggttgtgcagtgagggggggatggagaatagcccccaaaaatgctgccggaatggtaaagggcctagcctgcaaagctagtaacttgagctttattttgtggcactggcggtttttccagtcattgtaatgatacgatcagatttgcgctgtcttcaggttaccatggtaaccatatttccacccaccaagggtggattagagaaggcaaaactagggcagagaagccagggagtgttgagaaggtctgaacccaggcagtgggcagctgggccccacgatggatggggttaggatctagaggcagcagcagggtgtgaagagggcggaaggttccggaagggtgatggtggtgctcgtctctaaggctgggtctgtgggcttgtgagacacatccaggggcccatagtgaaacctgagtggtatttagtgcaggcagggtggcaggcaggctgggggcctctcagaagcgtggagctggcagagagagacctgcccggggcatcggaggaaagggcgactgtgcaggaacagagtagacgaggtgggggaacctttgggtaagaagagctgagtcaggagcattgaggcagcggttttcaaacctcagaagcaacagcagggccgggcgcggtggctcagcctgtaatcccaggactttgggaggctgaggcgggtagatcacctgaggtcgggagttcgaaaccagcctggccaacatggtgagaccctgtctccaccaaaaaatacaaaaattagccaggcatggtggcggacgcctgtaatcccagctactcgggagcttgaggcaggagaatcgcttgaacctgagacgcagaggttgcaatgagctgagatcacaccactgcactccagcctgggtgacagagcaagactctgtctcaaaaaaaaaaaaaaagccagacacagtggctcattgcctgtaatcccagcacttcgggaggccaaggcaggaggattgcttgaagccaggagaccagcctgggcaacatagtgagaccctgtctctacaaaaaatgaaaacattgagccagtgttgtggcacacatctgtagtctcaggtactcgggaggctgaggagggaggatcgcttgagcccaggaagtcaaagctgcagtaagctgtgatcacaccactgcactctagcctgcgagacagaatgagaccttgtctttcaaaaaaaaattctagaattgttcttgaatagcagtggttaacgttttttaaaagctttggaaggtagtgaactccccgtcactggaggcatttaagcagaggttgagctgccactcactagagaggccgcttcctatagggcttgctgcaggagaggagaaagggacaagagagccctgccggttttggaggggctgtggggaggactaaaaccaaggaggggcccctctacccaccaaatccacttctctttgctgccccgccaccagctccccacagctcctccctgcgtatgggcccagccacccttctccagttcccttttgggcaaacacgagggctctccccggacccaggccagcttccgctccttttagttctcctctcaccctgggggtacagcagtccctgccagcttgaggggactgtgggaaggcagcgccccacctctccttccccagagcaggggctccagaccccagggatgtggcagagctgccaacttcctgtgtgactccagcaagtcaggcttgcctacctgggcctcagtttccctacttgtaaaatgagaagaattgcccacgccacgtctgcctcccctggggccaccctggagtgcatgaccaggtgagaaggagggatgggctgtcatgagtgggaggtggtgaggcagagagactggccaggatggagcggggacagcctgggaggcctggctttgcagcatggacagggcccttcaggcctggccctggtaagctcttctgctgacgtccccatagcggaggaacccgtacagccccactggtcggggccaagctcttggcgggctccagttttatctaggacatccccacatcgtctcctctgtaaacgttccactttcatctcagtttaaggaactatgtcaaattacatgctgctagctgggcacagtggctcacgcctgtaatcccagcactttgggaggccaaggcaggagggtcacttgcatccaggagttcgaaaccagcctgggaaacataaagagatcctgtctcgacaaaaaataaaaaattagccaggcatggtggcgtgtgcctatagtcccagctactcaggaggctgaggtgggaggatcccttgaccctgggagttggaggctgtagtgggctatgattttgtcattgtactccagcctgggcaacagagtgagaccttgtctcaaaaaaaaaaaattacatgccaccgaggaagatcattccacttacactcacctctcacccccaccagaattgtttgaggcccattttgagaagctcagctgtgggtgaaatgcctgccaggcacagggctgtgatcccttttcagggggtacaagtggagaaaagccagaagcctcaaatacagtagcaccacttgtcattgtcctctttgatctcctgctaagcctctctcttctgtggggtctcctgtcacccagtgggtgctatggtgggatgggcttcctggagaggatgacctgagccaggcctggatgctagtgtaggactgacctctgcagagggtactggggtggacatggggagggactgaagagcggcaggcacaggaacaggtccctttttgccttctcaggaagaagtaccatcacttctgagctgtgtgatcttggataagttaacctactatctctgatcttggataagttaacttgctatctctgatcttggataagttaacttgctacctgtgatcttggataagttaacttaccatctctgatctagataagtcaacttactatctctgatcttggataagttaacttgcttgtctctgattttagataagttaacttactgtctttgatcttggatgagttaactgtctttgggtctccatttctttgacgtgatacagaacaaggacatcctccatgatcctcccttctgctgcccaagacttgagagtcatttccttgtcgccaatcacacacaggcacacaccctctggcccctgcctccctctctcagccttccccaccccctctctacccttccaactctgtcttgagctcttgaaagctcaaaataaagccaccctttctcaagtttctaaagatatcacaattccagcgccagccacatgtttctccactgaattatctctgcttgtctttgttaattagggttcagtaatgatctcccttctgccttcccagggagagctggcatctgcggggcggggcttggaggcctttgtgggcagacgagacgccctactgccgggcccagagttggcccgacgcctcctttcttctgaagtggcagagtgggccatgaaatgatggcatgttggggagaccctgcccttttctggctggtggggacttagctggggtcattgcaacaccattctgccccccaaccttccacacgtcggggaagggaactccaaggtttttagcctttattagatgggcttccaggctgggtgcggttgcttacacttgtcatcccagcactgtgggaagttgaggcaggcggattgcttgagcaatcctggagttcgagaccagcctgggcaacatggcaaaatcccatcttgacaaaaaatgagccaggcatgagggcacatgcctgtagtcccagctactcaggaggttaaggcaagaggctcacttgagcccaggaggttgaggctgtggtgagccgtgatcgtgccactgcccaccagcctgggcaacagagcaagaccttctctcaaaaaaaaaaaaaacgattaaaatttaaaatagacaggggctttccggacccgaaagggagcagggttgggggcgcctttagagtcttttgcaacatcccagaaagcctcccagaaaccctttccccagcgaagaccacccaagctgacaagagcaaccagcacctttatttgggctggaatgagatcagcaccgaggggtcgccaggcaccttgtgcagaacagaagctgatgcgtgtgtctgagccatagaagtagagcaggggcagggtggtaaccatggctcagcacatgtggtttactgggtgtacccgatccttccagccttgtggggaggggtgtggggacaaaagaggagggaggtggaggttgggggccatgcaggcctagccctctaagaaccttcgtgtcatggagagggctcagcaccacccacagcagacttcgtgtggccccaacagaggccttgggggcgcaggtgcagtcactcatttgtgcacaggcccaggtgtctcactggggccagcactgtgccagatactggtcttttattattatttcattattctttttgtttgtttctgttttgttttgtctttgagacagagttgcgctcttattgcccaggctggagtgcagcagtgcaatctcagctcactgcaacctccgcctcccgggttcaagcaattctcctgccttagcctcctgagcatctgggattacaggcatgcaccaccacaccaagctaatttttttttttttttttttttttgtatttttagtagagactggatttcaccatgttggccaggctggtctcgaactcctgacctcaggtgatccacctgcctcgacctcccaaagtgccgggattactggtgtgagccactgagcccggcctcattattcttatttaatatttttgtaggacagcatcttgcttcattgcccaggctggtctagaactcctggcttcaagggatctcaccgccttggtttcccaaagtgctgggattacaggcgtgagccactacaccgggcctagatactggaatttttttttttttttttttttaaggcagggtctctctctgtcactcaggctggagtgcagtagcacgatcacggctcactgcatcctcgacctccctaagctcaagtgatcctcctgcctcagcctcccaagtagctgggactggaggcgtgcaccaccgtgccaggctaatttttgtatttttttgtagagacggggttttgccatgtttcccaggctggtctggaactcctgggctcaagtaatccacacacctctaacttccaaagtactgggattacagatgtgagccaccgtgcccggcctatgctggacttttaatcaacactgattaaaaaaaaaaaaaaacccggctgagtgcagtggttcacgtctgtaatcccagcacttcgggaggctgaggtgggcggatcacctaaggtcaggagtttgagaccagcctggctaacatggtgaaactccgtttctactaaaaatacaaaaaattagcccagcatcatgacacacacctataatcccagctacttgggaggctgaggcaggagaatcgcttgaacccgggaggtggaagttgcagtgagccgagattgcgccattgcgctccagcttgggcaacaagagcgaaactccgtctcaaaatacaaaaaaacaaaaaaacccagcctcacggagcctacatggtggggcggggggataaacagaaaatctgcaaagcgtaaaccatgggagcaattgtatttatttttaggagattgcaacattatttaggtgatgaccagaaggaggccttagttttaaaggcctgaaggggcagcagggaacagcattgcaggcagagagaacagcagctgcaaagcccctgaggtcacctgccaaggtatcagaggaaggtcaggggaagtgagagatgagatggagatggacagggaagatggtacatggccagataaggattttgacttttgctcagagtgagcttagagtcggtgcagttctgagcagagggtaacaggatccagcttgttttaacagaatccctctggttgctggcttgaggacagacaagggtggagagacataaggaggttgtaataatccaggcgacgcctgtggcggcagtggggtggtgagtcacccactcttaggtgagttggctgaagccaacagaatgtgctgatataagctgtgagaaaatgaggagctgactttgacttcagaggttcaggctgaacttggggaaggacggaggtgctgtgggtggagacagggaagatgcaggagaagctggtggggcaggaggtggcggatcaggcgtgttcaatctggggtctcatccagtcgaagttggaagcaagttggggctcaggggagcagtccaggcttgagatatgatttggggaatcatgaatttataactggtatttcaagccttaaaacaggccgggtccagtggctcacgccagcactctggaaggctgagacagaagggtcacttgagcccaggagttcgagacaagcctgggcaacatagcaagaccccatctctaaaaaaaaaaaaatagctgcacgtagtgcacacctgtggtcccagctactagggaggctgaggtgggaggatgacttgagctcaggaggtcaggctgcagtgagccacgattgtgccactgaactccagcgtgggaaacagagtgagaccctgtctcaaaaaaataaataaattacctaaacgtagtggcttcaaacaacacaaatttattgccttacagttttggagatcagaagtctgaaatgagtcttccaaggctaatgtcaaggtgtcaggggccaggtgcagtggctcacgactgtaatcctagcacttcgggaggctgaggcgggcgaatcacttgagatcaggagttcgagaccagcctggccaacgtggtaaaaccccatctctactaaaaatacaaaaattagccaggtgtggtggtgcgcacttgtaatcccagctactcgggaggctgaggcaagagaatcccttgaacccaggaggcggagtttgcagtgagctgagatcgtgccattgcactccagcctgggctacaagaaaaaaaaaaaaaaaagatgtcagcagggctgatccttctggaggctctaggggaaaatctatttccttgtcttttttttttttttttttttttttttttttttgagacagagtcttcaggctggagtgcagtggcgcgatctcagctcactgcaacctccgccttccaggttcaagcaattctcctgcctcagcttcctgagtagctgggattacaggcatatgccaacatgcccggctaatttttgtatttgtagtagagacagggtttcaccatgttgcccaggctggtctcaaactcctgacctcaagtgatctgcccactttggccttccaaagtgctgggattacaggtgtgagccactgagcacggccccctgttttaaggattaaatgaatgaatccatgcaaagatcaaagagcagtgcctggcacagaagagctcagattctctgagttaccaagtgcccgtgatgggttgggcattttttttatttgtttgtttgttttgagatggagtcttgctctgtcgcccaggctggagtgcagtggcgcaatctcggctcactgcaagctctgcctcctgagttcaagcaattctcctgcctcagcctcctgagtagctgtgactacaagcgtgcaccacctatcccagctaattttttgtatttttagtagagacgggatttcgccatgttggccagactagtcttgaactcctggcctcaagcgatccacccgcctcagcctcccaaagtggtgggattacaggcgtgagccaccgcgcccagctgggttcagtaattcttagcatattgccaattttccctgctttctctctcacacacacgcgcacacacataatttctctttctttttctctatttgaagtaaggtgcaaacatcttgactcttcgtgcctaaatgtttcaatgcacatctcctaagaaaacactgttatcttacatactcacaatagcatcatcgtacttatacaacttaataattccctgtcatctaatacatggtctttattcaaatttccaaaactgtcttctatgcctgttctcctccatgatataatcatttttcactggttgatttcttttttaattttttttttttttaaagacagtctccctcttgcccaggcaggagtgcagtggcacagtcatagcttactgcagcctggaccttctaggctcaaaccatccttaccacctcagcccctcgagtggctaggactacaagcacacgtgctaccatgcccagctcatattttattttttacttttgtagagataggctggagtgcagtgacactatcacatagctcactgtaacctccaactcctgggctcaaacaatcctcccgcatcagcctcccaagtagctgggactatagctgggtgccactgtaccagctacttttaaattttttgtagacagagtctctctatgttacccaaggctggtctccaactcctgccctcaagtgatcctcctgtctcggcctcccaaagtgctgagattataggtgtgagccaccacgccaggctcacgggttaattttttaaaaattattttattgcatgtaatgtttgcctaaacaaaaattatttcattttgcttataattttactttcttttttttgagacggagtctcgcactgtcgcccaggctggagtgaagtagtgtgatcttggctcactgcaacctccacctcccaggttcaagtgattctcctgcctcactcagccttccgagtagctgggactataggtgcccgccaccacgcccagctaattttttgtagagacggggtttcactgtgttagccaggatggtctccatctcctgacctcacgatccacccgcctcagcctcccaaaatgctgggattacaggcatgagccaccgcgcccagcctataattttacttttatgacaaaggcgtgttattgaatagagtctgggacttgctgttttccacttagctttggttgacataatgctgaagtgtgtagctgtagcttcttagttctcatggctctataatcttccattgagtggaattttaccatgatgcaattcctctctctcccctccttggggattgggctgcttccattgttttgctgttactaagaatgcaattaacacttatagccgggcacgatggctcatgcctgtaaacccagcactgtggcaggccacgacgggaggatcccttgagctcaggagtttgagaccagcctgggcaacatggcaagaccccatctctactaaaaatacaaaaaaattagccaggcatggtggcatgcttgctattcaagaggctgaggcgggaggatcgcttcagcccaggaggcagaggttgcagtgagctgagatcatgccactgcactccagcctgggcaacagagcgagatcctgtctcaaaaaaaaaaaaaaagcagaggaggagaagcatagatccgttaaaaagtttaaggcccagcctggtgactcgcccctgtaatcccaacactttgggaggctgaggcggaagaattgcttgaagccaggagtttgagatcaacctgggcaacatagcaagatcctgtctctacaaaaatgttaaaattagccagacgtggtggtatgcacctgtaggcccatgtactcaggagactgcggcaggaggatgaggtcaaggctgcagtgagctaggatcgcactactgcatgggtgacaaaatgagactacatctctaaaaaaaaattttttttgaaaaggaagaggaagaaggccaggcgcagtggctcatgcctgtaatcccagcactttgggagaccgaggcaggcggatcacctgaggtcaggagttcaagaccagcctgaccaacatgatgaaaccccgtctctactaaaaatacaaaaattagccaagcgtggtggctcgtgccggtagtctcagctacttaggaggctaaggcaggagaattgctggaacctgggaggcggaggttgcagtgagcccagatcacgccaccgcactccaccctgagcgacagagcaagactccatcttaagaaaaaaaaaaaaaaactacagttccctttgtaaaatgggtttttggtagagacagtgtcttgctgtcattccggctagagtccagtagctgggactacaggtgtgggccaccatgcccagctaatttttccatttttatagagatgggatcttgctatgttgcccaggctacatttttttttaaatcatgagtttttgaaggaaattggatagggcaggctgtggtaggggatggattggacaagcccctgcttgaatgcctgcatacagtggggaaaagggggatcaaaatgggtcaagccttaagggtccctcctgcacgcagtgtccaggtgcaggtctgggatggcagaagaaccacaggctcatgagcactggcctgggcacaggtccacaggtctctgccccgctgcagcttggccctcctctctccaggcctcagttatctcatccatgaaatggagctgatggaattcctgctaaacctgtgcacaggccctacaaggggttaaaagctgaacctgaatgtagcttttttattttttcgagaccgggtctcactctgtcacccaggctggaatgcagtggtgcaatcgctgcagccgtgaactctgcccgggcctggcagggagttggggctctgtgaagtggttcaggaggggagagaaggaccattatcccacgcttctgctacagatcgcagtctctcccctctaaaccgcccttgcccttcgctggctgcgtctccctgctgtgaatggtcgtaattaccaacgtgaggtcgtcagtctgagctgaagtcctctaactaggcggggagagtcagggctggccagggctcttgcactttgccccgagagagagccgtggagccagcccaggcaccacccgagccagttggtttaaaattgtgtacatagcatggctgtgattcagtgagcttggttgtcttttttttttcccccttggcaaatttcagttactccttgggctaacagacagcagactggtaaagataagatgagagttgcccagccagcgttaaagagagagaggagaccgaagaacagaatgagcaggaggcgggcaggaaaaatgtcaagggaaggcctgtccaccaaaggtgtcactgtccaggggcagtgggcaggaggtcgctgctgcggggatgggttctttcagcaggactttctgcacagcactgggggcagaaacatgaaggtgaaaccctacacacactgagtcctaactatgacatttccaaacagagaacactctgaaatgtttgcaactgtgggtgtctttacagccagcctgggttcaggggagctcaggcaggtcctcccgagaataggtttgctgacttggtgttccggacggtaaactaaacccccttttctggggggggttggggggagacggagttttgctcttgttgcccaggctggagtgcagtggcgccatctcggctcactgcaacctccgcctcccgggttcaagtgattctcctgcctcagcctcccaagtagctgggattacaggcacccgccactatgcccggctaatttttttttattagtagtagagatgaggtttcaccatgttggccaggctggtcttgaactcctgacctcagctgatccacccacattggcctctcaaagtgttgggatgaaaggcatgagccaccgcatgcccggcccattgctgctttacagatgaggacatcgagtggttcagggacttgcccagggtcgcgagctgattgcagagctgggatttgaacccaggcaatcagtcttgggtagaccactgggcttgtgaccctggccttgaagggcccggtattgctcctgcccctgcagtgtcctcagcagctctctgaggcgattctctgatccgtgtttttcccgtgagcagattagactcaaaggtgaccgggcatgctggagctgccctgccccacctgaggccgaggccaccactgcccacagcagtccttggggaactccctggtggcgacctggtggtggtggcaggagcctggctctgttgggaaagaggactcatgaccccacctgcagctctccgagatgctcagctggtctgggcacgatggctcacgcctgtatctcagcactttggaaggccaaggtgggtggattgcttgagcttaggagttgaagaccagcctgggcaacatagtgagaccttgtctctacaaataacacaaaaattagacagacatagtggcacacacctgtagcaccagctactcaggaggctgaggatggaggatggcttcagctcaggaggcggaggttacagtgagctgagattgctccactgcgctccagcctgggcaacagagccagaccatctcaactcaaaaaaataaataaataaataaagcttggctgggccatctgggttagcaaggatcttagcattctccctcagggctaaccagggtgcgtgggcgagctgtctcggttgcagcgggggccacgattcctgtcgggcaagactggtgccagcctgcacacctcagagcccaacaggaatatctgttcagatcgagacgttgccctttcccctgcagggcacggctagagcacagacacaaacccagtgtcaggtccccagacacggcaggggacaggggagttggtcttcacctgtggttcaggttccctcccagacagtgagtcacttatgtgcccaaggagctgcctctggtgcactcacagttcccagaagatctgggatgggactacaggtgtgcaccaccatgcccagcattttttctttttttttggtagaaacagggtttccctctgttgcccagactggtcttgaactcctggcctcaagcaatcctcccacttcagccttccaaagtgctgggatgacaggcatgagccactgtgcccagcctgtagtgctttttgatatgtgagattagatccagcaggcccagagtcccagttgaggaatgtggaaacaggctcagagaggttgagtgactttccatacaccacacagcattagggattagaatcaagattgccttccagtctgatgagccagggactttccccatacctggccctggggatcccccttttccccactgtatgcaggcattcaagcaggggcttgtccaatccagctcccaccagagcctcccctactccatttccttcaaaaactcacgatttaaaaaaatgtagcctgggcaacatagcaagatcccatctctacaaaagatggaaaaattagctgggtgtggtagcccacacctgtagtcccagctactgcactccagcctgaatgacagcaagaccctgtctctaccaaaaaaaaaaaaccacgtaattctctttactctaaattaaataaaaagaaagaggtaggaaaatgcaagaacagctacagagaaaaatcagtgttcttcctgagcttgatgttgactgagctagagaatcccacagacaaggtatattgtgggccttgcacagtgtctgcacgtagtatgtgccaagcttgttttttattttttaatttttgtttggttgtttgtttgaaacaggatctagctcagtcacccaggctggagtgcagtggggcaatcatggcttactgcaacattgaccttccaggctcaagcaatcctcccacctcagcctcccaagtatctgggattacaggcacacaccaccatgcccagctaatttttctttttttttctttttttttttttttttttgtggagacagggtcttgccatgttgcccaggctggttgcaaactcgtggcctcagtctcccaaattgctgggattacaggcgtgagccactacatccggccagttcttggtgttattgacaaaggcatttagccccactccacccctcccacactccagaggtggtcaggacgcctccccaaactgccagccccctcagccagcccggccccactttcctgacatgcacactcccaccacttctggtccaccgcctgggacctgtgccccatatagaattgccatagtatcctatcgactgccccgtagtgtcactcctggttagctgcagcctggtttagggttgcacttcttcccagaccaggcaagacttggaaggaagaggggaagtttcctgattggctaaagcatgttgagcacctgaaatcacaggatactacaagtttccttgtgtcttactcaccgctcacaactgccttggaggtccgtgtgatgagccccagcgtgcagatgagcccacatccttggagctttgggccccgtgtggtggtcacctcctctgggaagtcctccctgactcccagctgggtcaggatccctgctatagacccccgtgggccatgtaaaccaaaagtgcctgaaacaggtctcaatcaatttaaagatttattttgccatgggggaggacacagccaggaaaaagagactcaagctgcaatagggtctgtggcctgtgcttttttccagagttttgaggactttggtatttaaaggggaaagagggcctgggtacggtggctcacagcactttgggaggccaagccaggtggatcacctgaggtcaggagttcgagactggcctgggcagcataacaaaaccccatctctactaaaaatacaaaaaattagccaggtgtggtggcgggtacctgtaatcccagctactctggaggctgaggcacgagaatcactcgaacccggtaggcggaggttgcagtgagccaaaatcatgccactgcactccagcctggaaaacagggagactctgtctcgaaaaataaaaaaataaagggggaagaggaatagttaatgatgtatttatcctgtgctcagtaaatctgccttttacataagataaagtaaatagagtagaggaagtcatataggcatttgtcttgggtagacagagcaatgatttctattcttatctttgtcccctgcctgtgaagataagctgtgaatttacatggccagggtgagggaggccaccaggggagctaggtggccttctatcttgcagccatctgtttaggaacaaaaggctattgcgtgactcagttcccaagcttaacatttccctttggcatagtaagtttggggtcccatgttttttgtttgtttgggttttttgtgtgttgttgttgttttgagatgaagtctcgctcttgtcccccaggctggagtacgatggcgcgatcttggctctctgtaacctccgcctcccaggtttaagcgattctcctgcctccgcccccggagtagctgggattacaggcacctgccaccacgcctggctaaattttgtacttttagttgagacggggtttcaccacgttggacaggctggtctcgaacttctgagctcaggtgatccacccacctcggcctcccaaagtgctgggattacagatgtgagccaccgcgcccagcctgtttggtgttttttttttttttttttttgagacggagtcttgctctgtcgcctaggctggagtgcagtggcgcaatctcagctcactgcaacctccacctcccagttcaagggattctcctgcttcagcctcctgagtaactgggattacaggcatgcaccaccacgcccagctaattttttgtatttttagtagagacggggtttcaccatgttggccaggctggtctggaactcctgacctcaagtgatccacctgcctcggcctctgagagtgctgggattataggcgtgagtcaccgtgcccggtctgggcctcgtctttgagaggcctgctaagcttctttctgtcctgcaggtttcgtagagctctgactttgagtctcgctctgtcccgacacaggagaagacagaggtgtggcattgtgggctgagagcaacagattagaggaaactatcttaaagattaagccttctttctacagctactgtaggggagcctgggcatggtggttcacgtctgtaatcccagcactttgggaggccgaggtgggcgaatcacctgaggccaggagttggagaccagcctgagtaacatggtgaaaccccatctctactaaaaatacaaaaatcagccaggtgtgatggtgggtgcctgtaatcccagatactcgagaggctgaggcaggagaatcacttgaacccagcaggcagaggttgcagtgagccaagatcgcaccactgcactccagtccagcctgggtgacagagcaagactcttccaaaaaaaaaaagaaaaagaaagaaactgtagaggaatctgagacctcaggaaacccagggctcatggtagagtggaaagaccagggctttggggttgacacagagtactcctggtgcttagaggctgtgtgaccttgggcaagtttctttacctctctgagcctctgtgtctttggctgcagtgtctaggaaagcatctgcacacagtgatgtgtgtgatccaggccatcctttctctgttctgtgcatgcatggccatgcctgctgagaatcctgccaccaaagattcctcagtggcatggggacagatggaatgtgctgttgcttccctgcaggctctaggagctggtccttgggcccaggactccatcactgttgtctgcatggatttggacaagggtggccttgattcttcccacatcctagtcctgaaaggaaggcccgtgttgggtcacaggagaagacgagggttctaggggatgtggagcgtggggtctttgtgtggctgaattagaggcattactccacgagatagggacacgggaggaggacgttgtctggaatggctgatgtttgcagtgtctctgggcacgcaggggggctggcgggccgtgcctgaagacagatcagcaactcagagatgtgcagagattgctgagtgtgggtgtggacggaccaggccagggacctgcagggtttgggaggacctgaggtggtgggtgttggagccctgggaaaaggaggaaccaggccaagcaggtgcccagcctctgtcctgtgggaagctccctgctctttggggcaacccccacatggggaacagggcctccattctggcagcttgcgcacgggaggccaagccacccagacggggtcagcagactctaagcagcacagagcaccacgccaggagatgcagttcccaaggcagcctcctaaacagaagtgagctcttcccagagttttcaagattaaaagagccagacacagtggctcacaactgtaatcccagcactttcggaggctgcggacaggaggatcgcttgagcttaggagttcgagaacagcctgtgcaacagagagagactctctctacaaaaaattttaaaaaaacttagtctggcatggtgattcatgcctggagccccagctacttgagaggctgagtggggaggattgcttgagccaaagagttcaaggctgcagtgagctatgatggcaccactgtactccaacctgggaaacagggtgagaccctgtctcaaaaaacaggagtcaggctgggcacagtggctcacgcctgtaatcccagcactttgggagaccgaggcaggcagatcacctgagctcaggagtttgagaccaccctggccaatatggcaaaaccccatctctactaaatatacaaaaattaaccggacgttgtggcaggcgcctgtagtcccagctctcaggaggctgacgcaggagaatggcttgaacctgggaggcagaggttgcagcgaaccgagaccgtgccactgcactccagcctgggcaacagagtgagactctgtcttggaaaaacaaaaagaaaaaaaaacaggagtcattttgctccaaagacccatcagtctgctctgccctgaatcatccggccctggctccctgcctgcgtctagctccaccccacaacatctcacccttaccgaacccgcctgccccaagaggcccagcccatgtgaccccacgcttctcagagaggagatttcctgttggacatgcaaaccacccttcctgcaatcccagccccgtcctcaaccctggcacaagcccacaggctgctgcagagctctgccccagaccccatctccagcccaacccccactcagccttacagcccagctcaggccccatctccagggctaactgactccagcagctcctctaggctacagggaggggagagcagagcacaccagggctcaagcagcagataggccgtgacggttacctgggcagtgagcagggagaatgcacggcccccacactcccagacacggtctgtttcccattcacagaccttggtcagcgagcggtcaggggatttccaacagcccagcacagtgacaccggcccctgtgcatggaccccactaggcccatcagtcatctcccctgtaccaccccaaagttcagccacttccaggacatgggatctttttctttttttcttttcttttcttttttttttttttttttgagacggagtttcgctcttgttgcccaggctggagtgcagtggcgcgatctcagctcactgcaacctccgcctcctgggttcaagcagttctcctgtctcaatctcttgagtagttgggattacaggtgcccgccaccacactcggctaatttttgtatttttagtagagacggggtttcgctatgttggccagggtggtctcaaactcctgacctctggtgatctgccaatctcagcctccctcagtgctggggttacaggcgtgagccaccgcacccagccaacacaagatctttcacgcttgagtgcctatgcatggctggtccttctgtcctggtggcttcccactgccactccgtccttcacaaactcctacctgcctttttggagcccattttttgtttgtttgtttgttttcatttttgtttgagacaggtctctgtctcccgggctggactgcagtgacgtgatctctgctcactgcaacctccaccttccaggctcaagtgattctcctacctcaccctcctgagtagctgggactacaggtgcccgccacatgcccagctaatctttttgtatttttagtacagacggggtttcaccatgttggccagaatggtctcgaactcctggcctcaagtaatctgcctgcctctgcctcccaaagtgctgggattataggcatgagccaccatgtcaggccttgagagcccattcaagcatccttctctcttgggggaggtctccccagacttgcccacagagggtgggcaccctcattcatgccccttgtctcctaagtgtgtcctgttgtactttagtgaccagatgacaccccctctggctgggagcccctcagggaagcagccctgcctcttctctttaggttgttttgtgcccaacacagggcctgtgctggggacactgataaaaaaatgtgggatgggctggccaccgtggctcacatctgtaattcctgaactttgggagggcaaagcaagaggatcacttgaggccagcaagaggatcacttcagcctgggaaacatagcgagactccatctgtacaaaaactttaaaaaattaggcatggtggcacacatctttattcccagctactcaggaggctgaggtgggaggatcacttgagcctgggagttggaggctgccgtgagctatctatgatccactgctgccttccagcctgggtgacagagcaagaccgtgtctcaaaaaaagaaaaatggatggagggacagaccaataactgatgctagaaaccagctgcagccaggcacagtggctcacacctgtaatcccagcactttgggaggctgaggcgggtggatcacctgagccaggagtttgagaccagcctgggcaacatggtgaaaccccatctctactaaaaatacaaaaattagctgggcatggtggcacgtgcctgtgatcccagctacttgggatggtgaggcaggagaattcgcttgaacccagaaggcagaggttgcagtgagctgagatcacgccactgcactccagcctgggcaacagagcgagactctgtctcaaaaggaaaaaaaaaaaaacagctatataggagtgggtcggccctgcagagaatgtaatgttttggcagatcagggacgcctggtgggagaagcagcaggtccagtggctaagctggtgccaactctcatgcccccttgtcttcctcttgtagatgaagatgacgccaacagactcggggagaaggtgatcctgcgggagcaggtgaaggaactcttcaacgagaaatacggtcagtgcctgtggtcagggtcagcacaccaagccctcctcccgggggtggtggggggcctccctctgcagccagcctggctttcaggagcccccagctggctgcctgctccctggtgacatggctgctctgcccatgacccacgttttgtgtatgttgattttttttttttaaacagggtctcactctgttgcccaagctggagtacagtggcgtatctccgctcactgcagccttcacctcctgggcttaggtgatcctcctgcctcagcctcccaagtagctgggactacaagcatgcgccaacactcccggctaatttttctatttttagtagagacaaggtttcactatgttgcccagactggtcttgatcttctgggttcaagcgatcctcctgccttggcctcccaaagtgccaggattacaggtgtgagccaccatgcccagcctgtaggtcttgatttttttttttttggagacagagtctcactctgtcgcccaggctggagtgcagtggcgggatctccactcactgcaagctccacctcctgggttcacgtcattctcctgcctcagcctcacgagtagctgggactacaggtgcccgccaccacgcccggctaatttttttgtatttttttagtagagacgaggttttaccgagttagccacgatggtctcgatctcctgacctcgtgatcctcctgcctcagcctcccaaagtgctgggattacaggcgtgagccactgcgccccaccagggtcttgatttttaaactctctgggtgtgatggctgctgggctagggcagcccagactccagccctttccctagagggctttgccattgacaggagacatctttcctcactgtgacttcctgtgccctctaggtgaggccctgggcctgaaccggccggtgctggtcccttataaactaatccgggacagcccagacgccgtggaggtcacgggtctgcctgatgacatccccttccggaaccccaacacgtacgacatccaccggctggagaagatcctgaaggcccgagagcatgtccgcatggtcatcattaaccagctccagtgagtgcccggcctctggaacggggaacagagagggcgaggccatggggagggtgaaagtcaaggtcacggtgggtcagctgggatccagacccaggtgtactgtaatagttcctgcctctttctcctgaaacatacaacttcaacagtcatggacatttacttatttttaaagatttttttttagatattacatttgttctctggggaaaaaacaaaacatgttttaattaaatttgactttttctgactatacaattctgatttttaacatttaaatataaatatgtttatttaaatatgaatatttattatatattttagaataattataattccatagtctcagtgattctcttttttttttttttttttttttgagacagagtcttgctctgtcacccagtctggagtgcagtggcacgatctcagctcactgcacgcttcacctcctgagttcaaccgattctcgtgcctcagcctcccaagtagctgggattacaggtgtgcaccatcacaccggctaatttttgtatttttttggtagagatggagtttcaccatgttggccaggctggtctcgaactcctgacctgaagtgatctgcccgcctcagcctcccaaagtgctgggattacaggcgtgagccactgcacccagcctgcattattactattataccgtatatccttacaatcttttgggttttggtttttgttttgagacagggtctcactctgttgcccaggcaggagtacagaggtatgatcatggcccagtgcagcctcaacagggtctcactgtattgcccaggctggtcttgaactcctaagctcaagtgatcctcccacctcggcctcccaaagtgctgaggttacaggtgtgagccaccacacccaaacctgggtggcccagttttttttttttaatacaatagattatttgattattttcagaataatacacacagcaacctggaaaatacaaaaagatagaagaaaagaagatagctgtaactctcctactgaaagtcaacactgtgatgcatttctttatatttttaaattattattttattaatatattattactttctttttgagatggactctcgttctgtcacacaggctggaatgcagtggtgtgatctcagctcactgcaacctccaccgcccaggttcaagcaattctcctgtctcagtctctcaagtagctggcactacaggcacacgctaccacacctggctaattttttttttgtatttttagtagagatggggtttcaccatattggtcaggctggtctcaaactcctgacctcaggtgatccacctacctcagcctcccaaagtgctgggattacaggcatgagtcaccacacccagccccccctttttttttgtattgcacaggctagtctcgaactcctgggctcaagccatcctcccatgtcggcctttcaaagtgctgggattatgggggtcagccaccacacctggcctgtggtgtatttctttctttcttttttttttttaagatggagttttgctcttgttactcaggctagagtgcaatggcacgatctcagctcactgcaacctccacctcccagattcaagcaattctcctgcctcaccctcccgagtagctgggattacaggcatgtgccaccaccccagctaattttgtatttttaatagagacagggtttctccacgttggtcaggctggtctcgaactcccgacctcaggtgatctgcccacctcagcctcctaaagtgctgggattacaagcttgagccaccgtacccggcccgccttcaatgttatattatgtgttttgtttcttcgtttttttgagatgaggtcttgctctgtcgccctggctggagtgcagtgccgtcatcttggctcactgtaacctctgcctcttggattcaagcaattcttgtgcctcagcctcccaaatagctgggatcacaggtgcccgccaccacacctggctaatttttgtatttttgtagagacaggttttcaccatgttggccaggctggtctggaactcctgaccttaagtgatccgcccaccttggcctcccaaagtactgggattacaaacatgagccactgtgcctggcctacatgtttttttaaaattacgataatatttgcgtgtgtcaaaaaaaaacaaattgttcaaaatcaaaaagtagaggtttcctttctcccacagacagttcaccccctgaagtaacaactagaaaatgcaggaaaacggccaggcgtggtggctcacgcctgtaatcccagcactttgggaggccgaggtgggtgaatcacctgaggtcaggagttcgagaccagcctgaccaatatggtgaaacctcatctctactaaaaaaaaaaaaaaaaaaaaaaagatacaaaaattgggccaggcacagtggctcacgcctgtaatcccagcactttgggaggccgaggctggcagatcacaaggtcaggagatcacaaccatcctggctaacatggtgaaaccccgtctccactaaaaatacaaaaaactagccgggcgtggcgcagggcacctgttgttccagctactcgagaggctgaggcaggagaatggcatgaacctgggaggcggagcttgcagtgagccaagatagtgtcactgcactccagcctggatgacagagcgagactccatctcaaaaaaaaaaaaaaaaaaaaaattagctaagtgtggtggcatgtgcctgtagtcccagctactcaggaggctaagacaggagaattgcttgaacccagaaggcagaggttgcagtgagccaagattgcaccactgcactccagcctgggcgacagagtaagattctgtctcaaaaaataaaaataggctgggcgtggtggctcgcgcttgtaatcccagcactttgggaggccaaggcgggcagttcacgaggtcaggagttcgagaccagcctggccaacatagtgaaatcccatctctactaaaaatacaaaaaattagccgggcatggtggtacacgcctgtaatcccagctactcgagagcctgaggcaggacaatcgcttgaacccaggaggtggaggttgcagtgagctgagaccatgccacagcacaccagcctggacaacagagcaagactccgtctcaaaaaaaaaaaattaattaataaaaataaaaattagccgggcatggtggtgtgcacctgccttcccagctactgggaaggctgaggcaggaggatcgattgagcccaggagttcgaggctgcagtgagctaggatggcaccaccgaactccagcctgggcaaaagagtgagactctgtctcaaaaataataattgataataatgctgtgatgaatatccacttgcataaatctgggcacacatttctgatcacttggtcagacaacatcctcgctttatagatgaggacagcagacccagaggaaagatttgccagcacaggcccatcatccagggcctatatgggggatgctctgttgggacgttgtgccccccatttttatttgggtcttaccaggctcccccagcagcagcagcagcatatctcagggagcaggtgagaaggaggggaaaacagccagacacctggattctccgggcgcgatggctcatgcctgtatcccagcactttgggaggtggaggcaggcagatcacctgaggtcaggagttcaagaccaacctggccaacatggtgaaaccccgtctctactaaaaatataaaacttagccgggcatggtggcgggcgcctgtagtcccagctactcgggaggctgagacaggagaatggcgtgaacccaggaggtggaggctgcagtgagctgaaattgcgccactgcacttcagcctgggcaaccgagtgagactccatctcaaaaaaataaaggaggggaaaacctcattttctaactgccacctcatttctttctttttcagaccctttgcagaaatctgcaatgatgccaaggtgccaggtgagtcagaggtgaagaagccacccttctgctccgtggggactagagactgttccatttgaaaaaaggtagacccgggcgcagtggctcatgcctgtaatcccagcactttgggaggccgaggcaggcagatcacttgaggtcaggagttcaagaccagcctgagcaacatggtgaaaccccgtctctactaaaaatgcaacaattagctgggcgtggtcgtgggcacctgtaatcccagctactcaggggactgaggcaggagaattgcgtgaacccgggaggcagaggttgcggtgaactgagatcgcgcccctgcactccagcctgggtgacagagcaagactccatctcgaaaaaaaaaaaaaaagaaagaaagaaaaaagcagagacaccaggagttggaggctgcaatgagttatgattgtaccactgcactccagcctgagcaacggagcgagaccctgtctctaaaaaaaaaaaatttcataaaaaaattttttaaaggcagaaatagatgtggtccaggtgggcatgcaatagatggctgaccaccttgagaaaaatatagcccctctccacgctggggcctccccagggagcctgaggtctccatgaacagagccaggtatccccaagaggcctccagaaacctgcaggtgccctgcagaggggaggccttgccatagcaccagtgagtgtatgaggtcagctggaaggacaagaggcaggctgggcctcagggaggatcatggagtcctcctgggtagcagaggggtagcacgtgaccaacagtggtgaggcaggcaggcattgcccgagactggccagaccccctctgttctgctggcatctgcagggtatacagaacctttcactaggcacctgggggccgcctggcatgatggttctgattaaggtgtatgatgggacttgggagaaagtactcccgggtgactatgatgtgcacctgattaagaaacactgattgggccaggcgcagaggctcacacctgtaatcccagcactttgggaggccgaggcaggcatatcacttgagatcaggagttcaagtccagactggccaacatggtgaaaccccatctcaactgaaaatagaaaaatcagggccgggcgcggtggctcacgcgtgtaatcccagcactttggaaggctgaggtgggtggatcacctgaggtcaagagttcgagaccagcctggtcaacatgctaaaccctgtctctactaaaaatacaaaaattagccaggcatggtggcacgtgcctgtaatcccagctacttgggggctgaggtaggaggatcgcttgaacctaggagacagaggttgcagtgagccaagattatgccactgcactccagcctgggcaacagagcaagactctgtctcaaaaaaaaaaaaaaaaagaaaaagaaaaaaaaaattagcctggcatggtggtgcacgcctgcagtcccagctacttgggagtctgaggtggaagaatcactttagtccaggaggcagaggttgcagtgagtcgagatcacaccactgcactccaggctgggtgacagagcaagactctgtctcgaaaagaaaaagaaaaagaaacactgattggccaggtgtggtggctcacgcctctaatcccagcaatttgggaggcctaagtgggaggactgcttgagtccaggagtttgaaaccaacctgggcaacgtagtgagatcttgtctctacaaaaagttttttctcccatccaagtactaaccaggcccgaccctgcttcagttctgagatcaggcaagatcgggtgcattcagggtggtatggctgtggaccaaaaaggtttttctaaaaattagccaggcatggtagtaggcacttgtagtcccaggaggctgaggctggaggatcacttgagcccaagagtttaaggctgcagtgagctatgattatgccatcctgcctggatgacagaatgagaccccatctcttttttttttttccgagacagcgtctcactctgtcgcccaggctggagtgcagtggtgtgatctcggctcactgcaacctccgactcccgggttcaagtgattctcctgcctcagtttcccaagtagctgggattacaggcgcctgccaccacgcccagctatttttttgtatttttagtagagacggggtttctccatattggccaggctggtctcgaactcctgacctcatgatctacctgcctcggccccccaaagtgctgggattacaggcgtaagccactgctaccggccttttttttttttttttttctttcaagacagagtctcactctgtcactcaggctggagtcaatcttgcgatcttggctcactgcaacctccgcctcctgagttcaagcaattctcatgccttagcctcccgagtagctgggacttcaggcatgcaccaccacacccagctaattttttgtatttttagtagaagtgaggtttcaccatgttggccgggctggtctcaaacacctgacctcaagtgatcttcccaccccagcatcccaaagtgctgggattacaggcgtgagctactgtgcctggccgagaccccgtctcctaagaaataaaaaagaagaagaaagaaaaaatactgatctaatcttaccccacctcattgtacagctgggaagctgaggcacagagatgcccagggacttgcccaggccacatagtgagtcagatgctgtgtagaccctgctctcaggaccacccatctgaaccatagaccaccgtgggccacacggcccagtatggctgctcaacagggacagtgataggattcagcaagtccacgccacaaccttacctgagacccaaggccctgactcctgtcaggaccaggttcacctggaactccacagcctggggtggcacagcccagctagaagccacctccttccatcaagagctagtcacaagcctgggccataaagtgagaccctccctccgtctctgcaaaaaaattaaaaattagccaggcgtggtggcgcgtacctgttgtcccagatagtcaagaggatgaggcaggaggagtgcttgaggccggaaggtggaggctgcagtgagctatgattgtgccactgcgctccagcctgggcgacagagtgagaccctgtttccaaaaaaaaaagagccagttaaaagggtcaggtctggcactgaacacacggatctggaggcgatttggtttactctcaggtcaaaggcagagaggaggccagtcgcggtggctcacgcctgtaatcccaacactttgggaggctgaggcagggaggcaggtggatcacctgaggtcaggagttcaagaccagcctggccaacatggtgaaaccttgtctctactaaaatccaaaaaaaaaaaaattagccgggggtggtggtgggcgcctgtaatcccagccgctcaggaggctgaggcaggagaattgcttgaacccaggaagcggcggttgcagtgagctgagatcacactactgtacttcagcctggggaacacagccaggctctgtctcaaaaaaaaacaaaacaaaacatggcagagacacagaaggccacatgaaagcctcaggaggatttgggacagatgcccagagggtggatactgtcacccacatccaccactccctccaatgtggccatctctcatggtgattcaaggatggccacagcccatggaccagtctgagacagagggtggggcagcctctgacttctttttcatgtggaatctcccacaaaaatccctctgactcatagcctgggctcctcctgcctccagggtcttctctttcgcagggtctctatgcctcaccacagacccccagtttctgacttctccaccagttgaagagacatttgccccatggacccagcctgcccttactctgtgtcattaagacccttccggtgggctgagtgcagtggctcacgcctgtaatcccagcactttgggaggctgaagcaggagaattctttgagcccaagagttcaagaccagactgggcaacatacagagaccccgtctctacaaaaaattagccaggcagggtggtgtgcacctgtagggaggctgaggcaggaggatcacttgagcttgggaggtggaggttgcagtgagccaagaccacaccactgcactccagcatgggtgacagagtgagaccttgtctcaaaaagacaataaaagcccttctttattgggctgggcgaggtttccatgcagtaatccatccaatcaggacgtgctgctcaaagtcttacatcttcacctcaagttaatccagcaaccacagaacacctgctgacccctcctccgtgctgaactaggtgctgggttcttttatgcatgcggtgttttttgagtctcacatcacactggtttccccatttgactcagagaggttcatcagttttcccagattcacacagtgataatagtaagtggccacagtgaaatttgaacttaggacttctgattctaaaccagagtttctttcactggggcactgcctgtctacttggacctgtgaactctccactcaggaccaccatacattagtgataaccatagcaatacaatttttttgtattttggtagagacagggtttcaaccttcaccatgttgcccaggctggtctcgaactcctgacctcagtcaatccacccaccttggtctcccaaagtgctgggattaccagtgtgagccactgcgcctggccccaggtcctctttataccctccctggacaacctagcctgcagttccagcctccccagaactcccagagcctctcctggggtcccacatcccctcacagccttaaagagcccaggaaagaatgtggcctccggagccacgcagacttggccttggagaaagtcctttaacagccctgccccttcgggtgctcgtgagtgaaatgtgaataggatcttggagggttgctgggaggatcccagcagacaatgtgcaaagcatttagcacagtgcccagcacccagaaaatactcagaaactgagaatgcgattaatattgttgccatgagccaggcacggtggctcatgcctgtaatctcagcatttagggaagctgaggcaggaggattgcttgaggttgggaattggagaccagcctgggcaacataatgatgcagaaatacaaaaagttagccaggcatggtggcgcgcacgtatagtcccagctactcgggaacctgaggtgggaggattgcttgagcccaggacttggaagctgcagtgagctacgattgcaccatggcactccagcctgggcaacagagtgagaccctaaaaaacaatataggccaggttcgatggctcatgcctataatcccagcactttgggaggccgaggtggatggatcacttgaggtcaggagttcaagagctgcctgcccaacacggtgaaaccccatctctactcaaaatacaaaaaaattagctggacgtggtggcagacacctataaccccagctacttgggaggctcaggcactagaatcgcttgaacccagaaggcaaaggttgcagtgagccaagatcgcgccactggactccaggctgggtgacagagcgagactccatctcaaaaaaccagaaagagagaggacctagggcctaaggggtgagcttgctggggaggaggagggacacatggggatgaggatacggtgttagcaaaggcaggcaggccagcaagagcaggaggccggggagagtgggccctcgggcttgctttgggaaggaggctggacatgtgggctctggacaggtgggccctgacccccaggggatcaggagcctgaaatcctgaaagggggactcgaaaccttaagacagagcacttttccagggagctcaggaggctgagacagaaaagcctcagcttccagtgtcaacagccttttcccctccttccagccaaagacagcagcattcccaagcgcaagagaaagcgggtctcggaaggaaattccgtctcctcttcctcctcgtcttcctcttcctcgtcctctaacccggattcagtggcatcggccaaccagatctcactcgtggtaaagttgcaccgatttggactccggcactcatctctgtggccctcacccctctgtctggcagggccgtctactctgggatgtgggcccaggggacggggaggcactgggctttgagtggggaccttccggcctcgggggttatagatgcatccacctgtctcacccaagaggtagcccatccttctcgtggggtactcacaggcactcaggcaggaattcacatcctcgctgggcagatgggccggctgaggtccacctgcccacacccttcagccgcaccagagctggagacatgaaaagacatggctggcgggtgcagtggctcacgcctgtaatcccagcactttggcaggtcaagtcgggtggatcacctgaggtcaggagtttgagaccaggctgaccaacacggggaaaccccatctctactaaaaatacaaaattagccgggcaaagtggggcatagtggctcatgcctgtaatcccagctacttggaaggctgagataggagaatcgcttgaacctgggaggcagaggttgcaatgagccgaggtcgcgccattgcactgcagcctgggcaacaagagtgaaacactgtctcagaaaaaaaaattagccaggcatggtggcacgtgcctgtggtcgcagctacttgggaggctggggcaggaggatcatttgagcccaaggggattgaggctgcagtgagccaagatcgtcccattgcactccagcctgggcaagagaacgagactccatctcaaaaataaataaataggctgggtgtggtggctcacgcctgtaatcctagcactttgggaggccgaggcaggcggatcacttgaggctcaggagttcaagaccagcctggccaacatggcaaaaccccgtctctactaaaaatagaaaaattagccgggcatggtggcgggcgcctataatcccagctactcgggaggctgaggcaggagactcgcttgaacccgcggggccaaggttgcagtgagccgagattgcatcactgcactccagcctgggcagaagagtgaaactccatctcaaaaaaataaaaaatataaataaatagcctctgagaaagctcttccaaaagcagaactaagcattttgggtttgttccgcatcacctggagtcctaatccagtccctttgtccctctctctagcaatggccaatgtacatggtggactatgccggcctgaacgtgcagctcccgggacctcttaattactagacctcagtactgaatcaggacctcactcagaaagactaaaggaaatgtaatttatgtacaaaatgtatattcggatatgtatcgatgccttttagtttttccaatgatttttacactatattcctgccaccaaggcctttttaaataagtaaaaaaagaaaaaaaaaaaaagagtgttgcctttacttttacggtcactgtttcatgttctcttttggatcgtggccgcagctgtcactggggacagggtcaggaaacgcagctcaggtggcctgccaaggccctccttcttcatcacagcagaggtagtgtccaggaagaccccagagctctctgtgctcctgggagcacgtgacctcaagaagaaaagccacggaaggaaaatgtgccacggggccgggcgtggtggctcatgcctggaatcccagcactttgggatgtcgaggtgggtggattgcttgaggtcaggagttcgacctcattggcctgtaataccgatgctttgggaggccaaggtgggaggattgcttgagaccaggagtttgagatgagcctaggcaacatagtagaaccctttctctagaaaatgttaaatgtggcttacacctgtaatcccagcactctgggaggctgaggcgggtgaatcacctgaggtcaggagtttgagactagcctgggcaacataaggagaccccgtctgtacgaaaatgcaaaaatgaggccgggcatgatggctcatgcctgtaatcccagcactttgggaggccgaggcgggtggatcacctgaggtcaggagttcgagaccagcctggccaacatggtgaaaccccatctctactaaaaatgcaaaaattagccaggtgtggtggcgggaacctgtaatcccagctactcaggaggctgaggtaggagaatcacttgaacctgggaggcagaggttgcagtgagctgagaccacgccattgcactgcagctggggcaagaagaacaaaagtccgtctcaaaaaaacaaaacaaaagcacaaaaattagccaggcgtggtggtgcacacacctggagtccagctactcaggaggctgaggcaggaggaggattgcttgagtaaagatggttgaggctgtagtgagtcatgattacaccactgcactccagcctgggcgacaaagcaagaccctgtctcaaaaaaaaaaaaaagtgttaaatatggtaaatgtcagagagggaggggcccatcccagtgaagcactgtggctggatgggaggcttcttcaaaaaggggtttggagaccaggtgcggtggctcacgcctgtaatcccagcacattgagaggccaaggtgtgcagatcgcctgaagtcaggagttcgagaccagcccagccaacatgatgaaaccctatctctactaaaaatacaaaaaaattagccaggtgtggtggcgcgcaactgtaattccagctacttggaaggcagaggcaggagaattgcttggacccaggaggcagaggttgcagtgagccgagactgtaccattgcactccagcctgggcaacaagaatgaaactccatctcaaaaaaaaaggggggtggggtgggggcaggacaagttttcttttttcagaggcaagttctttctgtgtccccaggctggaatgcagtggcacgatcatatcttcctgcagcctcaaactcctgggctcaagtaatcctcctgcctcagcctccagagtagctgggactacaggtgtgagccaccacacccagctaattttttgatttttttgtagagatggggtcttgggttatgttgcccaggctggctgcaaattcctgggctcaagccatcctcctgccccagcctcccagagtgctgggattagaggcgtgagccaccatgcccagcctgggatgattttggatagagctctggatacctgacaagcagagtgatggggtcccagctgtgtctcagaaagaccactttaggggcaggtgggaagttgaaggaagggacaagactgaaggcagaaagacaagtcacaagagcgtggcaggcgtccaaggcctggcacccagtccctgcttattgggtgacacatatttactgagccctgcccttctggctggggaggccaagcagctgagtgtcct

SEQ ID NO: 12522 - DNA, 19009 bp, Human
  misc_feature (1)...(19009): n = A,T,C or G
atgtatttaacagtgcttttctaactagtgcatatcaaaatcacctggaggtcttgttaaacctgatccctggcctaactcccagagattctgatttgtgggagggacttatgactttgcctctcaaacaagcccccaaggcatgctgaagctgctggtccttatactgcattccaactagtagtggtttaacaaacaccagatcatgtgatgttatttggaaatgtgataaacaaggaaacaacaaaacaccagatcggtgcttactggtgccacaaactattctaagtaccatataaatatcaactcctagtcctcacggccatcctatagtgtagagactcttaccatgctcattttacagatgaggaaacttgaagtacagagcagctaagcaacttgccctaggtcacttggctagtcagtagctgaggcaggacccatgcatagctggaacctgctgtgttcccactagaacccagagcgcatctctgtgactttggaggataggcatctgctgctccgcccaagcctggcatgacccctggaaaccactccctgagatgctgcgattgctcagctcctcagatgtcccaggcagtgatgtgacaggaaaggaacagcaggtgcagagtctcaagagggtctgccaggtataccagctgcttaaactaggaactgcaaactcagatgcctatggtggccagactctgagagattctagctagataccggaaaatatttttcgtaaagccaatcatctcagtctgttattccccccacccccgccctttatttttttaaagagatgggagtctcattaggttgtccagactggcctcaaacacctgacctcaagtgatgtgccttcctcagcctcttgagtaactgggattacaggcatgaaccaccatacccggctatttccccccgtgtgatagatgcatgaagcaagaaatcatttacttttaccttatctccactgtaagaagaagactatatgtcttatatatagaagaatatatgtcttatatagttaatacttggtttcctttttgaggagtagtaggagtgtagaggctaaagtagactggcctgtccataagaaatacccattactcaattccagccaatttttaccacaacaacaattgagctagaagttcaaatctagatttttatgtgttatctcttgatttttaagtattggtaactaattataaaaatgcatttgtaggctgggcgtggtggcttacgcctgtaattccagcactttgggaggctgaggcgggcagatcacctgaggtcagaagttggagaccagcttggccaacatggcaaaaccccatatctactaaaaatacaaatattagttgggggtggtggcgtgtgcctgtaattccagctactcgggaggctgaggcaggagaatcacttgaacctgggaggcggaggttgcagtgagccgagattgtgcccttgcactccagcctaggtgacagagtgagactctgtctcaaaaaaaaaaaaaatgcatttgtatacatacaaacatgcacagacacatgcacacatgcgtgcacacacacacacacacacacacacacacactctttctctctctcgctgtcgctctccaactctgttgggctcagaaacagccagtcagtatctggcctcgttagttgggccgtcagtccactagtcccgtagtcccaagcattacacaggcagctgctgcgcaagggtaggcccactcttctctagaactttttgtttaaaaagcaaaaaacaaaacaaaaaagcatgagggatacaagaggctttgctgatttttctgtgggttcataagtaagcttgccctttctgtgagtgtgcccatgtgacaggcaccaggaggcacttgggtggggtcaggggagcaaacagtagggtcactgcctctgggcagaagtttacgactggggactcacctcagctcactctgtccctcccccaggatgtccatgaggagccccatctctgcccagctggccctggatggcgttggcaccatggtgaactgcaccatcaagtcagaggagaagaaagagccttgccacgaggccccccagggctcagccactgccgctgaacctcagcctggagacccagcccgggcctcccaggatagtgctgacccccaagctccagcccaggggaatttcaggggctcctgggtcagtgtccccgccctgcctccatcctcacacccatgcgctgtacctgggctctctgctcggctgggcaggcccactcccctagatggcagcagatacaggcagaagtggtgatcctaggggtaagacgccatgtagggaagcagggaggcactgccaagttcagtctgaggctggaagcggggtcacctatcagagcaggacctagactcatgcctgtacttactcgcttgatagtgacagttcacctatgtgtgacccagtccttgcttctgaggactagatggggagatgggacacacatgctaaagtttggctttaaagtaatctaccagatttttcagatgatttgggaaaatcaacctgattacacaagcaagaattaggtcactgttaaagatgatacggttcttgacccttaaaaaaacaagagaattgagctgcatgattcataaggattcttgcagctcctaaaaattctgatttcacatatgagatgtaaaaaggtgatatataattaaaatccaaataagtgaaaatgaggagagttatgggctctaagaaagaatccagcctggaggaaggaggtggggggtgggggcactggtgatcaaggaaggcttcctggagaagtagagcctcaagctaggccttaaaggatggggaggactttgatgagaagaggagtgaggcaggcagtggggagtgtgagtaacttttgccagcccctacctgctcccctatgcagcccagctggtgtagtgggtatgttcaagggagtgataactaatagctgacttttggcccctgattgtaatggcaaatctcattcacatgcattaactcccttgatcccagcaacaatcctgtgacagaggaggtattaatatttccattttcaaaagagggaagtcaggttcagagcatttcagggacttgtgtgggatcaagcatcgtgtgagtcactgagcctggactgaaacccaggtcttttgttttgaaatcttctgttcttttcctaaacaaagcttgggcaggtggaggccaaagggacctagtgagtggagaagtaggacttggatagggctgggatccctcagggtacacatctttggggtgcccagccctccctgcagcctgtccccttctcttgggggttatggtgacaattcagtatgtcttgcaggactgtagctctccagagggtaatgggtccccagaacccaagagaccaggagtgtcggaggctgcctctggaagccaggagaagctggacttcaaccgaaatttgaaagaaggtaggatgtctgccctagttagaagcagaggcctgaggcagggaggtgttaagacggttattcctcacccctttgctgtcttccagtggtgccagccatagagaagctgttgtccagtgactggaaggagaggtttctaggaaggaactctatggaagccaaagatgtcaaaggtgaaggcctgttgggggtgggggagatgtttgaaccccatctctcttctcctggtctggccacgcagcctggctctgtagggcagttcttggtacatacctatcctgtgccatctggctcctgcctggccttaggggtcatcaccatccctcgcctggaggccccaagcattaggtctcactcatcccatgcaggagaggcctggtaggaatcaaatcccatgactctgaatctgggctctcaccaggcacccttgtgacttcaggcatgtcattgccacttcccgagtctaaccgcaaaatgagcagaaagttccctttcactctaattaattctaggtcagttggacctcactaagtgagtgaaaagtagttactaatgggctgctgcttgggttccttagagtgatttttttttttttttaagatacagtctccctgtgtcgcccaggctggagtgcagtggcacaatcttggctcactgcagcctcaacctcctgcatgatcctcctatctcagcctcctgagtagctgggaacacaggcacctgccaccaagccaggctaatttttatattttttttgtagagatgacgtcttactatgttgcccaggctggtctcgaacccctgggcctaaacagtcctcccaccttggcatctcaaattgctaggattgcaggcatgagccacccactgcacccagccagaatgatcatttttgcattgtcattgatcacacccacagagggaactttaaaaccgtacagatgcccaggctccacccccacctattgaatgggaaccccagggtatggtaggggcctgggcctctatacttctcaaaggatccatgagtgattccgatgttgtttttttttttttttttaaaaaaaaaaaaaaaaaaaaaggtctatggccaggcactcaggaataaactgctgcatcagacaggagctaaactggaggtcagggggacactaacatttattggttgaggaccatgtgccagatcctggactaagagctttgcatatattagcgcttcttcttctttttttttttttttttttttttttggagagagacagctcgctctgttgcccaggctggagcgtagtggtgtgatttcggctcactgcaaagttcacctcctgggttcaagcgattctcctgtctcagtctcccaagtagttgggattacaggtatgcgccaccatacccggctaatttttgcatttttgtagagatggggttttaccatgttgttcaggctggtctcgaactcctgacctcaagtgatccacctgtctcggcctcccaaagtgctgggattacaggcgtgagccaccacacctggcctctattagctcatttatccctcatagtaaccctctgaggtgattattattatgcccacttaccaagattttgaaaaccctaaagtgcagagaaattggtaacttgcctaacagctcacagacaggatgggttgaaatgggaatttgaccccagacctgtcttgcttcaaagcctgagtgtgtcccactggatccctccgatgggatggttgtccaccctgaccctgtgtggcgctgagcactcgaggacattgaagaggcctggggctctggggctgacatgtcccactgtcagcattttcagggggcctggaattcatggctaataggggagaacttctaggctagtagttgccaggtagcaacatgaagagcccccttcaaggcaagcatcttgtgtcatcatctctgtggctcagcccctaatggtcctgggacatagcaattgctcaataagtttctgatggatgggtggatagatggatggatgtatagatgaacaagtaaaaagtctcaatggggtctgtttcactgtggagcagggacccaagagagcctagcagagaaggagctccagcttctggtcatgattcaccagctgtccaccctgcgggaccagctcctgacagcccactcggagcagaagaacatggctgccatgctgtttgagaagcagcagcagcagatggagcttgcccggcagcagcaggagcaggtaggtcctgttcggtgggtgtagctttctttccaggaaaaggagtgtgtcaggacctagagaaggctgccttagggacaggcctcaccagtgcaagctggggcctgggggcaggctgggcagggtctgtggccaggggctgtaggattcccacctggactgattcatgagcccttgtacagggttaggggtgggagggtatgaaagggactctgcaggaagagcagcttgcagcttcctgcccagcctcctggtcctggagggagggatgagcttcctgcaaaaggagaaccaattctgagggctgactgctttgctccctactgccaccccactccatggcttgccccactgtagaaagcagggtgtggttagggctgggcagactgggcaccagggctaatgtccgtgaccccctctgcctactctttccctctcccagattgcaaagcagcagcagcagctgattcagcagcagcataagatcaacctccttcagcagcagatccaggtaaccggaggggagacccggagaggcacaggaggcagttgagggagttgacaccggcctggagggtgctggggacaggggatgtgcaccaagttaaagagccagagcagaatcactcaggcctgacctgaggagggttatttctattctagcccccaacctgtcttccttccctgattaaagggaggagcccggcatgtcttcctccccagctgagacctgagggcaggtagacaggggcccacagagttggcctagggtcaaagggatcctttggaaaactgtccctgctttatcccctgtgcctcttgtccatgggtccattctctgtgccatgggctgaccatagctgggtagctctttgggtccctggggactcacacagggtttctttgccttcagcaggttaacatgccttatgtcatgatcccagccttccccccaagccaccaacctctgcctgtcacccctgactcccagctggccttacccattcagcccattccctgcaaaccaggtgagtgtgagaagggaggttccaccactgcggccagcctgtcctgaggtcagggaaagcgccctggagccactctcatccattaatttgctatgtggactttctgggcctcagttttggatctgtctggtagaagaatcatcctctttttctgaatcttgctgaatttctctgaacttcactgggagaatgaaaaaccataaagccctttccagatgtaaaatgatgtagcaatccaggtctagtctctccaactctagtacatttactgtgtcagagtattaatatctggaatattgccaggtgtggtggctcacgcatgtaatcccagcactttgggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgcctcattccccacagctcaccctcacacaccccaccactccatctctacttgcccaaatcctgcccatcctgcaggcactagcgcacacctcgggtcccacagggagcctgctctagttaccccagctggagcagagtttgctggtgctctgtctgtgtggccctcatcaccacctgccatgcacttcatgatttctacatgtggcctatctctccacctggatgctgggcctgggagtgaggtagggtaggcaggagtgccatgtcgagaagaaggaaaggctgtggagtctagaggccctgggttcaaatcctgatgctgccatttcatagctctgtggacaacccatttttcttcttatttttatttttttagttttgaaaattttaaattctttttttttttttttgaaacagagtctcgctctgtcccccaggttggagtgcagtggtgcaatctcgactcactgcaacctccgcctcctgggttcaagcgattctcctgcctcagcctcctgaatatctgggattacaggcgcgtgccaccgcacccggctaatttttgtatttttagtggagatggggtttcaccatgttggtcatgctggtcagggtggtctcgaactcctgaccttgtgatccacccaccttgtcctcccaaagtgctgggattacaggcgtaagccaccacgcctggcttcaattcttaataatagagatgggggtcttgctatgttgaccagattggtcttgaactcttggcctcaagcagtctttctgcctcagcctcccaaagtgctaggcatgagccaccacacccagccccatttgacttctaaggttttcatttctttttctgtaaaatgggatgatgatgtattcagcccctgttatatatcacataccatgtattattgtcagatgatacatatgagacgttctacacaacaggcagccgcttttgtgccctgtgcccagtaggtacaaaataaaagtagctgttggatgaataggtgttttaccctctctcattgtgccattggatgggactctagaatctgggaaactctatttagagtgggttgggaagggcgggaacccagtgaagatgccagtcagtgtgcaggggcagtgtggagtgaggggataggagcctccaagcagtgctttggggctggggagggcagtggttggaaccaagctggtccagtgccgagccattgcccatcttgtggtgctgggacctcgtcaagcagggtgtctgctgttctgtgctcatccaggacttttctccttgctgccttttccatagtggagtatccgctgcagctgctgcacagcccccctgccccagtggtgaagaggcctggggccatggccacccaccaccccctgcaggtaccgccctctacccactggcctggggctccctctcgagcttatgacggccggctgccgtgttagggaactgcggggtgtggactggtgagccctggcatcctgtgttcttgttcacccgctccttctgcgtccacttttctgtctgtctccttgtgtgttctgggtatgctcacctcacttcctctctgtcctgctgtgggagtgtcctttggtgtctgtcatcctctgacctgctgggtctccctcaggagccctcccagcccctgaacctcacagccaagcccaaggcccccgagctgcccaacacctccagctccccaagcctgaagatgagcagctgtgtgccccgcccccccagccatggaggccccacgcgggacctgcagtccagccccccgagcctgcctctgggtaagcctcctgctgcctgcacttgtccctcagccctcttaggggagagccggcggcatgatgcgaccttgagcaggtcccttctcctccctgggttccagattttatcaaatgaggggttagacttgctcttagcagaagatccccttcttcctctccctcatcatatctgtctgggcattccaagcatcagggattcaggccagagtcacatagttccagggggtactgttgtcatttctagtctattgacatgcacaataactagccagtgtaagtggcatatccctgaggacatgcaatgcagccgccctgtggaagaacaggagggaacactaactcaggtgcctcatgggagggcatggcgggaagctgatggagtttgggctcatgctgggctgatgccctcagcttctctcgcttctcttccctctcttctgccctctcccacaggcttccttggtgaaggggacgctgtcaccaaagccatccaggatgctcggcagctgctgcacagccacagtggggccttggatggctcccccaacacccccttccgtaaggtatggtcccccactcccttgagcctaggggcagcaacagatggtggccaggagtggaagacacagtctgaggccaccaagagaggagcatggggaggagtggggtgatgcagaggaggctgatgtcaggttgcccctgtcaacctaggacctcatcagcctggactcatccccagccaaggagcggctggaggacggctgtgtgcacccactggaggaagccatgctgagctgcgacatggatggtgagggctcaggcgcagggctgatgcgcaggagggcccaactctgtattccaccagggccagggctgtgtctgcctctgatctcttccctcccttggtctgttgggtcctttccaggtgtgtgtgcctctgctgtcccattatgtgtctgtcggctctgtctctgagtctgctttcctaagttttgtgactgctgagtttctgctctctcttgaggccataccgctgtgattttcttgtgtgtctgtctctggttccctggctgggcctctgcggataatttgctgtttcttctgccccatctgctcctgccttgctcctcctcggctggctgctgtgggagcctcctcagtgcctcctgctggtcaagtaggggacgtctctctgctggccctggggcactctcctgaccccagacaggctgcttggctgacttcactcctgtctcccaggctcccgccacttccccgagtcccgaaacagcagccacatcaagaggcccatgaacgccttcatggtgtgggccaaggatgagcggaggaagatcctgcaagccttcccagacatgcacaactccagcatcagcaagatccttggtaagggccagtggctggggccatggttcagtgtgacctggttgcaggagccagctgggtctattcagggcttgcttggtgatattccatactgtgttggactccagtggaatctgacgacaggggtgcaggagttgctggggatgtgagggcagctgggtcctggggtcttatatcactgaagtgttcggtagcacctgtcctcaagaactcaaggagtgtgcgtgtgtgtgtgtttacattctttagtactcctgatctaaacctaacctgttccactgtttgtccagacccttgctctggcagaaaacaggagagactagtgttcctgggctgtcactagaaagatttttttaaattatatgtcctgattggtggccacggagggatgttgggcagggcagatggagctcgaggggccagttgttttcaagactgaggctcctccagtgtcagcgcaggactctgtcaactgagacatcaggtattttgtcctgagcagggagcctgtctgggttgttgaaggtctgaggtggctgctcttttgtttatgcaaatcaggcaggccagaggctcaaggaagttgctggattgttaggaacatgggtgggtactgagtcttaagctggcagttggatatccctatacaggccaacttcattcatttgcccaatatccaaggagcacccgtatcgggccaggcccttgctaagtgcttgcacatatattatcttatggacccacctggggatcaaggtcttctcaggtcctgcatggggctgggggtggtcagcagagcccagcactgactgcctgcccctggggggttgggtcaggatctcgctggaagtccatgaccaaccaggagaagcagccctactatgaggaacaggcgcggctgagccggcagcacctggagaagtatcctgactacaagtacaagccgcggcccaagcgcacctgcatcgtggagggcaagcggctgcgcgtgggagagtacaaggccctgatgaggacccggcgtcaggatgcccgccagagctacgtgatcccgtgagcaggcccccccgcaggcagccaggagactgtgtgtacatgtgtagctctcatgagtggctgggtgtcagtgtgtggcctgcctttgtgtgtgaccccaggggtgctgtgtgtatgcgtacgtgtgtgtgttatctgtgtatagctgagcctgcacgtgcgacccgactgtgtatggctatgtatgtgactgtggtgagcactcagtggctgaggatgtaggaatgtgactggaggactggccacgtggacctggagaaagtgcctgtagatcccacggccgataaactcaatagaaattcagaggtgctagaaatcaaagtattcatcacacagaaaggttcctgacttgactaaagcaagcaccctagtctattcctttaaacaggacatctcccagggcatttaaaatatacaatttctgcctggtatagtgacacacgcctgtaatgccaacactttgggaggctgaggcaggaggatcccttgagctcaggagtttgagaccagcctgggcaacatagtgaaacctcatctttaaataaaattagccaggtgtggtggttcacacctgtagtcccagctactcaggaggctgaggcaggctcaggaggatcacttgagcctgggaggctgacgctgcagtcagctgtgattgtaccactgttctccagcatgggtgacagagcatgaccctgtctctaaatataagtaaacaaaacataaaatatacaagttctaaaaactggattcacacatgatcctccaagaatattatctgttgaacacatctatggccctaggtctgcaggtcatctgcagggtcgtaggtgccagtgaatttggccatcagaaagcaggctgggggcagggtatataagtcacagccaagagtgtgtggagtgggagtgcacgctctgaggaggcctggaggggagatgggtttggggttgaatcaagtgtgcatccatcaccgttccccttctctgccccacagcccgcaggctggccaggtgcagatgagctcctcagatgtcctgtaccctcgggcagcaggcatgccgctggcacagccactggtggagcactatgtccctcgtagcctggaccccaacatgcctgtgatcgtcaacacctgcagcctcagagaggagggtgagggcacagatgacaggcactcggtggctgatggcgagatgtaccggtacagcgaggacgaggactcggagggcgaagagaagagcgatggggagttggtggtgctcacagactgatcccggctgggtgggcctggccccttctcctctggggaagaccttgtcccaactcgatgggcacagccagccaacctaagactatgttggtacttggacttgttcgtgccccagagatgggcaaagctgtgcacttgcagatacattcatgaggggagaggcgccctcccttcctgaggagctgttggcctgggtgggcaggaactgcagtatggccatgggctgagcaggctgagcacctcagcctttagggcttatggccaggggacactgtatgactctcctctcctgcaggtgtctatccacctggggtatggcatctaccgacctgtctccctggggtcacatgctttgtttccattcttgtcctggctggaccagccactgtgggaccaacacccctcccacactcccccagactgctcgtctatcaccaggatcgctttgtactttgtgcaaaagggtctggctgtcccttgctgttttcatctctgccaagcctattgtgcctctggctgctgtatgtgtgcgcgtgcacgtgtgtgtgtttcatctgttcattcactgcacaagatatttattgagtgcccactacgtgccaggcactgttgctgagttcctgtgggtgtgtctctcgatgccactcctgcttctctgggggcctctttctgtgcttctctttgtccccaaattgctacctctttgtcagtctgggtgtctcaggttctgtgtgtccttgtgtgcatttctgtctctctctgtcctcgtctctctgcaaggccctctatttctctctttcttggtgtctgtcctttgccccctgtgccctctggattctctgggtctatgtaggcccctggtctgccctgggctcatcagccttcctgacctcctcctgccctccccttcactccctccctggctctgccagtcggttcccacggagccatttttagctctgatcagcatgggaatgtgcctcggcctccaaggggctttgtcctggtgcccccgcccctggtcccaacctgatcccacgagggagttgggacaggaggattgatggtgctccccttcctgccagcgtcagaggccctggagaggggctgtccatggcagctggtctttattcctccctcatgagcacagggtcgggggggtccccattcttggaagaggttgagaagactcctgggcttcagcctctcccacccagccctgcccctcacctgcctgccctcccctcccccactctatactagggactggatctcagcctctgatcagtttcacaaagtttgttccctaaggaaatcaaatcccattgtcacctaactctgaagatctaaatagcccttggatcagtacgggaaccccaaatcccacagggccagatgtggagtctgtgtctgcccccgtcttctctccatcctcaaagcccccacttctctccaggctgtttctttttttatgactgtaaacatagatagtgctttattttgttaataataagataatgatgagtaacttaaccagcacatttctcctgtttacactcgggggatttttttgttttctgatgacataataaagacagatcatttcagaatctggcccttgtgcaggggaggagggaggctggcctaagtccagaattcccaaatatgccaccagcctgggcaccactgtcccctggtggcagcctgcaggagcttcaggcctggggcctcagaggaattggcttaatgcaagggaatcccaggccaagcttgtgagtgacacatttcctccacagagcccacgctgaatgcccctaccttgacgaggtgaggccacccggatcctaagaaagaaggcagtagtaagagcactgtaataggagtcatgaagctcggggtctctctagaactggccacatggctggggttggggagtgggagccaggtctctcctttggggcctcattgtcctcatctgacaacaagattaaaccttatacctggttcttaccattcagagaagtagccctttgagactctaatgaaagctgtggatccttttcttagaaaagggcccacaaaggtttaccctgaagcccatctgaggcccctacgatgctaattaatgaagcagggtctctaatgataatgcttcagggctctctatccatgacacatgctttgagtgaacacttcagacctagttatcccattaggagaagtaataggcctgcaagggctggatgacagactgaaacacctcaaaaatgcatattaaccaggctctagagagacacatcttgtagtgaaaaattaatcccatcagtatagagtggggacagcaaaaccgaatggcagtagttcttgtggaagagttggacttgggctgcattaatagaggcttgtgttcacaacaggggaggtgatggtccagtgtaccccacacagacctagtcccaggggtagcgtgcccttcctcgccccttcactagggaagtctcacaatggaggggccctgaagcaggcaccccacatggaggagcacaggagggatcctggtgcacattgtccttagaggaatagtcagaagggtcaggtgtgtttcctctagaaaagaagacagagttggacagaaaggacaagattgctttctccaaaactgccaggtgggcaaagtgtagtattgcacaaagttcatgaggcagaacttgagctcctggatgaggttcaagactgtcttgacataaagaacaccttttccacaaaaaagagtgaacttcccaactcaagtcctcaagctcttgagtactggtggagggatttctagattggagagggtagtggtgagagagggtaggtgtggtggttgattctagggccacaaagttgggagggtgtggaatggagactgcccaagaattaagggcccagccatttggtatggggagcgtcctgaacgctggctggctgttttttccccagcccgggttctcagagcctcctctccttcgccctccccacgccacgtctggaaaagatgcaggcagaggtgggaggaggagctggcgacgcgctgacccctcggtggtcacgatggagagctgcccattgcacctcccactcccctcagccctctgccctccggcccttcgctctccgccctcctctctcggcccgcccctgcgcgtcccggcctcctccactccactggtgggtccaaaccatgtcctgccagtctcaagactctcccagcctggctcattcccacctgtcggtcctgagttcctcttccctcccgcaagtcctcttgtcttgcctgccttattccctctgctgagacacagttgcgggtcctggagccccacccctgtctcatgagaggcaggatggggccaggtggttggagaggccaggagcagagtgctgtggtcattaccaggaaagctgggctacaagttcgtcccctccgtgcgtctccggcagagaccgaggggcagagcccgttgggaaggtgaatgtgcccaggagtcctttaactagagctctttgctaagagtcctggaaggggcccgagggggtggaacccggatcacactgggaggctccca

SEQ ID NO: 12523 - DNA, 45693 bp, Human
  misc_feature (1)...(45693): n = A,T,C or G
gcatctgagaacttcactttggtatctttcacatgcttcagaataggttcatcatgtttctgaagcatatcactgagcaagtcaacattcttaaaaacaggtaaccaaaattcaggaattcctttggggtcttctttttcttcatcgtttttctcatcttcagtcttggccttttctttcaactcctctgaaatctcatcttcttcatctggtttccattcacattcttcctctgtaggttcataaattgtattagtaatctcagattgcttatcaaatagaggctgatagagaacagcatacttcctttcaagatcgtgaacttcctcatagaatttggcttctatctgtgcacctttaacttgcaggtttttgagagcattcactcctcttttaactaccctagctaggcaggttgtcaatgtctgccatgttgtaagaactccaaatatcagtggctactatgagaagccaggcggctggagctgtgcaggcagtgactcagggcagcagtggtggtggggaggagcaagaggcagcactgcaagcagatggcgctaaaaaaagagaccctatctctgaaaatggaaaaaaaaaccactcttaatttcaccaacctgagataattcctaaaatttggcattgacctaggcatttttgtatgcatctacaacacatagatgcctatactacatgtctttaaaaatcagatgctatacctatcttggaatcatttctcaaatcatgtaacaaataactttctgtctcatacattatcagtctgaagatttgcatagtattttactttttagatataccctcatttgttaggccagtctcctactactggatagtttgttttctgttatatacacatataagctgtgatggactacctgcatctgtctttggggctttgtgtccaagtaaacactgaggataaatttgtagaagtaagtttattagattaaaggatataacatccttagaatctttcattacatattgcatattgttagcatattgtactgttttactaccagcaagaacatccatttctctacaccctcattagaacacctttttattttgaaataattatagactcacaggaagttgcagggtgatgtacagggaggtcccatgcaccctccactgtgtaccctttcccccatctcccccactgttggacatcttgcataactatagtacaataacaaagtgagaaaattggacatgggtacaatccacagagcttgttcagatttatacgtgaatttgtgtgtgtgtgtatgtgtagttctgtatactttagtgtgcccaagatggtcttcatatgagtcaactccgtaaagagagtatttatcagactaattattggttatatgtacggcatattgagaaaaatagattaccacaaatgggcctttgaagagtttagtgggtaaagtaggtcaaggtaatactgggcttgattaggctgcaaaagtataacttttatttaaatacttcttattgttagatataattcatattcagaaaagtacatacagtgtatatgcacactttataaacagttaataaaccaattatctgtgtccacctaatcaagcgtttcagacactgaagagagaccatttacatttatttcagggtttgggagaactccacatttaagaaggcatttgaattgggctctgaatagaatttgagaaggcagtaatgagagggcattttaggcttggcaacagcaaagaataatgcaagaataatgtttttggagaacagcaagtatagtgatgggacataataggagataaggcaggaagggtgtctaggaacaagactgtagatacgaagttttttctgtcttgctctgtcgcccaggctggagtgcagttgcgcgatctcggctcactgcaacctctgcctcccaagttcaagtgattctcctgcctcagcctcccgagtagctgggactacaggcgtgtgccaccacgcccggctaattattttttattttttatttttattagagatgaggtttcactgtgttagccaggatggtctcgatctcatgaacacgtgatccacctgccctggcttcccaaagtgctgggattacaggcatgagccactgtgcccagtccccctttttttgagacagtctcactctattgcccaaactggagtgtagtggcgtgatctcggctcactgcaaactccacctcctgggttcaagtgattctcccgcttcagcctcccgagtagctgggattacaggcgcgcactactatgcccggctaattttttgtatttttagtagagatggagtttcaccatgctggccaggctggtctcaaactcccgaccttgtgatccgcctgcctcggcctcccaaagtgctgggattacaggcatgagccaccgcgcccagccgaaattcttatctattaagcaattactcattcccctctcctccctccagccctggtaacctctaatttaattaattaattactttattactttgagacagagcctcactttattgccgaggctggaatgcagtggcacagtttgggccagtctctgcctcccaggttcaagcaatcatcctgcctcagcctcctgagtagctgggactacaggtgcccaccaccacacctggctaatttttgtatttgtttgcatttttagtagagactgggtttcaccatgttggccaggctagtcttgaactcctgacctcaggtgatctgcccacctcagccttccaaagtgttgggattacaggtgtgagccactgtgcctggccgaatttactttctgtctctgaatttgcctattgtagatatttcatataaattgaatcattcagtatttgtccttttgtgcttggcttacttctgttagcataatattagactagtactttttgcctgagctagtataaaaaagtactcaatagtgattgtaaaaatagagaggaagggatgatttggggaggcattataaaggtatttgtagaattcagatggacttgaatttaaaaaaagataataccagggtttctagttattaaacaagataggaaacataaggtgctcagtaactatatcaagagatttaatttgtctaaggctgggcgtggtggctcatgcctgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctggcccttctgcagtttgcttgttatgacctaataactataatatcgtagttgcttgctactattctgtgggttgctgctatccacacaaataaaaatgctgaaattggcagaaatatgggataagcatttaaaattgccctcatgcctctaattgttggctgggttttttgttttttgttttctttctgatcactaaaagtgcatttgggtccttggctcaggatggtgaaccccgtggaggtttactaagagtacaaaaccatccttggaatgtaagtgctgctgcttggttgtttctttagcaaggatagccctcagattctgatgtctaagactgaatttagcccagaatcattggaccttcattttaatagaccctttttacccagttctggactgataagtgctgttctgatacctgagatttgttaggacagcacataataaagggctcaagtttattctctctgtaagactcagtggtgtggtggctcacacctgtaatcccaacactttgggaagtcgaggcgggtggatcacttgaggtcggaagtttgagaccagcctgaccaacatggagaaaccccctctctactaaaaatacaaaattagccgggcgtggtggtgcatgcctgtaatcccagctactggggaggctgaggcaggcaggagaatcacttgaacctgggaggtggaggctgcggtgagccgagatcgcgccattgcactccagcctgggcaatgagagcgaaactccgtctcaaacaaacaaacaaacaaaaagacttagcaattctgtagagggctggataaattaattttaacttttcttttttattttcctcttaggattttgaactacatataatattttaactaggtgctttatagttaaggctaatcagtcactacctcaggtccttagatgtatcctttacccaaataagttaacatctttaacttatgccttgttacgaacttattttcttattgttgaaaatgaactaaaaaagtgacagggaatagtggatgatctgaagttttaatagcaaagttgcataaagtgttggaatttagatttgcattaggtagatgactatttttccctaagagtaaaatacttgtagttactttaatgttatttttccctcttagaaatgcagttttagatgctgaaatgtaaataattttaaagctagagtaaattattgtttggcataagatttatcagttggaatataattatcaagtaatttaggcataagtttcctgtactttttcggtattgtctgtttcataagttttatatataaatttctcaaagtaaaatatggttgatgtatttttgtatatcgcctaacttactttttttctaggtccataacttagtggcaattgaactggcttatatcaacacaaaacatccagactttgctgatgcttgtgggctaatgaacaataatatagaggtaaatataattcttaaatgctttttcacaggtagaaaaatctgttgtaactcagttatatcaaacttatttagcatggagtaactataaaatagacatgtgccacattagtgcctgctgcatgtcaggaaatatgctgaggggattacattgttttcttaattctcaaaaccacctgcaggcattattactttctgcttatgaaattgaaattcagaaagaatctgaaaattcattgatttggtgtgactggctctattttggtaacttatagtttatacaggggaagtgtgtacaacaaagtatttaaaattcttttcatttggctttgaaagctgtgaaggaaacactcaagaattaaccaacttagcataaatttggaaaagcagagtgcttttttcaccactactggggtggctgcatttcatggatcttttctttccttttgattttaatgtaacaaattgaataagatctcagatggagccaaggctggtggacagagcaatttatccagaagccattttttttctctgccgcttttctccaaaaatagtacatttttctgctactccctaattcagtaagacctgagtcccctgctataccaaatttcctcttctgcatatccatggtgagaaaattgtaaacatgcaattcagaagctggaagggatcctgtgttattgacttcaactctggttaaaacagatggggtggccagacgtggtggctcatgcctgtaatcccagcaatttgggaggtcaaggcaggtggatcacctgacatcaggagtttgagaccagcctggccaacatggtgaaaccccgtctctactaaaaatacaaaaaattagccgggcttggtggcaggtgcctgtaatctgagctactagggaggctgaggcaggagaatcaacttgaacccaggaggtggaggttgcagtgagctgagatcgcgccattgcactccagcctgggcaacaagggcgaaactccatcttaaaaaaaaactggggagcttgaggcttacagatagcagttattcctttggtgcttattttgcagggcactattataggaagcaagcaccttcttaacacaggtatagggaactaatttttggttacatagctgggggtgattcctgttatcagaaaaaattccaaaatgcatacatgagtaggcacttcaaaacactcagaaagtaggccagatcacagttatgttaaaaattagcatgtagacacttaaaggatttagttttttttacattgaaactaacatcatgaaaaacttgtgtttgcggtagttctgttacactgacaaggtcatatgtgatatgatttcagattagtatttttctacaaatgaataggtttctggttttaatgactgtgccagagaactttatgtggatattttcatttaatctttaccataccctgagggcagatcatgtcattaacagattaggacactagggcttcaaaatagttggtaagctgtccagttagcaaagcaggtactccacatctgctggggtccaggagcagctcagatcataactggttagtaacagactagggtgagaattctagataccgtggccttttgctttgtatccctgttcaaaatgtacattttatcatgctaattttttattttgaagattgttaatatctatacttttattatctgttattttttattactgaatacccgcccatgaaaaaataaaattgggtcaaatttctgtcaaaaaaaattattacacatgaaacatcactgtgggctgtgtgcggtggctcatgcctgtaatcccagcactttggtaggccgaggcaggctgatcacctgaggtcaggagttcaagtctagcctggccaacgtggcaaaactgtctctactaaaaatagaaaaattagccgggggtggtggatgcctgtaatcccagctagtagggaggctgcagcagggagaatccattgaatccaggaggcggaggttgcagtgagccaagatcacaccactgcactccagcctgggcgacagagcgagactccatttcaacaaaaaacaaaaacaaaatcattgtgaggctttaacttatatttttttgcaagttggactgtgttcatgaaatacttcctacttaggagcaattgtgactttaacctaaatagtttctactttatctgatgctgcctgtgagagatccatcattaattaacatctacagatttctatatcttcataatcttttttttttttttttttttttaagacagagtctcactctgtcgcccaggctggagtgcagtggcatgagctctgctcactgcaacctctgcctcctgggttcaagcagttctcctgccgcagcctcctgagtagctgggattacaggtgtgcggcaccatgcctggctaatttttatatttttagtagagacagggtttcaccattttggccaggctggtcttgaactgccctcaagtgatctgcccaccttggcctccccaaagtgctgggattacaagcatgaggcactgtgcccggccaatattttcataatcttttacctatcttggtgcttggatatagcagatgctcgggacattctaatttgaatttgtcagtttctttagctttgtacaagttactttgataatattagcaaattagaacagtaggcaattgatcagtgtgttaaattagccaggttacagaaaggactagcagttgtcaacactatttcctggaggaagaaatggaacatttttataggataacctcaaccacagatacttcttcaagatacggttttatgaggggagttgtttgagtttaacacaaaggtgttcaggttagagtgacttttaaaggctttgcggagttttctgtgatctctggacttcaaattccacatggttatgttgaaggcttaccacgttccacatttatgtgaggacagtttacatcactgtttcttagtgggaaagggggagaagatggcagtctgttgcccctcatttgagaatccccagtacagggagccactgttactgacagtgtattgtatccttcaggtgtgtgggcagaaaaaaaaaagattaagaagctttgggttaaatgatttcttatttattttaaaatatgataattatggcatgagtcccaacagtgagaggatgtatctgtaagttactccacacttttcaattaacatgaacattttttagtaggcatatatctcaatacttggataatcacttttgttttgcttgtgtttcttaggaacaaaggagaaacaggctagccagagaattaccttcagctgtatcacgagacaaggtaaaaaaatgtttttaatgcatattcccaatacctaaagatagattgatgagctcagaatattactcagtcctaggagtaattttttcttcttttcctccctttaacactccattggaactaactgagtaaaggcatacaagtttaaaatgggttttgagtgatttaaagataatagtattttgaattcactgacataaatgcttaaaagtagatttaagcatttatttaagcatttaagcatcaagctttttaaaaaaattcagtcagtgactttatcaactttgcacatagctgaaatgactcaagattttattataataagagggtttcttggaaaaaacagtatgcacagaacagaggttttaattactagtaataattaaaatagttgtaatactaaagtgtgtataaaaatcttttaccttgaattctttgccagaaaagaatcttattaaataccaaaaataaaaatgaagcttttggatttggatttttcttatgtattcatctgaaggaaacttttaacaaaggtgacaatggtgaaggaaataaggcagaataaacaatctcccatgattattttcatttttcatgttattttacgatttcattacagaagggaaaaattcatttatagaatgttcctgaatgcatttttgcatccttgattttttttcccccctggattttttgcctttagtcttctaaagttccaagtgctttggcacctgcctcccaggagccctcccccgctgcttctgctgaggctgatggcaaggtctgttctgattcttaatctaagcctgcatgccttgttctctggtacaacataatcttctggaaacaatacactgaatagaagaatattaatatgggatactgtgctaaggtcagatcactttagtctaatatatattttaaaattatataacaatgcaatgcatagtttatattgttgacatgcttttgcttgcaatatagaagatgcacacagaaaaagtaatttaaagaggaaattatcctgcactttttgaatttcaacccattggtatttaaattttgcttgttaaattgcatgttttaacatatcttttaacagttaattcaggacagcagaagagaaactaaaaatgtgagtctcttgcttcagaatggaaatgttggtacctttggttctcactgaaacactgtctataccaccattaaagaacctgtttgtgtagtggtatctatctcttgtctgtgttatgttcttaatgttccttttatctaacctgtggaagatggcattaaacgttgttttaattagtaacaataataggctttctcactgttttgttaccttcaagaatagttttaaatttagtattttggtaggaaattcagagatttcctagatttcagagatggaattgtatttttggacatttcctttcctctttaaagatcttgagatctgttcagtactaatagatctaatgcttctttcttatgcttccagttagtttgcacttgttaccctatatatagcttcacatatgcttcagaagcttaagcaaattaaaaaaacaaatggggactgtgagagtttgagactgttttcaattcttgataaccattttagaggaaaattaaataatgtataaattattcagactcatcgctatttcaagattttctgccatttagctcctttccttaattatccagatttaaagttctgaacttcaaataaaggtttataaatgtcttatcttctctcagcccactgtgctcagatattaatcaaaccatctaaatcactgcacaagttttatttcattcatgacgtcacactgaatgtgctctctctccttaagatttcatttggtatgtcattcatgtatagttaacaaacatttaaaaatctaattactcatttttaagttaatgtgtaacataaatatactacttatatttaaatgtagttcaccttaactgacatactaaagacagattttagcaaatattttgattcagaatgatacctcaaactaccatttttctaactgccataatcctctattaaacttatataatccatttttagattgtaagatcttaaagaatacctaaaaaaaaccctcttaaatgttgatgaattgtttttccattataaagtcatttttgacttttagaagtcaagactaatacattttctagaaaacaaggtacaaaagcacttgtgattaatggtagcactagatttctttcagcaaatccttaagagtacagaggttgaggggacttctgttgtttgtcacattccgcatttgaaacaactcacagtgactgtcagcctaagaatagcaaatgtagtcttgctttttgttaaagagttcttacttataccttatggcatttttgttgactattagaaatgtaaattgagaaacatataaactcttaagttcagagacgtaagttcatggaacttttagagtttaacagtgttaatgattacttaagaaattaaactgaatagcagttctttgtgcttttaacgagtagttttgtttttaagggcagcatatacttttcctacaatttagtgtttgaagggtgggagaagaggaacgattttgaaaagttagcgaatgataaagaaaaaaggaattaaatagaacataagttggttgatgccttgcaaacaacttagagcagaacttctttattatttagataggtcagggttccagttatacatgctacctagtgtctccttctgacctcattatctgtctgaataaacttcagatgggtactggatgtatattgactactgtcaaataaaatgaactttgttttagttaaggtcagatatgatgtggttggtatgttttggaacatgttttttcaggttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtggtaagccatgacaatttggtttaggtaataaggtaggtgaccaagttagtaggaaaacgattagacagaaagaactaaaagtctcaaaaacttacataactttcagatgttaaagctgccattttagtgtcacaaaagtaatattttttccccctcatccctatttagccagttcctgttgcacgaaaactatctgctcgggaacagcgagattgtgaggttattgaacgactcattaaatcatattttctcattgtcagaaagaatattcaagacaggttagtattacttaatataaatgacggactttaatacttctggatgattctgtgatctgttttgaaaaatacatgtatttttacaattttaggtttttattctaaatcatcaagtggattttctgatagtccttgggtaacttgtagcaagacccattttgttaacatagaatgactaggacctcatgtatcagctagaaaaagctattaaaaatgagagattcttttgttctatctggctgccacattttgagtcatttaagaaaatctttttcctaaattttaatttagtagtttcattaattattttggctagtaacactgacttgcctttttaatttaacttggttttccaaagtatcaaaacgaatgtcttttactaggaaatatgtgtattttttctcgttcagaatgttttttcatgtgtctagtccctactgcatcttctccttcatgttgcctggtatgtcatttcatgcagtaatagggagaatatacatttagttgtgtgaagtgatctattagaaaatattctgcatccagtttttggtaatctgtcagcagctaagatgaattttactgcacagagtaataaacagtctaatacttcatattgaaataaatgatttttgtctgtagaaccatttatcttttttgcttgtagactttttaaacccgtagcttgtagtagaaataacagttcctagtgttttacactgtgggcctgaagaaaaaaattccatttgtttccttccttgcccccatcctctgcagaaggtgtttttgagatggagtctcgctttgtcgcccaggctggggtgcagtggcgcagtcttggcccacttcaacctctgccttctgggttcaagcgattctcctgcctcagcctcctgagtagctgggataacaggtgtgcaccaccatgcccagctaatttttgtatttttagtagagacgggtttcaccatgttggccaggctggtctcgaactcctgacgtcaggtgatctacctgtcttggcctcccaaagtgctgggattataggcgtgagccactgcacccggctcacttaatgtttttaagcctcatccatactgtagtatgaatcagtatagtcacgcaccacataacattttagtcaacagaccacgtatttgaatgtgttcccgttagattatgataccatgtttttgctgtacatttcctatgtttagatacacaaatactattgtgttacagttccctattcagtacagtaacatgctgtacatgtttgcagcctggagcaataggctatcccatatagcttaggcgtgtcataggctataccatctacgtttgtgtaagtacactctgtgctgtgcatgtaatgaaatcacctaataatgcatttctcaaagcatatccgtgtcattaagtgacatatcttttgtgtgaataatactagattatgtagatatactgtgtttaagcattcatcagctgatgtttggatttttctcacttcttggctattatgaataaatgcttattgaagagttttgaaataaagatgatgaaaagaaggtaaagtatcaagaattgttgcttttgtttttttttttgagacagagtctcactctgttgcccaggctggagtgcagtggcgcgttcttggctcactgcaatctccacctcctgggttcaagtgattctcgtatctcagcctcccgagtagctgggatcacaggcatgtgccaccacactcagctaattttttatttttagtgcagacggtgtttcaccatgttggccaggctgctgtcaaactcctggcctcaagcagtccacccgcgtcagcctcccagagtgctgggattacaggcatgagccactgcgcctggccgagaactgcttttcttaatgtttaattacagttaagcaaaaatctaaagggcgattatgccattaatgaaatatccaaagtagtagtgttcttacttaactttatttcatgaggttagcatctaagcccaaattgttaaaagtagaattttggctaaaattccataatttggttgtgttttgcagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggtattgtggaccttttgattttttatacttgggtagtagatagaaacatagaaatagttttaaatgcagtttgattcttggatatgtatagtctttatattctagctaggcttgtttcctgttggtacttgataagaatctttttttttttttttttttttttttgagtgggagtctggctctgtcgcccaggctggagtgcagtggcacaatctcggctcactgcaagcgccgcctcccaggttcacgccattctcctgcctcagcctcccgagtagctgggactacaggcgcccaccaccacacccagctaattttttgtatttttagtagagacggggtttcaccatgttagccaggatagtctctaactcctgacctcatgatccgcccgcctcgacctcccaaagtgctgggattacaggcatgagccactgcgcctggccggtacttgattagattctaattccagagaagatattggttagtataaactggttagttataaacctaccacatatatattggaaaaattaccctgcgtaattcagattaatttcataactttataataagcatttaaaattttttttcctttaatgcaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttttgcttcatagcttcataccaacaaaatatatttattagaatagtatgaaagtactggaggagctgaaagaaaaacacccaaggctgggcgtggtggcacacgcctgtaatcccagcactttgggaggccgaggcaggtggatcacctgaggttgggagttggagaccagcttgaccaacatggagaaaccccgtctctactaaaaatacaaaattggccgggcgtggtggcgcatgcctgtaatcccagctactcgggagggtgaggcaggagaattgcttgaccctgggaggtggaggttgtggtgagctaagatcgtgccattgcactccagccttggcaacaagagcgaaactccgtctcaaaaaaaaaaaataaaacaacacccagatagatacacatactccttcagacttacagacctaagctgcatttatggggtagtgatgaggtttagaacatatacatattttgttaaaattccccagatgattcttggtatgaacgactatattataaattttaagatgtacttagaaatccttaagacatctagccccgtctctaatagacaacacatttatattgcagatattacttttttttcagtttatgaccaggtatttatgaaggactattggcagggaaaatatgaatatgttaactttagcttatggcatcaatttactaaggaacaacaggctcaccaactgatgtcaaacataaaaacccccacatcagtctgatacgatatggtactactttgaatctgttactagtaccatcttgacagaggatacatgctcccaaaacgtttgttaccacacttaaaaatcactgccatcattaagcatcagtttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgacactaaagtttgtcaaaaaatgaattcttaacttttctcccagagaaagggagacaaaaggagctttttaatacctaatctactttggaacataaccgtatagagtacgaaaaattttacgacttttttcctaccagattctgacagttcaccaaggtattataacatctccatttttgcgtatgaagacagtgacttgctccaagtaatccaggtagtaaatggctagaatttgaacactaaagccatgctctgctgcctgtaaggttttcaaaagaaatctgattaatcatttcgtatgtgattcacttgatcctcaaggcaacagggatgccattgccttgatttttcagatatggaaatagttctggagaattaatttgcctcatgtttgaagagctgaactcagtcttgattccaaatcctttaagtttgacctgaaaactttccttacctggatactttttgatattctcatatgattgcatatttggtataattggctttatttttggggggttaactttttaatttacctcaagttgcaatctgcttggggggaaaagctgaaacttaaaaccaatttaagtttctaaatttataaaacattgctaccttaggaatccactgacaacaaggcttaatgtgaacagaattatactggaacacaggcaaggaaccagaaaactgaattagaaactttctgaaaagtcacgtactgatttttgtactattatttgtaaagaaactacttactgtaatttctcaaagcaaccatggcctcatctaactttttctcctttttaagaactacatttgctctctgaactacaaaaaaatcaaatttctattcaaagtttctaatactagttttcccatttctaatgtggacactagaggccctgatgattttataaacaactatataacattagtgacatcggtgctccatacctgatagaaaagcagctacaattccttttttttttttttttttttgagacagagtttcactcactactcatgctgtctcccaggctggagtgcagtggcgtgatctcagctcactgcaacctccatctcctgggttcaagtgattctcgcagctcagcctcttgagtagctggggttacaggtgcctgcaaccacatctggctaatttttatattttcagtagagacggggtttcgccctgttggccaggctggtctcaaactcctggcctcaagcgatttgcccaccttggcctcccgaagtgctgggattacaggtgtgagccaccatgcccagcctcacaattccttacactacctctttttcattgttcctcatcactacaaaaaggagagcaggaagggtaagataggaaagcagcatttctttctcttctgaagtataattttaaaaagagattaaccctgaaaatcatggttttctatggtaatcaagctttgtacatcagaaaataaaacatcccattattaaacaaatatttattaaccggcccataaaaataatgaagttactcacactgagtcctagtccattctgtttttctgatttgcataagcaaaggtctaagttctggagccaacccttcagaggtcttgagaatgaatgatgggtaagtttatttggacaaccagaaggacttttcatcacaactgaagccattttataatgtagaaatttctttttcctattttaagtaaggaaagtccattcttgagaatatgttgtccaacaattaaaacactctcaggatttgttacttgttggtgatttatgctgactccgccttctgttatcattcgatacctaaaaaatagaaacgtttagtaagtagagagatccaatcactgttgatctgtcccccaaaaaagactgtttcacttagatttcagaggctctccaattgagaagatttcatttggcactggactgttaccttcatgtttgctctattattaatagattctgcctctctttactgctctttgttttttgttgtttgtttttgaaacacattcttgctctgtagcccaggctggcatgatctcagctcactgcaacctccgcctcctgtgttctaagtgattctcctgcctcagcctccagagtagctgcgattacaggtgcatgccaccacacctggctaattttgtatttttagtagagatgggtttcgccatgttagccaggctggtctcaaactcccaacctcaagtgatccacctgccttggcctcccaaagtgctgggattacaggtgtgaaccactgtgtctggccggaatttacgccttgcaatctgctcttttaaagactccgtctcaagaaaaaaaaagaaagacctaggagaagttgttctaggagcacactgggtaggtgagggctgaacatttcactgaaaaaagagatacttaaactgggagtgaagctaccttgacaatcagggcaggaaacatgggagcagctagaaagaggtgagatctgagaagacagggctacagcgtggctagatcttggaagtccttaagaaagaaaaatggtggttttctctcatctgaatgttaccaaataaaattaagaaaccactactggacatggttttaaagatatttttatacctttatttttgggtagagacggagtctcactacgtccttgcccacacagatcttgaactcctggccccaagcaatcctcccgccctcagcctcccgaagtgctgggattacaaatgtgagccaccatacctggccatggacatggttttataaaactcatcagtaaaatattttctacttaaggccagattcctttcttttaggaagtattattttacgctgtctgctagtttccagatcatgttctatgtttaatttaaatgcaccaaacctatttagcttatataatattaaaaaaaaaaatcagtattacttagagccctggctaaatcagatgtggtgtcatttttagtagtggtaaagcttccagtattagcgaacacactatagtaaagttcagaagaaaacgaaatctgcttccatagtgaggaaaattatttgtctcgctgacatactacagggaagtatatgacaccagcctcaaattcactgtgtgttaaaccagcagatgagggaatcactaaggtggagtggcaggtgatgcaaagggagacaatgggtgctttttccaggcagaatagtctaggactctttaggacacaggcaaacaatccaagacagttgaaagagaacaactataacaaatgtcattcataatcatggccatgatatggccgataaccatttgacttctgtgtgaactcctgcaaaagaggcacctgggggtcttctggctacccaacacttttccttccacctcactgttcatttaaaaatggataagcatcaattatatgctgaattattttttgtgaaaaaccttatttactccttaatacctcataactgattaattaaaatattctactcaattcctgaatagaaaatgcaattctcaaggggattattatatagtttacaataatagtcttatgacgttagtaggttagtgcaaaagtacttgcggttttggccattatatgctcatttcattttcagaaattcagttaatactatagataggttaggtaacctttcccatccccgaatataaaaaggatacagactatgagaggggctgtgttaatctgttacatagggcctctgtttctgcatccctctaaaactgtgaccatatccctaagccgtacactgatgccagtgtatttactgaacatgtccctcaaatgcacttttccagtgttggaggaaagactgactgggttagatataataagagacagtataggagtactgtactattatagaaaatataaagtattttcaacaataagtactctcaggctatactttattcttggactaaactaacttttctaaggaagagatgccactaaagcactatcaggaaaacatcctctctggaaacacatgctgtgaactgtaacattttatttattttttgagacagagtcttgctctgtcacccaggctggagtgcagtggtgggatctccgctcactgcaagctctgcctcccgggttgatgccattctcctgcctcagcctcccaagtagctgggactacaggcgcctgccaccatgcccggctaatttgtatttttagtagagacagggtttcaccgtgttagccaggatggtctcgatctcctgacctcgtgatctgcccgcctcggcctcccaatgtgctgtgattacaggcatgagccacttctcctggccttgtgaactgtaacatttaatggtgaattaactgtaaatctaaaagttaaataatcttaccctcggggaccatctggaatggcatttgctttgcggcaagtatctaggacacttgttccaggatcgagaaaaaattcagaaaatggagcttctttaaacaactcttttaactcctgatcagacatgacctccagtgcatctatgctactgtgataaagggcttgtgtacacctgaaaaacacattttaagagctacatcatataaatgtttattcaaatacatgttctaatacccattaaccaattatagagtgtccaagttctagactaaaagtttttttttgagatggagtctcgctctgttgccccggctggattgcaatggcatgatctcggctcacagcaacctctgcctcccgggttcaggcgattctcctgcctcagcctcctgagtagctgggattacagacgtgtgccaccacgcccagctaagttttgtatttttagtagagatgggggtttcaccatgttggtcaggctggtctcgaactcctgacctcgtgatcagcccaccttggcctcccaaagtgctgggattacaggcgtgagccaccgcgcccggcatagactaaaagttttttaaacatctatctggtataattcataaacttaattcaagataatccttctttccaataaacaggggctattttaaattgctaagtcaaatactgacagtccttgtgataaatgacaagataatcctaaaacatactcctacttttctcatgtctatccactgaataactaactatcaagtgttaatcatactaaactactaccttttagcagaatccaatccttctcgtccatgaacaagctttgttacttctgctgccagtcgtttctgaggaccccgcctttctggctctttgacatgcagctgcatgatatgatcaatctctggaaggggcaggaaagtgaacagcttcaggtacctttgagacaaaaaataaagagttacacttatataacatacctaatttttatctccagctcttctaccctttaaggttatcctgcttacttttaaatatgaaacaaacatacagaaatgtactgaacatagtaggtcccatgcacacatcacccagatttaaggtgttactattttggcatctttgttttcaatttcttttttttttttttgagatgggggtcttgctgttgcccaggctggagtgcagtggcatgatcatggctcactgtaacctcaacctcctgggctcaagcaattctaccacctctgcctcccaagcagccgggaccacaggcttgtgccaccacgcctggctaatttttatattttttttgtaaagacggggtctcctgtgttgcccaggctggtctcaaactcctgggctcaagtgatcctcttgtctcagcctcccaaagtgttgggattatgggcaggagccaccaagcccagcctcgtattttctttttaaaaggaacaaaataggcatagatgaaggccgcagtccaatcacattcccttccttgccccgagataatcataaatctaagtttatgtgctgccatctttcccaagcatgtttttatactttcatgtgcatgtggccataaaaaaaaagtactgtgtaattttaaaaactgatataaatcatcatgctctgcataatgatgtttctgtcaatgatggactacatatatccgcggtccccaacctttttggcaccacgaggcggcggggaggggaggtggtttcagaatgaaactgttccacttcagatcatcaggcatttgttggatcctcaaaaggaatgcgcaacctagatctcttgcatgcgcagttcacaatagggtttgtgctcctatgagaatctaatgcaaccgtggatctgacaggagatggagcccaggtgtaatgctcgctcgcctgccactcagctcctgttgcgcagccctgttcctaacaggccacggactggtacagtccaacagtggttcataacattataataccatagtttactgtactttttctatgtttacgtatacaaatacttaccctcgcgttatcactgccttcagtatttagtacagtaatgtgctgtatgtgcttctaccctgggagcaacagggtacactgtatagcctaagtgtgtagtaggctatgctatctatgtttgtgcagggacactctacgatatttgcaatgatgaaatcacctaacaacacacttcccagaatgtatccctattgttaagtgatatatgactataatatcatcctatatgtattctctttttctttggtgaaatatatataacacacagaaaaaagtacattattcacaaagatatagcttaatgaatcataaaacatctatgtaaccatcaccatggtcaagaaatacagtattgggccgggcgcagtggctcacgtctgtaatcaaatagtgagtttggcagagttgctagatttaaaggtaatatatataaagtaattgtatttctatacaccagaaccagatagaaaatgcaatttttgaaaagattatctaaattctctaggccgggtgcggtagctcaagcctgtaatcccagcactttgggaggctgaggaaggtggatcacttgaggtcaggagttcgagaccagcctggccaacatggcgaaaccctgcctctacaaaaatacaaaaattagctgggcatggtggcgcatgcctgtagtcctagctactcaggagaatcacttgaacccaggaggcggaggttgcaatgagccaagatcatgccactacactctagcctgggcaacaaagtgagacactgcctcaaaaaaaaaaaaaaaaaaaaaaaaaagattatcaattctcaatacatcaaaaccccaggactatatcgtcaaacattctaggactaaatctaaagagaaaaaaacacaattaccaaaattttgtaataaggcatgataatcttccactctgttcttcaaaaacatcttggccaatcttagccctttttatttctatgtcagtgttacaatgagcttgtcaagttccacaaaaagccggtttagatatggttggcactgtactaaatgtagatcaaatccagaactggtatcttggccgggtgcgggggctcatgctgtaatcccagcactttgggagtctgaggcaggtttatcgcttgagtccaggagtctgagaccagcctggggaacaaggtgaaactccaccattactaaaaaaaaaatacaaaattagctgggcatggtggtgtgcacctgagcctgggaatttcaggctacagtgagccaagactgcgtcactacactctagcctgggcaatgggagtgagattctgtttcaaaaaatacaaaaaagaactgatattatttttgtactatgaatatggtctaactctccatttatgtaggtctttattttgctcaatagcatcttttaatattttgcaggaaagtcatataccttttaagtcttaaagaattattcctagattactttgatgttacagagcatcaaaatatttttttcactttttgttgcaggtatatttgtttctcattaattcatattcttccaagagtttaaggcaatttgatttaaggagaaatcatttcttaagaggatctttaaagtcatatttgtgagagaagagagacaaaggaaaaataagggtagtcaaggttaagttgaaaggagtgaaaaaactagaatatgcaggtgataaaatcctaagaacttgctagatacagatcaaaaagttggctctacattttctagccacccactgtttttctgctttaaccaacaaagtgtttaactttagaacacagtaaaaattagtcttctatgatgtaatggtttatgtacagacagaaactacgttaaaaacaaaaaaactataaaatgtacatagattcaatggctaaaattacatcatgagtttatggtgtcagtttttctcagcccattattcagaactcacctttccactgaatcgtccggttgcctgacaaagaattgatacaattcaaatggagatgtcttatctctgtttagccaaacagcgttgccagcagactttcccagctttgctccagttgtacttgtaattagaggaacggtgattccaaatacatcttctccagtcaacctacgcataaagaacaatttcattatgtgcctcaagcacaagtggtggtaggttctactgttcaccttccagatttctttctggttacttgctccaggaaaacttccttgacctcctaaatctgaattcttgttcctcttatgtattgttacagtacttactctattcattctgaacctcatgagtggttccaggcaggttctaggcaggccaaggggaagtgctacataacaatggactagagattttgaaaggctgagtgggaaggagaaaactgggtgaaggggtgtcaggaagagacactaaaggaaatcttctaaacgccttttaaacatgtgctttgctctgttgcacatgagctagccctatccttcacctctctcaagaaaatgctattagacccgcattacttgtcaattatttggagttgaaaaaactttttgagataccaaccaaggactaacactagtttcatggagggtgcagagctaaagcagaggctagctactcaaggaggcccagtcacgttctggtataaacacacaaaagcagtttctctaattagagaggacgacttaggcgaagcaaaacagaccgaccaaatcttcactagtggtctgtttcccttttttttttttttttttttgagacggagtctccctctgttgccccaggctggagtgcagtggcgcgatctcggctcactgaaaccttcgcctcccgggttcaagagattctcctgcctcagcctcccgaatagctgggattacaggcgtgcatcaccacgcccagctaatttttagaatacaccgtttactcttaatacccttaattcagccctttaattcttattagccagtgttattaacgccattatagagccttaatggggataaaaccaacaagagctggaacgaagggcagcaactacaatcctaagagtgaatcacaggctactagtgtgtaaattatttggtcccaggatttccccaaggtttaaaggcacttacttgttgatgaactcatatccggacatgatgttgcctagttgatcagatccgcccagctggaccctgcatccataacgctggaagaggtaatagaagtcataggcctggagcacctggtaaaagaactcggccaagctcatgccctcggggctcttgagccgcagctgcacgctctgccggctcagcagcgtccccatgcggaagtgaccccccactgccgccaggaagtccaccaggtgctgcttctggtaccaggccgagttgtccagcacagtgaagctgccccaggagcgcccatcagtgaaaagctgctggtgattagccgccagggcctcaagccctaggcgcagagctcgcgcgttggctcgcacgcgctctgtctccagcgcctcgcgttccttggtacggccgctcgggtctcccaggcgcgccgtggcgcctcccaccagcgcgatcacgttgtggcccgctcgctgcaaatgaaacaggcccagcagcgcaagtagatgacccacatgaagcgagtctgccgtggggtcgaagccacagtaaatggtttggggaaaactcgccgtgccacggtcgaagagctctgggagctctattttcgtccccgtctccgggaagaagtccttgaacagacctcgagccttctgcgctgccagtaacccctgagcgcccgagtgggccttacgcagccccaagggcaacaatactgagagatttagggtaccagaccaccggccccaggaaaaggaccgcaagatgggcgccgccatcttggtagcggcacgaagggaatgctgggattgcagaggctcccaccacacccacctacttacagctcctagggaaggtgcttcagtgtttttctgcgcatgcccgagacggttacgtagttacggagcttgcgctctcagcagttgagtcccgactccaagtggcgattccgcctcagagccgtcgccttacgttcccttaaacttaatttttccatcagcagtgtggatctgcttatgatagttcctacctcataaggctgttgtgagccttaaaaattaaagcatttggcacataacgcttcacaaatgctaacttgtatttacattttcacgtaaaaagattgtgatgcgcaagttctttgaagtcttggttccatgcaaaaagctgttcacagaggttgagaaaggttaggaattggtttaagttcgcggagagatagggagttgctgctgagacgcaagcaatttcatagtaccgattccctaattgcacctcgtccccagtattcatcggctcttccaggaggtggcagtcttgtccaaggtatagcaagaaaaactcagtgcaataaagtacatgcatcaagtcctgtggtttatttattttaaatacagttaactaggttgggacacagcttagcatgagtggattcaagttagtaatcacatcgtgcagcgtgacaggtgctctgaatactgaccagggatgaggttcttattggcagctggctggcaggtgatctagcttcaaaatcccatgttagagcctgatttctaggaccgctttcaaaatcgtcttaggtagaattccctggactctgagttgggggggagactggtttgcaggagggtaattggagtgtgctcttaagaacaacacctataatggagtgagggaggccgggttgggcggagggagaaagaagttgaactgtgaacaatttgtaatagaggcctcaggcaatccagtaagggctctggagccgggatttcctttcagagtcatcctgaattgaggccagggggcagacctttagaccctcttactgactgctcattaaatgtgggatgtttctggggaggaagcaaaacgctgggttaaggcttttggagagtgagatgtgcaggaagggactcagctgtgagcaataagcaaccaacactcccagcagctgggggattgagtgccttggtcctgtgactgggatctgggccatgttccaaatcattccctacaggacttttccattttttaacgttataaagttatctaacaaaatgaaaacttattttaataattagtttctttgcatgtataattatcagtgaattagtttctcattgccaaatagtaacttcaataggattttgagatactcattcaataggctattaaacatactcccaactgcttaagaaaatagtgtgttcaaaatatcttaaaatttgcaatcataacctgttgatcttcagtgttttttttttttttaagtgtcactctgttgtccacactggagtgccgtggcaggatcatggttcactgcagccttgaactcctaggctccagcgatcttcctgcctcagcctcccaagtagctggagctacaggtgtggactaccatgcctggctaatttttattttttgtttttgtagagacgggggtctcactgtattgcccagggtggtcctaaactcctggcctcaagcaagcttcccacctctgcctcccaaagtgttgggattacaggcatgagctacttcgcaaggccaatctgcagtcatatggtccaccactttgatcagggacagatttcagtaggtatggcaggaaattctcctgagcacacgtaaggaaactcacatctgggccacttgtcacttgaaagccaaaaacccaagagaagagctgtagtgaaagtaaagttagctttattcaagagaccagcaaccctgggggatgcagtgagctagcgttcaaagaccacctctggtttttaagggcaattaagagaaaggatgataaaaagatttttgtgaaacgtgtgcagtctcaggtcggcagtaaatcattgctttcttggtcaatattttgtggctttctgcaggtaccatcagcctattcttattaggtcggtcagcccattcacagagaggctgatctaggtattttcttttatctctgttcaagatcctgtttttctgaggctgattttagtgaatgatctacaaaatcaagcaaagtaataattgtattcaagtaagcaagctttcttctaacatggaatcagtactgtcacacacacagcaaatggtgctttctatttagtaccttaatacatagggcacacatgtgtttctggtgacacacaactctctggcttttacaggtgtgttagtaatttgaaaatcctacttgttacaacagtatgccagggttacttgatgtcagggttacttgatgacctgtgcttaatggagaagaattttgtggataatgagaaatagaaaatttctacctgggattacaatttattataaagtcttttaaaaatagatttgagctctgctttgtctcttaagtttagttgcatctcatgaagaggcagcaaagtctgatatagaaggtggtgtcgggccgggtgcggtggctcacgcctgtaatcccagcactttgggaggctgaggtgagcggatcacttgaggttgggagtttgagaccagcctgaccaacatggagaaaccccatctctaataaaaatacaaaattagccgggcatggtggcgcatgcctgtaatcccagctacttgggaggctgaggcaggagcattgcttgcacccacgaggtggaggttgcagtgagccgagatcatgccattgcactccagcctgggcaacgaaagccaaactccgtctcaaaaaaaaaaaaaaaaaaagaaggtggtgtcacaggaggtgctagatgagacttgacagtagcttaatgacagtaacaagcaacaagtttggaaaatacagtgagatcaattactctctttttataatttgtgttggtattataggggaaattgggctttgtcccaaagacaggagcaataaagaagatgggactttcaaacctttggaattatatccgtggctaaaattttatgggattgcacccatggtttgcatttgggttacaaaaaagtgaccaagttaattcttgctgtttttattggcttaaaaagtgagtgaacaagggttaaaaagtatttttaaaaatatgatttatctcaactgtaataacttgaggttaactggccttgaattagaggcacatgtgttttacagttaccttttcctgcaacaaaatgccacataaatgttctctttgaagggatccctgttttaaatggcttggttttcaaaatgtaaacaaatataaatataatagaattcaaaagacacagagtaaacagtaatggtattttaactgatctctacttaactttgaaaatttctctatctctagcattgtattaaatatatattcagattacagcagagatctgattagggctgaaatatgagctgctcgaacatcacagcaaaatgacagcagaaagaagtctgaggaattctgatcattataatcactataaaatataattcttatttgtgttttctgtttttttttccttggagaagattattggtgacatcagatgcaaaagggagtggataggaacaagaaatagaaattgtaaacctataattgtaaacctacgtaaccatgcccggttacggccgggcatggtggctcacgcttgtaatcccagcactttgggaggctgaggcgggcagatcacctgaggtcaggagtttgagaccagcctgacaaacatggtgaaactcccgtctcaaccaaaaatacaaaaattagccagacgtggtggcgggcgtctgtaatcccagctactcaggaggctgaggcaggagaatcacttaaacctgggaggcggaggttgcagtgagccgacatagcaccactgcactccagcctgggcaacagagtgagacaacatctcaaaaaaaaaaaaaagaaagaaaagaaaaagaaattgtaggttattgcagaaaggccatggcttttcttccagttgaagtatttccatggcttttcttccagttgaagtatttccatgacattcctatctcctattacttgggaagaatcatttctaaagattgatttcatgtctttgttgtctttgtataataatttataactcaatctgcctcataattacatcttctcacacatgactttcatgttgctgtttttcttgaaacctacatctaaagtcctaaagatcctcccactctgcccatccttacctgcaaggcagttgctcccctttcattccaaactaatttctttcaggaagctcctctgcattaggtagggcgaaggaaggatgcttttactgtccaggttcatcatgcccctaaaatgtattaaaatgtaaaatcaataatgcttacccttcccacacaaaaaaatggaaagaccattaagttctattaaaatttatagaaatttatgtgagctaagtgtcttgaaacctagtctgtgtcccttgattgaagtggctttaatgctttttgagctgatggtcatattaacatccaaaaattttttataagagattagcttattttaagatgctgattgtaggaggataattagacaaagaaacatgttactagatatgcatttcctttctatattagagtttagagaaggataccccaagtttctttctttctttcttttaggctgctgttgtagccagtggaataacctggaggtctcagcattgccttaactttatgcacctggtcccataccatatggctggataatgttttgagatatttatgggtttaaaaatctttcattttccaggccgggtgcggtggctcacgcctgtaatcccagcactttgggaggccgaggtgggcagatcacgaggtcaggagttcgagaccagcctggccaacatagtgaaaacccgtctcttccaaaaatacaaaaattagccaggtgtggtggcacacgcctgtagtcccatctactcaggaggctgaggcgggagagtcgcttgaacccggaaggcagaggttgcagtgagctgagaccacgccattgcactccagcctgggtgacagagtgagactccgtctcaaaaaaacaaagaaataaaaaatctttcattttcctctcttcattttaactgtccatttgtagcaagttctgtgtgtcagtgccttggggaaagtacaagtcggggaggaatacagagtcatcctggaactctttgtaacttttgtttccaaaagtcaaaagcctaagataggatgaagtttaaggaaataagcttagagaagagaaagaggtaggattctccagcttaaagagagtgcccctgccccaaacctgggcaagggagccctggctatggccctggtttgccagaggagctgtgcattgctccctggcctcaaagggacgacctcctgctacacttccagcctggggctcctggctttgcctaaggttcctctgcttcatttgaggcaggagagcccctgagtgccagctggaggtctcagagaaccactgaaggcttggccaacaaggatggctagaatgatcagaaccaattggaaattagagatattatttcctggggcacgttgatcaaattttggtaaaaccctagaagcgggaaggaggctaataatgatggagaaacaatttcctaccattctagtgggttaaggacatagatgtttgcttattcatttaacagatatttattagaattatttgatcagtcaggcactgttctaatggcttaggatatattcatggatgaaagaaagattcctgtcctcatggagataatattattctatgaagttatttttctctgagcagttttattcttcacttcctctttcttcatttcctctttctgattgggctccttttccacgcccaatttttggagcagagagagagtgactcctaggtagctgttgaagaacatgcagattaggagggggctgtgggagagaaacatttgttgagaatatgaccaagggaaagacatcccttgtaggagggtggtgattgaggtgtagagtagaattcaaacagcttttcccctttcaatatgtaattgtgtctcccttcactcctgctgcagtgaatttttctcctcgcagaaccctttccccaacatccaccccttctgctctgagcttggtgatagccgccgcagtcccctaccagcatgttctttcccaggccatgttgtcgggactgtaattcagccatgactggcaagcaacgaatccgcctggctgtttgctaatgtgatgagaaaagcaggcttccctcttagaaagaggatcttggagacactattgtgattgcatctgaaaagcttagatcaaatggataatgtcttcagtgaagatcattttggaattttcctatttatcaagttaccttagtaattttctggtctctctgacagagtagaagtgaatcaatcaactcatcattgtccctccatcaaggccaagtgaatttatatctccattggagaagaaacaaaacaataagcaatcattctatgttttgtagagcaattctattttgattaaaactatttttgtctttttttctcagtgtcttcaatacggactttatgtttttctgttataagcactgactggttagttaccaaaatgagaaataagtctggaaacatctcactcattaatgttctgtaacatcataaggggaacaaataccttgtatttacataatgtttgcagaaaagtcaaatattacttccttcatcctcacaaccataacaaaatgtgcttctgagtcgtggtccaaagaccatgggactaggagtcacagacatgagtagctatctcagcttaaccttgactacctgttcctccttagataagtcatttaacacactagccttggtgtcctcattttagaagtaaatgggctgggcttggcgcggtggctcatgcctgtaatcccagcattttgggaggccgaggcaggcaaatcacgacgtggtcaggagatcgagaccatcctggctaacacggtgaaaccctgtctctactaacaatacaaaaaattagccaggcatggtggccggcacctgtagtcccagctacttgggaggctgaggcaggagaatcacttgaacctgggaggcagagattgcagcaagctgagatctcgccactgcactccagcctgagcgacagagcaagactccatttcagaaaaaaaagaaaagaaaagaaaaaaaaaagtaaatgggctggattagatgaattctaaaatctcattcacctctacaattctgaaatgcctgtttgctatcacagtagtcaaaagtcccatttattgtttctcagctttaacttcattatttaagccaccacaccagggaggaggttaaaaatgtattcatcggccaggcacagtggcccatgcctgcaatcccagcactttgggaggccaagatggcggatcacttgaggtcaggagtttgagaccagcctggccaacatggtgaaaccctatctctactaaaatacaaaaaataattagccgggcatggtgatgggcgcccataatctcagctacttgagaggctgaggcaggagaatcccttgaacctgggaggtggacgttgcagtgagcagagatcatgcctctgcactccagcctgggtgacaaagtgagactccctctcaaagaaaaaaacaaacaaacaaaaaaaagcctgggcgcagtggctcacgcctgtaatcccagcactttgggaggctgaggcaggcagatcacttgaggttgggagttcgagaccgcctgaccaacatggtgaaaccccatctctaccaaaaaatacaaaaaattagctgggcatggtggcacacacctgtagtcccagctacttgggaggctgaggcaggagaattgcttgaacccaggaggcggaggttgcagtgagccgacatcatgccactgcactccagcctggtgacggaacaagactctattacaaaataaataaataaatacatctattttctcctctactgaggtttgcttaagcagtagaagccagtttaagtcatgcttacatggctgttattagagggaaactgtattatgacaagttttgaaaaattaagattgaagatttagaaagtgatagttgaccaatgaaacatatatcatatttgcagaaagatccagtgaaaatccaagcagctttgctcagatccaaacagtttcaattgccattgatctcattcaaagctgcccgtgggtgggagaccgacctggaagggtgtcactaacagagatagcaaatgaaaacaactcctctgtattctcatagctatttttttctaaaaccaaaggaaatcttagacacccatgccccttcccattgtatgtctcacgtaactcttctccaagcacagtttaaggaggttcaggggagtggcaatcagggacacaatggtgtcagatggtgaccaaatatctagcacatagcaccaactgagacacctttccaatggacttgtaacatgatgtcacactatatatttgagaaagcttccagtaaataggtgaatgtagccctggtttatatgcctcttgtctcagcctaattatttatatgaccccttttattctcgaaaatgtcctgttttgggaataaattttacagacattctatctaacatttctactctggaaaacaagttaattttaaaaatgggtatttttgaaacagggtcttgcaatgtccagcctggagggctgtggcatgatcacggctcactgcagcctcgacctcccaggctcaagtgctcctcccacttcggcctgctgagtagctgagagcacaggcatgtgccaccacgcctggctaattttttttttaatttattttttgtagagacagggtctcactacattacccaggctgttctcaaactcctgaccttaaataatcttccctccttggcctcccaaagtgctgggattacaggcactgtgagtgagccactgtgcctggcctaaaaaaaattttgagttaaagatttttaatgttttgtgtaagattcttttttacgaattttactttattttagattcaaggagtacatgtgcatgtttgttacatgggcatattgtgtaatcgtggggattgggcttctagtgtgcctgttacccaaatagtgagcactgtacctgataggtaatttttcaaccattgcccgctcccatccttcccgcttttggcatccccagtgtccattatttccctctttatgtccatgtgtactccttatttagctcccatttataagtggaaacatgcagtaattttatgtttctgagttagtttacttaggataatgttccccagctccatccatgttgctgcaaaggacatgatttcattatttcttatggctgcatattattccatggtgcatatacaccacattttaaaaatctagtcaagcattgatggacacttaggttggttccatgacttggctattgtgaataatgctgagtctttcttatggaatgatttcttttcctttgggtagatactcagtaaggggattgctaggtcaaatggtagttctttttttagttctttgagaaatctccatgctgttttctatagagattgaactaatttacattccctctaaaagtgtataagcattcccttttcttttcttttttcttttttttttttaagatggaggttcactcttgttgcccaggctggagtgcaatggcacaatctcagctcactgcaacctctgccttctgggttcaagtggttctcctgcctcagcctcccaagtagctgggattacaggcatgtgccaccacgcccggctaattttgtatttttagtagagacagggtttcactatgctggtcaggctggtctcgaactcctgacctcaagtgatccacttgccttaacctcccaaagtgttgggattacaggtatgagccatcatgcccagccaagcgttcccttttcttcacatgcacgctaacatctgttgttttttgacttttaataacagccattttgactagtgtaagatgatatctcactgtggttttaatttggctgcctgcatttgtctgatgattagtgatgttgaacatttttttcatgtgtttgttggctgcctgtatttcttcttttgagaaatgtctgtgtcctttgcccagtttttaatgtttattttttttttttagtttagtttttttttcttgttgaattgttccttgtagatagattctggatattagtcagcagcataatttgtaaatattttctcccattctacacattgtctatttactctgttgattatttcttttgctgtgtgaagccttttagtttaatgaagttccatttgtctatttttgtttttgttgcatttgctgttggggttttcaccataaattttttgcctaggccaatgtccagaagattttttcctaggtaaatgaataagcaaatcacacatacacacaaatcccaatggccaatataatacagaaaatattcaggctcataagtattcaaagaattgtggtttaaaggcacattttcctcatgtaaaatgttttggtgtttgaagtgacaccaaagtttggtaacgacaactaataatagcaacaaacactagtgaattctatgtgtgctaagcattgcattaaatgctttacatgcattattttactgaattcttacaaaaattcagaaagcaattatttttatctagctcacagatgaagagacttactaatagttgaatccagatatttctgacagcaaaggacatcatcttggccactctgcacaagatctttatgtagtttttcattcaagaggtatttattatgttttggacctatattaggctctgcgaatttcactgataagaagacatatgactcttgtccttgtagagcttatagcttagcaagatcttacagatggtactggtattgctgctcaggtttgctgtgagatgagcacatcaggctgtcttagtctgatactattcatgctagttagattggattgacatttattcctaactccttctatgtgcttttctgtgctgcaggtcctagaaagctgaaagctccatttcctagatccccttgcaggtagggttctaaacatgaatgggttccttgaattagatatactcttgagaaattggtgaggcggaggtcatccttctgacattgtttctcctgggaagcaagtcgtgggaatgtatcaggaagtgaaagaggtaactcagtgttcttgcatctagtgtccagcttcgtgggttttgagaggcagttatggaagtaggagaagcagctaccacttcctatcccagctttatgatctcctagtcactgggacacggtaggtccagtggcagccccttgactcctgctcctttggtccttcccataatcatgattccttctttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccactaccacgcccggctaattttttgtatttttagtagagacggggtttcaccgttttagccgggatggtctcgatctcctgacctcgtgatccgcccgcctcggcctcccaaagtgctgggactacacatgattccttcttgattgctccttaaatacctggggttgtttcttcctgtgctgaatcttgactgatctaccaattctcatttgattcatttcactctcctggttctgattccatgttccccaaatagccatctgattatgatttgaaaggcaatattgtgtaacggataagtatataagctttggaatcagatttgggatcagatcctctacaatgatcatgggcaagtcaactatgaatagtgattctaatgcactttacagggttgtcatgaagattaaatgccaccttatataataagtacctggtacacaatgaaattgataaatcgcagttgtgttattcctattgttattactaatgtgtgtctgactttaacacgctctttagagttaaagcagagggcagatccctacgacttaattaaagacatcaccgctactatgtattcataagataacttattgtaattaaaaatcatctaaattttagaacacctttttcacaacacatataatgacacttacatgtatgacaaacacatgaactaagggtataacccatggttttatcttccattccagaaagcatgtgccttagtccctttctgttggttataacagaacacctgaaactcagtaatttataaagaaaagaagtttatttcttacacttgcagagactgagatgtgtaagggcaagaggccacatatagtgaaggtcttcttgttggtggggactctctacagagtcccgaggcagcacagggcattgcgtggccagggtactgagtatgctaacgtgctagctcagatcgttcttcctctgcttataaagccaccagttcccttcccaggataacccattaatctatgactaatccattcatgaaggctgagccctcatgatccaatcacctgttaaaggccacacctccacacctgttaaaggccacacctctcaatactgcaacattgggggttaaattgcaccatgagttttggaggtgatgttcaatccatagcagcatgttagaattcacatgagtaagaatgaaattgttattgcaatatattcaggtatgtatatgtatttatgtatgttttgttatttatgctgttatttgttaaagcaaacgattcacacattttatatatgaccattttacaggtgcctcgaccaatgagaacatttcctcaacattcctgattgctgctgtctgttttttatgttattacaactgttgttcactgattggcttccctttacagatgctgcagactggaaagctcagatgatgagctaaccttattttattctcttctcgctgtgatcaaagtcctgaaaagcctgttattgaatgtctaaaaacagttgtttcatgtatcttattttttcagttgtttatagtggaaagacaagtctagtaaaccagttactccatcctggtggaagtaaatatgtctccataaatatttttggtcgaatgaatgataaaatgccaaagaacccttagaactttatccctgttttctgccaaacttcatttgtggtcttttagagattaaagatacttttcctttagggctaaaatttcaattatagctcctgtccctttgatcttttctctgcagtgcctaaatcccaaatcgccaccagggtggtattcagctgcttagtgtagaaaaaaagctactgttacatggatttttttttaggacataaatatgtatagtttactaaattacaataaaaccagagaattttatctggcttagagtctgtcccgagcttcctaaaatgtctagtgtcttattctcttacagtcctcttccttcattccactaatcctggacaccaaagaaacaaatgtcttcccatctgttttctctaattctcagcctggagcactggtccagtgacctccaaaccttttttcatcatgtacccttatcaataaagaaagtttgaaaagccaatatttcaatgtacacatgtattaaacatatcctactgaaagaatatgtattatgtacataataaaacatccacaaagtgaaccgaaaatataaaattaaaaattctaatttttccatcttgtatcccagtggataaatttgcaccctctaagggatgctcacaccccattttaagatgaatgccttgcaatgcagaacaaagtgcaaatgagccaaccccctgcagtgctaaatctcccttggctcccctcttggtaatattttaaaactagactttaatggtttttttagtttcttaatgtccacacataatccttcttacttcagatcccagctaacttaatccttgatttttcttgttctctttggatttccatcatatttctttccttttgctctcccttatttgtggtcttgttttctcccgggcaatctatttcccatgatagtttaacatgtaagaacagatgcattcatgctgactttacaagatagtgttcttggcaatattgaaatgatacacaaaaaaacaaggagggagtgatttctttcagagtccacttggattctgcccaagatggaaaggacctggaagctattcaaattaagttgctaattgggtggaaaactggaaagtaaattgggacttcccacatgcaaaaatacataaaagagatgtgaatagaaataaaacctgtactacttttcattataaaaatgactctttaatacatagtaagagctgtgattttagccatttgaccatcagatcctgggattaatatcaaaagcctatgagacaaatatgaggcatttaaagacaggtccagttttctttcagaagacaaccactgttaccagcttcttttgcatcttttgaaatatatcatacataagactaataataacatcccacatagacacttctgcatctttctcttttccatttaacatatcttggcaaagtttccaaccagtacaggaagaacacctgcattctttttaataatctcataaaaagctgtaactttatttatttaaccaatactattgataatcaatagcactagtctttagctgttacaaacaatgctgtttgaatactcctgcgtacgccagtgtgcataggtactaatgcacctgtagtattaattcctaaaaattccactgctgatcaaagcatatgtgatttttttacttttaataggtaatagcaattattgccagcaataaatgagactgagcaatgtgtcctttacaatgccaggcataatgctttattggtagagagagctcacatattcatatattgacccaattaactgttgtaacagtcaaatataggaagaaaggtgaaagatatggttagtatgtaatctttaacacaaaacatgacgattattctcaataataaattcaaaagcaactcatgttagataaatgagtttctgggtttatcacttccttgtcctaagttgggcacagagagataacccagaggtaagccctgcttctaaactccaccctaagcctataaactccgcatcatacatctgcagtggctctgacttcaaaaaacgtttgctttaagaaacaagggtgggtgggcatggtggctcatatctgtaatctcaaccctttgggaggccaaggcgggaggatcatttgaggtccagagttcaagaccagcctggccaatatggtgaaaccctgtctctactaaaaatacaaaaaattagctgggtgtggtggtacggcctgtgatcccagctactcaggacgctgaggcacgagaattgcctgaacctaggaggctgaggttgcagtgagccaagatcacaccactgcactccagcctgggtgacagagtgaggctccatctgaaaaaaaaaaaaaaaaaaaaaaaaaaaaaagcctaaagaaagaagggtaatttttttgttttttactttttttcattttgggaggtcgaggcgggctgatcacttgagccaaggagtttgagaccagcctagagaacatggcaagactccatttctattaggggggcgtgctggcattggtggcttatgcctgtgttctcagctactcttgagtctggggtgggaggactgcttgagcccaggaggttgaggctgcagtgaactatggttgtgtcactgcactcaagcctgggtgatagagcaagaccctgttagaaaaaggaaggaaggaaggaagaaggaaggaaggaaggagagaggaagggacggaaggagggagggagggaggggaaagggaaagagaaaggaaagaaacaggaaggaaaggaaagaaaggaagaaagaaagagagggagataaaggaatcaagagtagtaatgttatattttataaaccaaaaagcaagaataaattattttcacagaactgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12524 - DNA, 133278 bp, Human
  misc_feature (1)...(133278): n = A,T,C or G
caatggtttatggccccaaaaaattctaatggacaaaaatcttatccttagtatttaattgtggggtagagggtttggtaatgcaaaaaccttgagaaacagtgtcctatagcatttcctttattcttgaaattaattaactttacagaatatatattcgtgttaatctttctgtgtctgtttttcctgggcatagtgtgtctttctgttatgtatgttatattttcatgtttgaaaacaccagctaaagtatttgctttatctcctttgatactctacattattatatttctttcattttgtgcttttctcaaatctgtttaacatgtccatgacttttttttttttttttttttttgagacggagtcttgctctgtcgccgggctggagtacagtagcgccatcttggttcactgcaacttctacctcccgggttcaagtgattctcctgcctcagcctcctgagtagctgggactacaggcgcgcgccaccacacccagctaatttttgtatttttagtagagatggggtttcaccatgttggacaagatggtctcgatctcctgaccccgtgatccacccacctcgcctcccaaagtgctgggattacaggcgtgggccatccatgactttttaaacctggctttttgttgttgtttcccacgtttttaactctgttttttgtttttttaactctgtcagccctcttttcatcacttgtcaccttaattcttctttaaactttttagtctttttttcctttagatcgggggtcctcaaaccctgggccacagaccagtaccagtccatggcctgttaggaaccaggccgcacaccaggaggtgagtgtcaggcaagccgacattacctcctgagctctgcctcctgtcagatcagcagcagcattagattctcataggagtgcaaaccctatcgtgaactatttatgcgagggatctaggttgcacgctccttatgagaatctaatgcctgatgatcaaggtggaacagtttcatcccagaaccattccccgcaacctgtctttggaaaaactgtcttccatgaaaccgatccctggtcccaaaaagtttgtggactgctgccttagatcatatcttatatttatcacctctcaatgttttccatctaattttggcctctatcctacatttgtttctttctaataattacttctcagcaccaaaacaaggaaaatgagaccagtgaggaacttacctcaatcacaaaatttaaggaagcaagaaaaaactcaataatcaagataaatattttattgcaatattttttaaaaggactaaattactgtataatgagcaaaatatcaaaatttttaataaagacaggattgattgttactgaatgaaacaatctgttagaagtttggggcacatatgtgtgtgtaatatagtgatgtgagctttattgcataatacatcctcttaaccaaatctgtcatttcctttgccctgtagactcatcttctctcgttttttttttttttttcactttgttgagatgtaaaacttttgtgttattcacagactttctataccacttacaattcatgcttttctcttctgtgccacctatgctccagatcatagatggtagaaatggctcccttgtctgcataagaaggtgtttgccagagaaaatggtgaattatgagctatatgttcttttatttttctaaaactttaataagtatatttaacacattacaaaatgtaaaacattttaagaaatactggctggaaatataatgggaattatcatggagtaaaagtttaaaactcctgggctacttacagcaatagactgatcatctgctttactttatttggttctttagattagcatttcccaatctttttggcaccagggaccagtttcatgaaagacaatttttccatgtagtgggtgacgggggatggctttgggatgaaactcttccacctcagatcatcaaccattagattctcataaggagcgaacaacctagatcctttgtatacacagttcgttgtagggtttgtgctcctatgaggatctaatgccgctgctgatctgacaggaggcagagctcaggtggtaatgcttgcttgcctgctgcttactgcctgctgtgcggcccagttactaacagcccatggactggcacgggtttgtgacctagagtctggggactcctgctttacatagcatatgtttcatttcctccaagaagctattctcagtaattagacttgattcttaacatgcctggatatttataattcagttaaatttatgatcattatttatgaatgttggacgttatcgcttatgtctttctgtatttataattactgaagcaggatatgcattgtttttcccttttgcttctttctagcacactctacttctcatttgtaggtttattattgtccagcacatactgattcaggaaatttaacttgaatcctttaatcagtcagaaccatgatttcttatcttaagttgtttcatagcctaaagaaaatggtagagttagtttatattgtgtttgctaaataaactgatgagataaaaggtggatgttgttaagggagggagagaataaacaataaaccctgggaggagtacaggatgtaaattgtgttaagcaaataagttcactgtcgtgttgcccagagcggattcttttccctccaaggttaagaatctttttaggagaggatattgattgactctctctactgtatctggtggaaaaagaggtggtaaatgtgatgtattcctgtcatattttaattcatttattgagattaaaaacaaggatgtaaaacattcattttttatattcttgagtcaagagcactgaatcaaaaagttgacattttcactaaatgtttacaccttaatgcggagttttctctagatagctcatgtagatcttatgtaatattcattttatttttttcctttagctggaagtgctcctggttgttactatcaaagacatgtaaaagcctagaagttaattttagatacttaaagggaaatgttaacatttttatcttgctttgttaaatttcataagatttgataaatgagatatcaagaatatttaatgaaataaaattattaatgggcatttacttttgaataatggagtaagaaaaaagtagtaaatgtctactctaaaacttattttggccttaaaaaatatatatgcttttagctcggcacaatagcttgtgcctgtaaccccagcaacatgagaggccaaggtgggaggattgtttaaggccaggagttcgagaccagcctgggcaacatagcaaggctccatctttttttttttttttttttttttttttgagacggaggactcactctgtcacccaggctggagagcagtggcgcaatctcggctcactgaaacctcggcctcccgggtttaagcaattctctgcctcagcctcccaagtagctgggattacaggtgcccaccaccacgcccagctgatttttgtatttttagtagagacaggatttcaccatcttggccaggctggtcttgaactcctgacctcgtgacccacctgccttggccttccaaagtgctgggattacatgcatgagccaccgtgcccagccagcaagcctacatttttaaaaaattttaaaaattagcagggcatggtggtatgtgccagtagtcccagttgggaggcatgaggatcacctgaacccaggagttcaaggctggagtgaggctgtgttcatgccattgcactccaacctgggcaatagagcaagaccctcacctcaaaaataaataaaaataaaagttatccttttggtggtgttctcactagttaactcaaagcatttgatgaaaaatatcagctctgttttagaaatagatgtttgtagcatatgtgacaactcatttgtaagagtagtgagtgaaatttggcttttggtaactgtgcctttgtacattcttatcttcagacaagttatttgagcagaaaaataaaaagtaacaagtctcccaccagcacagaatgagtatgttcatgttttggctttggggtgtaacacttctaaggatataattagctttgcttttcattttctactttttctccacagcctcacgattttgatgaatgtcgatttgatattagtgtaaatgatagtgtttggtatcttcgtgctcaggatccagatcatagacagcaatggatagatgccattgaacagcacaaggtaagatccctaatgtttacctgtccatggaggactaggtaagagattgttgacaataccttaaaaaaaaagttgacatgtgacattagttactgaaacattgaacattatttggatgataaagattaaagcagttcatatgtaaatttttgaaataatttttatttttaacactttagttgtactaagggtatttgctatgataaatattactcggctgggcatggtggctcacgcctgtattcccagcactttgggaggccgaggcaggtggatcagctgaggtcaggagcaataccagcctggccagcatggtgaaatcccttttctactaaaaatacaaaaattagccgtgcttagtggtgagcacctgtaatcccacctactcaggaggctgaggcagtagaaccgcttgaatccgggaggcagaggttgcggtaagccaagattgggctactgcactccagcctgggcaacagagcaagactccatctcaaaaaaaaaaaagataaatatttttcattgttaactacatcaaaaatataccctttttcataaaacacatttcgattttttatttaggttttgcttcataataaatacctttttaatgatctaaataaaaggatttttgaaataacattggattataaaaccccaacttataaaagtttcaatgttgatttttgttataactttttgggtaaattcttagtacgaacatttgtaaatcagttattctttgtaaatgtgaggctatctaatgataaacctatagaaagtcttttttatataaatatataaggtacattcatataatttaagctagtctttgacttctgttaataaatattaagtagactaaagaaatacattaataaatctgtattattagctaattcagtaataccatgataaaacagagaacgttctaaatccaccatgtcattcttgagtatgacttaagagaagttttgcttgtttacgtacttgcctatacttgttcgtttgagtttcacaaagttgtagttgaaacacctgttttggttatttctaacaggcacaaaacacacacacacataccacacacacacacacacacatttttaacaggcacaaaacacacacacacacaccacacacacacacacacgcgcgcctatacccatacacccaagaaaaaccagtctggcttgagaaagaaaagctaacacgattgataaagaagtatgcgattgtgaaatctgaggcactgttttgggtatttttaacaagcacaaaacacacacacacgcccttacacccacacacccaannnnnnnnnnnnnnnnnnnnnnnnnnnnnnnnnnnnnnnnnnnnnnnnnnnnnnnnnnnnnnnnnnnnttagcttttctttcttggtttattgatttaagatttctcccagcctaaataaaattgactatgttacctttcttttttttctttgttttagctttaggactatatatttaaactttagtgttaagtttttaaaacattttctaagtcttagttatcttggtaatgttacttcagaaaagtctaaatatggaaaaaaattattgtttttctattatttaaaagagaaatgagctactattcaaaaaatctcaatgctctggagccaggccatgcatgcagcctctgccatgtatgacatatgtgagcttggctgtgttaattaacctcttcttagtgtttattctcagctgccatgttggtacttctgctcaaagtagtagtaagacataaatgagataatatgcaaagttacttaccagaatgactgatgtatttccccatttatggcatataggaaaagcaagagacttggagtctcaactaaattcactaaattataccatcttgtttctggatgaagagttttacgttaggtgagagaagctaaatgtgcatataaggagaacagcctgtttcatgttatttaatcagggccagccgtctcactagtgattaaagatgttattaagtagaattaatttctatatttttaatggagatgacctttaagggcttaatcagttgatttttattacagggcaagtttttttctgttttaattaaacatattttattttgctcacttttctctgttaagtccaatgacagttcctttgcaaggttcccgttttgtgttttcttcctttagtgaagattaatgcacgaagtatatatttctcctttagtgttgatttctttacatctttgaacaatggatagatttaatctttgggtctctctcagagcagtgggacttaagctgagataacaaattttgagtgatttttagttcctgaaaaaaatactcaactgcagggttgtgatgcattgtacaagtttgccctttctttttttttttttttttttttttgagatgaggtcactttgtcacccagcatggagtgtgatctcggctcacttcagcctctgcctcctcggttcaaacgatcctctcaccttagcctcccaagtagctgggactacaggcatgcaccaccgtgcctggctaattaattttttgtatttttggtagagacacggtttcgccatgttgcccaggctgatcttgaacccctgaactcaagtgatctgcccatgccagcttcccaaaatgctgggattacaggtgtcagcctctgcagccagccaccctttcttatttttaaagatagtttatttgtagactaggagaaatcattgttaattgttgttaatattatttaatgtactaaagtaaaatatgtgatgtatgccaactgagcagcctatcagtgaatatttaagtgaattcatatttagaatatgaattctaaaagtaaattgttgagttatttaacatgtaagaaggagaaatttcaaatgttgtcattgttttttttcctcccatagaccagggctagtgagatgtttcttgattcattcttcagtatcattaaggaatattgattgtggaagctaagtttagtaattttactatttaagtatgcattatcgtcttgatcctctatataaaactgtacaggcataatgatgataatgataggagctaacacttattgaggatcaccaagtactaatcattgtattaagtgctttatgtgttttattttctccctactatcctgaaaaataaagtagtattttgcagaagaggaaacaggtttagattaaaattaagtaatttgcctgagactgtactgtcttttagtttgtgatttctgagtattcaattttgtgttaattctcttgtctgtctgttaccattagtaaacggactgtttatgaacaattcccatgagctaacctcctgcaaattgtggtgtataatctgagttctcctactatacctatgcaagataaatatgaactcatttttcttttcgcccgtggattgtcaaacaggacagtatattatattggtaactgtttcagtagcggatttcagactccagagtctggcaaatgtggatttgaatcctggcactactatgtattagactagtgcaaaagtaactgtgattttggaccatgattttttaaatcattttaactaggctcaaacacatctttattaatcaaaataggaaccattacaatcaacacatttttaccaataagaaataagtttgtttattcctgtagcataaaaatctgtgcttcgggattctacaaactcttggaaagcattttctgcatcctgctggttgtggaagcattttccctgcaaaaagttgtcaagatgcttgaagaagtggtagtcagttggcaagaggtcaggtgaatatggcggatgaggcaaaactttgtagcccagtttgttcaacttttgaaacattggttgtgcaatgtgcagtcaagacattgtgaagaagaattgggccctttctgttgaccagtgctggctgtaggcattgcatcgcatctatttgctgaacatacttttcagatgtaatggtttcaccgggattcagaaagctgtagtggttcagaccggcagcagaccaccaaacagtgaccatgacctttttttggtgcaagtttggctttgggaagtgctttggaacttcttcttggtccagccactgagctggtcgtcaccagttgctgtataaaatccacttttcgtcacatgtcacaatccgatcaagaaatggttctttattgttgtgtagaataagagaagatgacacttcaaaacttgcgatttttaaaattttcactcagctcatgaggcatccacttaattgagttttttcacctttccaatttgcttcaaatcccaaacaactgtagaatggtcgacattgagttcttcggcaacttcttgtgtagttgtaagaggatcagcttccatgattggtcttagttggtcgttgtcaacttcagatggccagccactactcttctcatcttgaaggctctcatctcctttgcaaacttcttgaaacaccaccgcactgtatgttcgttagcagttcctgggccaaatgcattgttgatgttgcaggttgtctctgctgctttatgacccattttgcactcaaataagaaaatcttttgaatttgctttatttgctttttgtctgacatcatttttgtagtctaaaatagatataaacagcaagtaataagtcattagcaaaaaacaaagcaagaaatgcacattaaaataatgtataatataaccacatttatttaagaatgtaatccaatatcaaacggcaaatttcaacaatgcaaaaactgcattagcaccaactaatactagctaagtggccttggtaagttattgaaaggaggaaaataatgatagtttacggtatgtgttaccataccctcagcacccccacaccttaacaaaaataagcaacaaaataacctatccatgataaaacaatagtattatactttgcggttagcctgggcacccataattccagcttattcagttcatttcacagttacttcatcagtgcaccacttgccattagtagacctgtatttttctgttctgatgccattggatgggcttttgttagggcttacctggaaggttttagttattttcaacatctggaggaagaggtcgggggtttcttttccatccttcccagaagacccttatgctgattataaattctttgtattgatctgtttcacacatgcacattcacgcaccctccactcgtgctctctctctctctctcacatacatacacgcgtgcaaacaaaatgagttttattttacaggacttctaaacaataataatggtgatagtgatgaagatagctaacatttttgaggatttatgtatgcctaacatgataaacaatttatatatattatctcatttttttcctcactttcatgagattagcattattatcctgtttttacagattaggaaattggggcatagagaggtgaaataatttgtccaaggtcaatcaactagttagtgaagaagtcagcattcagacctaggtctttctgacccaagaaccagggcttttggccaggaagcaattctgtgctgtaagtatgtatttctgtgaattatgttttgttgacataaatcatgggcttcttgaatcacagtattcttgtattttctgtttgttcctcatatctatattatttagaccataacttcttaaagactcagacatattcttattaaacttctttgtaggaatcagcaaagcattgggcacgcaaattttttatttgaaataatttacagtattgtaaaacagattttatgggagaaatttgtgatatttgaaggcttttcccccttaaaatcctcatggtttgtattacagtgattactgacagaatactttctgtctagctttactgtttttgccctccttggcatccattctagaatggttgctcactacaagaaaagttttaacgaaatgactgtatgatttaaatattctcaatgtattagaaatcacataattcaatgtgacattatacagcagcccctgcagaaaaaagttattcccgaggtcattcttaaattcaaaaattatatttcaatttataacatagaaaaggacatatgtataccagaccagtaattttatttagaaatattgtgctggctttaatctgtggagtccattaatattctgcatttctccttatgattttgagacaatgctaaattatttttaaagatagggttttgttttaaatatcttagccatctttcatgctgtcttgaggtcaaatgagatagtgtttgtaaaagttctttaagaaaaaactgaaagctgtatgaattaaagttaagattgtgtaaagttaagctaacatttttctagtaaagaggtgcctgttgtcaaagggctctgtgagcattttctgtataatttgtcaaagatatataataaaccacttttgatgctattatttttttaaattataggattattttcagaatcttctacaattagaatacatgtgattttgattaaacaaagtttctgcttactatgaaaaaaatgtactcccccacttcaacccttcaaatccctaaaactagcacgaaggctttcctgacgctaagagatttaaaaatcattttgaaaaagttaagtttcttgaaagcctctgacagagtttatggtaatcgtataacattctcatttccataaaggagcaaccttagtaggtcctaaagtgttggtgcctatgggccacacagactttccccacgttgtggaaattatccatgacacaaagattcatatgaaaatataaaattagggaggaagaatccaaatggtaatttttacagatgttgattttctgtagtgggaatctagaggcaattgtcttgtcatttaatatttgtggaattgttcttaccctttgtgaaggccaaattcatgtgtgaagcatcaatgaactttgaaagaaaggtttattctcaacctgagaaggttagagatttctgtttgaggaaattatgtggaaaacactttttgaaaggaacatatattttacttgaaataaaatgaagtgtgaaaaaagttttttactgagagaaccccattgttgagccatctaagtgaagctcaagacccatttagagatcttttaaaaattttgttccttttgccataatgaaatatttcccccatgctctgtcagagtcagtttgatttgctgtgttttttctaattttaggagcaatttctacttagttgacactttcatttttttgtcttaaatttgacataatcttaggaaacttctaaaataactagatggcagaattattaactcttagtagtttttaaatatcaaggtcatataaagtcatactgttggtttgtgccatttaaaatcaatattggattttaacagataccctctctatacttatctgccttataaattatataaaacttagctttgcatttgaatgtggtttaactgggaagtgtttaagaatgcaaatataacattattttgagtgtttacttcatataagtaatttcatgagtgtgttagaaccaagtctccatttacctatttgcatcatatgatgatgacagaggatcaaattttacttcctctttacattcaggagttttaaattttgagggaaggacgcataaatagttcttacagtagtcggggctctgccattttctcaagctgtagaaaaatcagtacatagaatcacaactgacctttattaagcagcagagaaacttcatgttgtctctggatgtttcagtcattaaaatcaagaatttggttcctaataatgggagttaactgccaaattgcatgcggtaatccatacacggttagtaaatttttttaaaacaccacaatgtagatagtatcaaactaccagcatttttgaggttggtgaaatcaaagaggaaaacaaggtaccaaccccctttagtttttatagtcttctggaataaaaacaattcagttgtcgagggtttataaagtaacttcatatttgtcagtttttcctgcctgcagtatttgaaaactggcatctgagacattagaagtttattttgtcaaggttatggatcatgacccatgacacagccctaggaggtcctgagagcatgtgcccaaggttgttgggttacagcttgggttatgttttaggaaacataaaacatcaacaatacatgtgaggcatacattggttcagtccagaaaagccagaaaacttggaaggggtgggaagcttacaaggtcattggtggattcaaatattttctgattggcagtttgttgagttattatctaaaggcttagaatcatagaaagaagtggctgggttaagataagggattgtggagaccaaggttatttcttacatagatgaagtctcatgggtggctgcctcaccagaaacagtagaaggcaaatgttttctatacagatccttaaaaggctctagactcagtctcttcgggatcagaaaaagacctggatcgggaaaggttctctattctctataggaagtaagtttcccctatgagacagttttgcggggccatttcaaaatatgtcaaagaaatacattttggtggaaaatactttggtttctttcagggccctactctctgccatgtgctgttatactagagtcaggttggaagctatagagtctgttctgttagtcttagaatctctgttttaatgttaatgctggtcagccccgtgcctgaactcccaaggaaggagagtataatgaggcatgcctgacccacctcccttccagtcatggtctgaactagtttttcaggtttagttgggtcctcttggccaggaggagggtacattcagctagttggtggggcacctagaattttatttttggtttacacccaaatacttcaaaaagtaaatcttaaagagagaagaaaggtcagtgatttttcaggtgggttcttctgtctgggaaggtgcttagcttttaccaagatagtaaaaggattgggaagattgtacactgagtagtgaagaaagaagatatttagatagctagtcatattaactaatgcaaccaatgaagagatgtaacttaacaagatattatgtcaaaaagacagggagattgttaaaaatcaatacaaaaagtttaggaagttcatttaaggggggaaaagccagaagatttgactgctgcttcataataggatgctgaaatgggtagtaaacataaataaaggtactccatgctattaatcatcagaaaaatgcaaatgtaaacctcagtgagataacaccatatacccatcagaatggctttaaaaaaaaaaacaccaccaccaagtgttggtgaggacgtggagcaacaagtaatctcatacattgctgatgtaagttataaattgtgcacacacttggaaaaaaatttttcaatatctactaaagctgagcctagaggtcccctctgctcagatgcatattgaaaatttgaagctctcacaagtattgatgtcataggtccattcattttaattaagctgtttagattatggggactagaggccaacctatattcccttgagaaatgggaaaattcccagcaaccaagaaaatttagaatacgctacctgcaaggcaagttggaattgtatacttaactcaagtgcttttattgttaacaaaactccaatcacctgccctcagctacaattaatatatctgtttcatcctattatttcttttctcttttttgtaattcctgtttattcataacttttgctctcctatcctattcttagtttctgtttccttggtttgtcatttttctgtcttttgatttcaacccctaactgccttaatctcttagtatgtcccaaagtaaaagaaaaaagtctaattgccatttcacagcacattactatgaatttgttaattatttgtttttaaagaaagtttaaaggaaggggtaggattggcagttatacaagtataatgttctgaaaatgcattttatgattttgcatagagtttaccagattttcaagtttttataatgtttactatgtgtttgccactaacaatttaggttactgttactagattttcagcttatttctctatccttttttcgtctgtaatttgtaaactatttagataacaagttataaaaaaaggttaatctagagttaaataactgttccatataattcttacagaagatattaaagaaaatgagattacatactgcaaaagttatttctgtacaatgccctaatgtggtatttaaatttttatttaatgaagagggaagatttctgacagtcactgggacacatgggattctgcttttttctatatttaatatggaaaagtaatggtgggagacatggcttatacatattgacagcaatataaactgttttccaattttgcttgctgagtattaggacattagctgggagaaaatgtttcctaaagtcaacacagaactgcactttttcatcaaatctttttaatcacttaaaagtattgtacttatattatcgttattgcttggtacatattctcagcttgtctgatactgagaatgaaaaacaacattggggtaggaataataaaaataggtagcaaagtaaattagtatcccgcaggttaaaatattaccgtaactgaaaacagttctatcatttttcagtcacacaggaagtccatgtacttcataggcaaataatgattaagataggaatgcttatattgctgttcagttcttagccccttgttctttttagtagtactcctctgatatatagagggatagaaggaataattcagcactttaatgtgttatttaattctcacagaagccccattttacataaaaatgaaattgaatggattatgagaatattgattattgattggtaagtagtaacattattttttcaagaacagcaacctaaaatactcatacagttagctctaacaatgtttacaagtcttaaaactattcctgcaaattgttgtattacataaatgttattgactcctcaaccatggttttttaaagtaatatttgttaattataaagtaagaaaatacaagccgggcatgatggcacatgcctgtagtcccatctactggggaggctgagtcaggaggattgtttgagcctggagtttgaggctacagtgagctatgatcacattattggcacgttagcctgggtaacacaatgagaccctgtctctttaacaaaaaaaaaaaggaggccgggtgtggtggctcacacctgttatcccagcactctgggaggctgaggtgggtggatcacgaggtcaggagatcgagaccatcctggcgaacatggtgaaaccctgtctctactaaaagtacaaaaaaaagattagctgggcgtggtggtgggcacctgtagtcccagctactcgggaggctgaggcgggagaatggcatgaacctgggaggcagagcttgcagtgagccaagatcgcgccactgcactctaccctgggcaacagagcgaaactccgtctcaaaaaaataaaaaataaataaataaataaataaataaataaattttttttaaaaaaggaagaaaatatagaaactaccttcagtcttataacccagacaacggtatatttttctcttctgtgtaccttttccttcaaaaacattatggatggagataggatttggggaagatggcagagcaggaagcacccagaatctgtctccccacctagacaacaattaccctagccagatatgtctgatataactgttttgaaactctggagtctgctaaaggcttgcaagttccagggaaggcttgagtggtaaattgctgttaatttcggttaatttcagctcttaacacagtagtagcttcctgtacctccacccatcccagccccgtggcaggcagctgtgcatgtgttcctagagcaatccatacacttgtgggagccagagtgagcacaaaagattctgtcctctaaatactagggatctatgctctgactgcaagttatggcttcttatcacagaggtgcagaaaaagaggtgggtgaccattattgttgcaggtccctccccctctggctgtagtgatttctaggagacttgaagggccaatgccctctttctccttaacttttctccttttccttttgggagcgagacattaaagactaggacattcataaacaactgcatatacacaaaaaattagaaagtgatgattgtgcatgctcagggaaaggtgcagggctagaaaaaatccgaagaagaccttacctttccacctcaggctggatccttggcacagaaatagcctacgacagtaaaaaataacaataacaaataacaaaccctgaggaaaaaaaagaacctgatttccagagttaccacactagtaaattcaaagttccagttttcaacaaaaaaacacaaggcatagaagaaaacaggaaaatgtggctttttcaagggaaaaatgtagatcaacaggaactgtccctgaaaaagacttgatggctgatctactagacaaaagactttaaagcagctaccttaatgatactcaaataactaaaggaagatgtggggaaagttaagaaaaagataaatgaacaaaatagaaatatcaatgaagaaatagaaaacctgaaaagaaatcaaaaagaaattatggagctagaaactctagtaactgaaatgaaaaattcactagaggtattcaaaggcagatttgcacaaacagaacaatcagtgaacttaaatataggacaacggatatgatttagtttgaagaacaaaaagaaaagattgaagtgaacagagcctaagagaactatgggacacatctgacagacctccctatacattttgagagtgccaggagaaaagagaaaggagcagaaagaatattcaaagagataatggccgaaaacttcccaaatttgatgaaagacatgaatataaacatgtgagaagtttaatgaactccaaataagataaaatcaatgagattcacagataaaatcaactttcaaaagacatacagagtatcctgaaagcaatcagaagcagctcatcatataaaaggaatcctcaatataattaacagatttcttgtcagaaactttagaagccagaaggtatgggccaatgtattcaaagtgctaaaaggaaagaactgtcaaccaagatgcctatatttgtggagccaggcatggtggcattgcacctgtaatctcagctactcaggaggtagaggcaggtggatcatttaacaccaggagtttgagaccagctttagcaacatcgcaagacctcatctcagtaaaaacccaatcctatgtctgacaaaagtgtccttcaaaggagaaggagatagcaggtgtggtggtgtgtgcctgtagtcctagctacttggaaggctgaggcaggagagtcacttgagcccaggagtttaagtttagcctggcaaaatagcaagtccttgtctcttaaagaaagaaaaaattagtttttcagcagtaaaatgagggaataaagtgagggagaaatttaaacacgcccaaataaacaaaagctaagggaattagctttgctatttgccactagacctgcactgcaagaaatgcttaagggagtcctctgaagtgaaatgtaagcatactggacaatacctctgagctgtatgaagaaataaaaatcttagtaaaagtgcatgagcaagtataaaaattagaattattgtaataacagtttgtaattctgctttttgttttctacatgatttaagaaaatgatacatgtttaagaacacaattagtctaaaagctaatagtattgtaactggtttgtaattgcagattttgttttcagtagactaatggatttaaaagaatatttgcttatttttttagtcacacagaatataaagatgtaattttgtgacatcaacaactgaaaggggtgaagacagagcttcaaaggagtagagtttttgtatgttactgaagttaagctagtttaagttcacattacagtgttataatttcaggatgttaaatatcatcccgatgataaccacaaaaaaaataggtatagaaatacacaaaaggaaatacgaaaaaaattcaaatatttcactatgaaaaatcaactaggctgggtgcagtggctcatgcctgtaatcccagcactttaggaggccgaggcgggcagatcacgaggtcaagagatcaagaccaccctggccaacatggtgaaacccagtctctactaaaaatacaaaaattggctgggcatggtcacgtgggcctgtagtcccagctacttgggaggctgagataggagaatctcttgaacccaggaggtggaggttgcagtgagccgagattgcaccactgcactcagcctggtgacagaatgagactctgtctcaaaaaaaaaaaaaaaaaagaaaagaaaagcaaaatcaactaaacagtgataaactagacagtgatgcaggaaatgagggacaaaaatactaataaggcacatagaaaatagcaaaaataagtaagttcttccttatcagtaattactttaaatgtaaatggatccaactcttcaattgaaagactgacagaatgaattaaaaatacatgatcaggccaggcgcagtggctcacatttgtaattccagcactttgggaggctgaggtgggtggatcacaaggtcaggagttcaagaccagcctggccaagatggtaaaacttcatctctactaaaactataaaaattagctgagcgcagtggcgggtgcctgtaatcccagctactcgggaggctgaggcaggagacttgcttgaacctgggcggcaggggttgcagtgagccaagatcacgccactgcactcctgcctgggtgacagcaaaaacaaacaaaaaaaatgatcaactatatgctgtctatatgacacttgagatccaaagacaacaaacagattgaaagtgaaagaatggaagaaaatattcatgcaaatagcaaccaaaagagagcagggttagctatagtaatatcagagaaaatagactttaagttagagaaggttttaagagacaaataaggacattgtgtattaataaaaggttcactgcagcaagaagactataacaattataaacatatctaatgacagaccatcaaaataatatgaaacaaaaacaggaattgaaaggaggaaatagacagttctacaataataattcaatgccctttttcagtaatagaccagacagaattaagtaaagaaacagagaacttaacacaatataccaactaggtctaaaagacatataccagaacactgtaccaaactataatatatacatttttctcaagtacacatgggacattttctaggttagatcatgtattaggacacagattaaatcttattccattttgaaataaataccatataaagtgtcctctctgaccacagctgggtgacttgagaaattagtaacaagtaaaactggaaaatttacagaatcatggaagttaaacaactagtggatcaaagaaaaaattacaagggaaattagaaaatgcttagagttgaataaaaacataccaaaactttgaggatacagtgaaagcagtgctaagggagaaatatagccataaacacttatattagtaaacaagacctcaaatcaacaacatagctttacaaattaaaaaggaaaataatgtaaatccaaagctagcaaaaggaaggaaataataaagatgtgagctgaaatcaacaaaacgagaatagaaaaacaatagagaaaatcattggaactaaaacttgattatttaaaaagatcaagaaatttgacaaacctttagctagatggactaaggaaaaaagaacattcaaattaccaacatcaggaattaacgtagggatgttatagcagtcctaccttattcacaagggtatatgttccaagaccccaagtggatgcctgaaacaccacagatggtactgagctctatatgtatatatataaatttttttcctatgcatacatacttacgataaagtttattttagaaatttggcacagtaagagattaccaccaatgacaaataataaaatagaataattataacgtatactatagtaaaagttacatgaatgtgagcacatgtgcgtgctcactctggctctttctctcttttccgttctctccccctatttccccctccctctctcctttcaaaatgtgttactgtgctatactcacctatttttggatcagaatttccacaagtaactgaatctatgcacatgaaaccagggaaaagaggggattactgtactactgactatagaaaataaaaagaagtgtaagacattatgaaaaattttatgccctaaaatcgggtaacctagatgaaatggacaaattcctagaaacacaacactgaccaagactaaatcagaaaggctgggcacagtggctcttgcctgtaatcccagcactttgggaggcagtggcaggtggattgcttgaacccaggactttaagaccagactgggcaacataatgagaccccatgtctacaaaaaatacaaaaattagctggacgtggtggtgtgcacctgtagtcccagctgcttgagagctgagctgtgagtattgcttgagcctgggaggcagaggttgcaatgagctgagattactagacctgcactgcaagaaatgcttaagggagtcctctgaagtgaaatgtaagcatactggacaatatctctaagttgtatgaagaaataaaaatcttagtaaaagtcaatgcatgagcaattataaaaattgctctccagcctgagtgacagagtcaaattaatagtataatgagataccaccttaaacccattagggtggctattatcaaataaataacaagtgttggcaaagatgtgaagaaattggaacccttgtgccctgttgataggaatgtaaaatagtacagccagtgtgaaaaatagtatggcaattcctcaaaaaatgaaaaatggaattaacatatgatctaccacttctgggtatttacccaaaagaaatgaaagagggatcttgaagagagttgtatacccgtgttcctggtatgattcacaatcacaaaaacatggaagcaacctatgtgtacatagatggacaaatatataagcaaaatgtggtatatccattcaatggaatatcactcaacctttaaaaagaaggaaattctgccacatgctactgaagcgtgaggacactatgctaagtgaagccagtcaccaaaagataaatactgtatgattccactcatattgggtgcatagagtagtcaaattcatagagacagaaagtagaatggtgattgccagggatagggggagggaaaaatgggatgttgctgtttaatgggtatagagtttcagttttgtaagctgaaaaagttttggagattaattgtataataaagtggatatacttaccactactgaactgtactcttaatggttaagatagtttcactgtttcaaaacatgtagtgtatccttataacaaatacccacgttcttaacaatagagatgcattctgagaaatgcatagtttgtcgattttgttgtgcaaacatcatagagtgaacttatgtatagatggtatagtctattacacacttaggctatatgatagagcatattgcttctaggttacaaacctgtataacatgctattgtactgaatattgtaggcagttgtgacacaatagtaattatttgtatgtcaaaacatagaaaaggtacaataaaaatatggtattataatcctatggaaccaccatcatatatgtggtctgtcattgacaaaaacattatgcagtgcatgactgtacatactagaacaaaacacttttataccaatactgttgtgacacattttaaatattggatactaaatgaatatagaggctgatagttgagtgtaattgtatttctacctctaccaagaccttattagcaatgcatggacttgatcctaagagaaacagggagccatagatacaggtatatgatattatgtaatcaaaagccctgaattacaagtgtaagaaaagaaggttgaaaccaagcagagaatgggggcagctgttatggccctctacttctatggtaccatgttatatttgggcatttttttttactttggatggtcataagcaatgtcttactctcttcttcctctctagtatacttgtaacactcagctttttagccctgagttaggtaagtcattgcttaagacacaggaactagggtgtatgataggccctggttaatttttccagcttcatgtcactttagcattttgcctattcagatatttctgtaaaggaaagtttatcgcatgttctagtttagtagaagaaaatgccaaatgaataaccagctcccataaatgaccttcaaatgagttgctatatttgatattagtttttaaattatgatacaggaatgactaggatttgaaaaagctctcccgtggtggtttgtgggcaaatttttgcaaatgttctgattttcagcgtgatttgagaaaagtatcttgagggtaagcaaatagggtattcagtgaagttaattgtactgtacctaggttttagaccattgaaatatgataaaaatcctgtttaatactattagaaaataaatgttttaaaatttatttgattcatgattggttcagttcctggaaattattgtcagttgagccttttcttataaagttagttttctttcatatctctccatctggttcagcaagggactgtcttatttggtttctactgtatatgtacattttcagtctgagtcttggtatttaggtttagtatagagaattacacttctggactaaccatatcgttttacagataaaatgaagcccagggaaggcaataagtaatgtgtctaattgtctgttacagtgattcaaaagcacattttctcactcatgttcttgtggggtttttgctacagactataacttctctagtgggggacccataagtatttgaaagcctaaataaattttaatattaatgagcatgaaattgtcatgctaaattttacctcagataatatatttatattgacctggacaagctaaaattgttcccattgcgtattttaaattacaattttattgattaaattgctgtcttaggtattgtatctggctcctcatgtggtttgttttaaaatagtaatattgaagttaaatgtatggatgctcacaacacagtcagcttgtttgattttattacgggtttcagaattttattttcagaaaaatcctttattgtgcttatgttaacatttaatcttgtattttctcattttccataattaaaatggagagagacaatgtagtttaggtggagggagtgggagtgaggaactgtgacattaacagctaggtaatttttgacaccatgaggaagttacttaatttctctctcaatttctttgctgtgcttcttgctacagagtgttattaggaaaaagaagaaggttttcaaaaggcaagtgctattttttttttaaagccaacctttttactatgttttataccactttctttggagggtagatagactgatgaacaaactgttcagaatgataatgtacgagtttatcttccacataattaaaccaagctaccaaatttagctgcaactttaagagaggttttttggctttttttttttgttcaattcagtttttagacatttctggtattttatttaatcgataactttgaactatattatttaatttgaaatgcttttaaatgttctcaaagcatcaaagtctaaagcataaaggtatatatatattggatttagtctaaaggttactatttttttttgaccagtagtaaccttcgtatcagctttcacatcgaaaaatattactgacctcctctagtggccaaaagattgttaatttaaaaacatgttcaggctggtattgctcttaaaagaaaaaaaaaaagatatgtcctaatataacaaaggtatggtctcattactgtagtattcagaagtagtaaaccttgatctgggtaggaggtgtttcagtaagtgcttcattgacccaagatgttattttttatttatgtagaacatgcttaggaatactgcttacaaatactaacaaatttgggaagcagtttttttgcaaaaaatttgtatgagggatcttaaagcaaatatgttgaaatggaaaaatactcctatagtaactatatttgaattccagattattaattttggtagaatttatgttttcaaaataatggattggtgattagaggttgtaaatgagttcaccttcttttttcttgtggaagagtaagtggaattaagaaaaagccagtatgcctttaaagtactgtccccaaaactggtgccactgggattttgaaagcatgttacaaattttaagaacatttaacactgtatcagttatgaccactgagtaatttcttctcattttcatccttacttccttaaccctgcttcaccctcaaaaagcagacattataaatgcaaataaaaactgtgggttttcaaagtggatatcttgagaagccaaagagatgtgttaacaaatttttatcagttttttagaacagtttgataacttttcttttagaactacttttggtccctatagtactttttaaaggtactgatatctttgatgatagatacgatttttgagagaaattaaaaactaattgagagccatgtcatataaataaaatcaatttaagaatttaagctcttcctttaatataatgagtcttttctttaatttttattctaaaatcaccaaaatgatttgaaatagctctattttgtgtaataaattgctctcaatatggttatgataggaacattcaggaaatttcacacaatgacagcatcattagcacaattgtagacattaccagaatgactaatttttaaacaatgaaggtgtatttgtgtgtatatttgtatttgttaaaaactcaaaatttttatatttgtagttattgtagttactggcataatgaaccctcattattaaattgaataacaatggaagtaggattcatgagtatactatcttttcttttttcttttttttttttttttttaatgagacagagtctcactctgttgcccaggctggagtgcagtggtacaatcccagcttactgcaacctctgcctcccgggttcaagcgagtctcctgcctcagcctcccaagtagctgggacaataggcgtgcaccaccacacccagctaattttcatatttttagtagagactgggttttgccatattggccaggctggtctcaaactcctgacctcaagtaatccacctgccttggcctcccaaagtgctgggattacaggcgtgagccatcatgcctggcctgttttctttttcattggaattatttatacagtatataatgaaacttatttaaatgaaattttattagacttagaagtacaagtgtactaaactcgtagcctccacatttatctgttacccatcacttaaaatgtgttgcatcgattttgctgaaatggagtcttgttttatcatgtctttgttgtaagatgatgttacttgttttgaaatagtggaacttgaagaaatacataagggcacaagacatatagtgaagacaccgttagtaaagtgtttaatgtttatattttgttttaagatcattttaaaaaatcagtagttttgacttgctctgtttaagactcattaatactggacatgaatagggtggattcatttggatttaaacttcatactgggccagttacagtggctcctgcctgtaatcccaggactttgagaggccaaggtaggagaatcgcttgaccccaacagtttgagaccagcctagacaacgtaataagaccccgtctttaaaaaagtaaaaaataaaaataaattagtggggcatctttgctgcatgccattagtcccagcatgcagcatacttgggaggctgagatgggaggattgtctgagcctgtgagatcgaggctcctgcaagccatgactgccactgcactccagcctgggtaacagagcgataccctgtctcaaaagaaaaaacatatatattcaaactgttgagttttgaatattttcaaataaatgtccaaaatgtgtttaatattataaaatatggattataagttgtagggggtattattatatttcaaaagacattccaattttgcttagaaatgaatcacacataggtatctaagtaacttctgaaataccttatattttcatctgttacagagagattcttatttttaattgcagtctcccatatttaaatctagcaaaagaaagaaaggaaagggaaagggaaggaaaaggaaacctttaccaaaaccagtataagaaatagagtactacacttacaaagctagcattgtgtctcagaaaagaagaaactagagccattttaggtaaaggacctaacatgatacctttgctctaggattttaatacacctcattctttcataagaattttccacacaggtggccgagtgcagtggctcacgcctgtaatcccagcacttagggaggccgaggcgggcagatcatgaggtcaggagatcgagaccatcctggctaacacggtgaaactctgtctctactaaaaatacaaaaaaattagccaggcatggtagcggacgtctgtagtcccagctactcgggaggccgaggcagaagaatggcgtgaacccgggaggtggagcttgcagtgcgccaagatcgcaccgctgcactccagcctgtgtgacagagcgatcctccgtctcaaaaaaaataaaataatttttcacacagggacctgccgctgccccagctggcatgcatgcatgcacagacccctataggtacacaaatatatgaggacacctgcaggtaccctgctggtgtgcacatgagcaaggacccccactgccccacctgtgcatatgtgcagggtgagggagccaccaccaccctaccagagtgcttttgccagcagtccccatcagagtgtttttaccagcagactgggaatgccttatccctccagtacagcaggtgcttaacctctaggggccagacagtaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggcaaaaagagtgagaccccatctctacaacaaatcaaaaaattacctgggtgtagtggcatgcacttgtagtcccagctactttggaggctgaggcaggaggaccactggagcctaggaggttgaggcttcagtgagccatgatcacaccactgcactccagcctgggtgacagcacgagaccctatctcgataaaacaaaatcagtaccatttctatacaccaataacatccaagctgagagtcagatcaggaatgcagtcccattcacagtaaccacaaaaggaattaaatacctaggaatacagctaaccaggtaagtgttaaagatctctacaatgagaattataaaacactgctgaaggaaattggagatgacacaaacaaatggaaaaacattccgtgcttatggataggaagaatcaatattgttaaaactgctgtaatgcccaaagcagtttacagattcattgccatttctatcaaactactaatgtcttttttcacagaattagaaaaaactattttaaaattcatatggtaccaataaaggtcccaaatagaacaatcctcagcaaaaagaacaaagctggaggtatcacactacctaattttaaactgtattacaatgctacagtaacaaaacagcatagtactggtacaaaaacagacacatgaccagtggaataggttagataacccagaaataaagcctcacaaccacaaccatctgttcttcgaaaaagttgacaaaaataagcaatagggaaaaggctccctatttaatacatggtgctagtataccaggctagccatatgcagaagattgaaactggatgccttcctctcaccttgtacaaaaattaactcaagatggattaaagacataaatgtaagttctaaaactataaaaacccaagtaggaaatctaggacatactggtctaggcataggccttggtgaagatttcatgaagaagtctccaaaagcaattgcaacaaaaacaaaaattgacaagtgaaacctaattatagagcttttgcaaagcaagagaaactatcaacagagtaaacagacaacatacagaaagagagaaagtatttgccaactatgcatacaacaaaggtctgatatccagaatataaggaacttaaatcaagcaaaacctaaacaaccccattaaacgatgggcaaaggacatgaacagacacttctcaaaagacatccatgctgccatcaagcatgtgaaaaagtgttcaacatcactgtttgttagataaatgtaaatcagaaccatctcaccaatcagaatgtgctgttacaacaaattcagaaaataacagcatgttggtgaggttgcagagaaaagggaatgcttggccgggcgtggtggctcatgcctgtaatcccagtactttgggaggccaaggcaggcggattacgacgtcagagatcgagaccatcctggctaacatggcaaaaccctgtctctactaaaaatacaaaaacaaaattagccgggtgtggtggctagcgcctgtagtcccagctattcaggaggctgaggcgagagaatggcatgaaccctggaggtggagcttgcagtgagttgagatcgcgccactgcattgcagcctgggtgacagagcaagtcttcatctcaaaaaaaaaaaagggggggggaatgtttatacactgctggtgggaacgtaaattagttcagccactgtggaatgtagtttggtgatttctcaaacaacttaaaacagaactaccatttgaccagcaatctcattactgtgtatatacccataggaatataaatcattcctccataaagaccacatgcatgtgtatgttcatcacaacatttttcacaatagcaaaaacatggaatgaacctaaatgcccatcaacagtagactggataaataaaatgtggcatatataccccatggaatactacacagccataaaaaggagtgagatcatgtcctttgcagccacatggatggaactggtggccattatccttagtaaactaatgcaggatcagaaaaacaaatactgcatgttttcatttataagtgagagcgaaataatgagaacacatgggccaaatcatggagcttatctaataatttatgtccaacattagctctaattagttcatttccaaccccataacacagagaagggatcaggtgggtgatgccaacagttcctgccatgacagagctcacatagcagggccacagaagcattgttcatccaaagtgtttcctgagctccctctgcctgctggaccacctcttcagtgtagtaagtctggaatgggtgctaattcccttcttcatgaaatggatgcagttagaggccattatcctaagtgaattaacacaggaacagaaaaccaaataccacatgttcttacttaaaagtgggaggtaaacattcagtacatatggacacaaagagggaaacaatagacactgggccctacttgagggtggaggatgggaggagggctagggacaaaaaaatacctgtcaggcactaagctcacgtcctaggtgatgaaattattttataccaaactccagcagcatgcaatttacccatgtaataaacctccacatgtattgcctgaacctaaaattaaaattgaaaaacagtaagtcttttgtttgtttgagatagtctgtctgtgtcacccagactggagtacagtggcacaatcctagctcagtgctatctcgaacttctggatgcaagggatcctcctgcctcggccttccaagtaactgagactacaggagcacaccacaatgccccactaacttttaaaaactttttttgtagagatggtgtctcgctttattgctcaggctggtcttgaactcctgggattaagcagttctcctgccttggcctccagagtgctgggattacaggtgtgagccactgcacctaatcaagaactctttttttttttgtgaactgattgctgtaattagaattccattttgctgtgattctgttatgttgaaacaagcttacatttttttctttatcaactttattggggtacaatttacatttacattcttaaaaagtacccattttaattgtacagtttcagttttgacagatgtagtctacacttcccacattttcttctacctctttgtattcagtgcccccattgtactctggcctgctcttgtttgtcatagattagttttgtcttttttaaaaatcagttttcttgaggcataatttgcataccatgaagtacatgcttttgattaccttttcattaatcattttcctggctccagaatgtttatattccttcatcactaagacattgctttgagatgtggattcatgtaagtctcggagaagagctttgattccaccttgtcttaaaattatgtgtaatttgttagccaattaagagttgagaacatattgaagtactttttatagatagaatgttttataagcaagcattattaaaaagtgtgaccattttactttggcaactggtaggtgttagaagtttgaaatttaagaggctacttgttttcatatggataaattcctagtgtctgcctgaaaatgtccatttcttttttcatgaactgttactttggttacagattcctttcctcctctcgtcatcctctttcttttttttttccattttgaccagatccatcatctgattattgatgttgggggtggggacaagtttcctcctcctttgagattgttactgttgtaccttcagagaattgtccctctttgttgctgttccttgccattgttactaccacttctaatctctactattctttttacccttgctttttttttttttttcattttttcttatatttggatgaacttatctagtttctgatagcttttcagcacttaacactgccaggaaccaaactttatggggaccatgggctcttaactgtttcaaggtaatatagaggacggcaggctatttttgatttacttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaccaggcattattcttttgctctcaagaagcaagaattatttaccctcttcagttttttactaaaagagttgtaaaatagctccaatgcagtgaaaggcaaaagtgtctatatgatcaaatagtactctcccaagggtaccataaatgacagctcaccattactttgaaaggacacaagtaatattttttcccatttcaaagtctttcacagttgttccacacaattttgtttaatttgaaaataccaaatgttatatttgcaaactgtcaggtattactgctttcttgttttctataaaaaatagggcttatttataagtgatatcacgaggttatcatcattcataagtggcttatcgctatcaagccaatagattcatcagtttcaagcctattcctagaagtattatattgaactagacagctctccttatcccatgccctcagttataaggtgcagaccttaaaagttgatgaaataccataggaccacatgaaatccagttttgttttacttgaattacatccccctattttatgttttgcagaaaggccacagtttacgtgagaagttggctgaaatggaaacatttagagacatcttatgtagacaagttgacacgctacagaagtactttgatgcctgtgctgatgctgtctctaaggatgaacttcaaagggataaaggttaattaggctattaccactatttttacttggagaatgaatggattaaaagcctcttgatctcaaagggtaatgtctttaagtgataaaggtgtttatagtcattttttgctgcaaacccccagtgaaacagatttcagtgtccttgtaacttgggtacttcagttacacatactaattcattttgatcatccataccagatgccattgaagacctttattttatttatttacttttttgttgagacatggtttcattctatcgcccaggctggagtgcagtggcgcgatcatagctcactgcagcctcaaacttctggcctcaagcaattctcccatctcagccacccaggttgctaggactacaggtgtgcatcaccacacccagctaatttatttttctattttttatagagacgggggtctcactatgttggtcaggttggtcttgaactcctggcctcaagcaatcttcccacttcggcctaccaaagtgttgagattataggtgtgagccaccacaccaggcaaagactttcaaatgatactctttattccattaaaaaatgatatctattatcttggtattatggatcatttcacattattattatgtctgataaatttagcccatgatgagtcttagaggagataagtatatgttaaatccttcagatctgaaatcaaccagttgatctctttctctttctccctctcatttctctttttctccccttctcttttctttttgccttttcctctctctctctttttctttctttttttttttgagacagagtctcgctctgtcaccaggctggagtgcagtcgcgtgatctcggctcgctgcaacctccggctccctggttcaagtgattgtcctgcctcagcctcccaagtagctgggattacaggcacgtgccaccatgcccagctaatttttgtatttttagtagagacggggttttggccaggatggtcttaatctcctgacctcatgatctgcccgcctcggccttccaaagtgctgggattacaggcctgagccaccgcgctcggccccctctctctctcagtctctccctttctctaccctttttctcatagaagaagaatcagtaatagaaatggaagtaataattgtatgtacatttaaaaataattttattgagttcttatttaaaagaaacaagatatcttcaattaacttttagtgttaggtttatagtttaactttcctttgttagtcccaaaaatactgctgatgtcaacattgttcttcagctttttcacttaatttattgtgatggcaaaaattaactactctaccattattaccaaacaggactaagttcatccccaatataactaggtggcttgacatggtttcatttctcttttttattaaatgtgtttgatctggatccaagttctttttgtctattctatattccctttttctgccttctttggatgaaatttttttcatatatatataattccactttatctcctttgttagcttcttaggtataactcgtggttttgttattttagtggctactttaaggtttatagtttgcatatttaacttaccacagtctgccttcaagtaatataccactttatgtgtagtatcagaaccttccaataatgtagtagaatgttcatagctccctgtgaccttaaactcctgggctcaagtgatcctcctgcctcaacttccgaactggctaggactacaggcatacaccgtcatatctggttaatttttaaattttttgtagagatgaggtctcgctatgtggcccaggctggtctttaaactcctggcctcaagggattctcccacctcaactgcccaaagtactagaattacaggcttgagccattgtgcctggccttgaagttctatttgttaatataaaaacttttattaaaggttttggttcgttaatgtgtgattttttttttttcccctctaaaaatagaaaacacctgaacttctgtttctccttcattaaaaaagtataccttttaatcaatttaaatgttacagattagctttaaacaaaaacaggatacatatagaatatgatgccttgtttatcttaatggtccataccaatagcgtatagtattagaaggacaaaagtgatggtggaaaaagtggaagttggaatgcagtgataaccaggttgtgtagatgatttgaaaaataataatagacattacacggaatcttttctgctacatgtttaaataaatagcaaattgaagactgatgtattagtttgctagggctgccatatcaaagtaccacagactgggtggcttaaacaacagatttattttctcacagttctgagataaaggtattggcagggttggtttcttctgaaggccatgaaggaaaaacctgttccacgcctctctccttggcttataggtagcctccctatatcttcacatcatcatctttccctttgtatgtgtctgtgtccaaatttcttctgcatattgtacagtcatagtggattagtgcccatcctaatgaccccatgttaacttaattactgctttacaaaccttgtctccaaataacagccatattctaaggtactggagattaaggacttcaacatatgaatttctgagacacaattcagcccataacaactgatttccctacaaatgttatttgtgagatactgactgattgattgatcctttgatttttatttgatactgggtctccctctgtcacccaggctggagtgcagtggcacaatcttggctcactgcaacctccgccccccaggcccaagcagtcctcccacctcagccttcccaagtagttgggactacagatgtgcaccaccatgcccagctaattgttgtattttttgtagagacagggttttgccatgttgcccaggcttgtctcaaactcctgagctcaagcagtctgcttgcctctgcctcccaaagtgctgggattacaggcataagccaccacgcccagcctgaaaaagctattttgtgtctgttttggaggtggaaggttatggtaaaggggtagtttgagaggaagatttaatgtgctggtggctgagaaatatttgggtggcaaaaataaatagatgtctggctgatactgtaatcatctcggggagctttaaaaaagaaataattgtatcatacccttcaccatagtctcactaaaccagaatattcaggggttgaggggagagagagagattaacgttttgttctttaaaagttccttgataggtagataatcaaaagttccttgatatgtggataccctctctagtagaagtatgagctagcattataaacaagccttctgaaggcagaaggaaagcacagcagaaaggggaaaacaaatattgtacagaaggcttttgagttttccaagaaaacaactcctttaaattgtgagaataggtcaaatctagagcaaatgaaatatctcctgcttctgtagaaaagaatgcatgaaggtagagttgaagagtgagtaacaaactgttttaacttttcattgatatgatgcaaaaaagtagggaaatttgaaaaggccccgggaagtaaggatctcaaaaggtacttgaaggtcatctttatgggattatgccaggggactaatttaggaatagtcgtattataacttcaactgatggtcagcatgattttttatctgagtatggtttaaaaataatgtatctaaagacattgcacagcatatttattgagcatatgagatcttactcatctttgtattttcactggtaatcaagatatgctcatattgaagtctgtaggaatgatggaagtggaaaagaaaaagaattgaatattgagatcacagccaggtagaaatgaatacagggtattaatagataatagtttatgatttgtaagagttgttatagatgattgacaacattttcaagtggttataaaaaaatgaaatagtccagtaattagaaaatnnnnnnnnnnnnnnnnnnnncatgtaggctgggtccagtggcttacacctgtaatcccagcattttgagaggcagaggtgggcagattgcttgagctcaggagttgaaaccggcctgggcaacatggcaaaacctcatctctacaaaaattagctgggctggtggtgtgcacctgtgttcccagctgctcaaggggctgagtaggattgcttgagcctgggaggtggaggttgcagtgagctgagattgtgccactgcactccaggctgggcaacagagccagaccctgtctcacaaacaagaagaagaagaagccacaaaaagcttgataaaagcagcaaataatgttgggaactaagatgcaggaatttgcattatgagtggaatgcgtagtacagagaattaaagcatgtggcgtagtagaaaaagggatagcacatagaagaaagaggtatgttaaagtagaacaagagagattctgtttttgtctggaattagagaaaagggatgcctggatacagatacagcctgggatgaatgaaaattgatatcatggtcaggagattgagaccggattcctggctaacatggtcaaaccccgtctctactaaaaatacaaaaaattagccaggcatggtggcaggcgcctgtagtcccagctactcgggaggctgaggcaggagaatggtgtgaacccgggaggtggagcttgcagtgagccgagatcgcgccactgcactccagcctgggcgacagagcaagactccgcctcaaaaaaaaaaaaaacagtcgatatcatatctgcaagtcattatattttccttgcacatcagaaatagtatatataagaactctcgcctgggtgtggtcactcacacctgtaatcccagcacattgggaggccgaggtgggcggatcatgaggccaggagtttcgaaaccagcctggccaacatagtgaaaccccttctctactaaaaatacaaaaatattagctggctgtggtggcacgcacctgtagtcccagctacttgggaggctgaggtggaagaattgcttgaacctaggaggcagaggttgcagtgagccgagaccatgccattgcactccagcctgggtgacagagtgagactccatctacaaaaaaaaaaaaaagaacaactcttagaggcaagctaaggtgtcttctgcatagaaggcacccttatagtcctgttcagcccttctggtcctcttacagagtggaaatggccccacggaagggagcaagagataggaagactacagggtgaaataattcataactcagtaaccttcccttacacaaatgagagtgaatatggtttaaaaataatgtatctaaagacattccacatatttgggtggcaaaaataaatagatggctgatactgtaatcatctcggggagctttaaaaagaaataattgtatcatacccttctccatagtctcactaaatgagaatattcaggggttgaggggagagagagagattaagattttgttctttaaaagttccttgataggtagatatttattgagcataccttgattaccagtgaaaatacaaagatgagtaagacttcatactcagaatcagaatccagagtaaaatgactcagttgaacataagaatagacattaatttctatttcttttcatcctaatttccttaaatatattttatttagtggtagaagatgatgaagatgactttcctacaacgcgttctgatggtgacttcttgcatagtaccaacggcaataaagaaaagtgtaagtaatacatttttcccctcagctggataaaatatactttcagaagttatgtaacaactcacaagaaataattacctgattaattttttaaaaagcagtagaactggtggaatccaagtgaaaatatcttccaaggcatgcaggtaaaaatcacattctgacattatgtaataatggtaacttttacataaggatgtccagctgtcccagcatcatttgctgaaaagacaatttttttcccttgtcttggcaccttcgtgaaaatctgatagactgtaaatgcgagggtttatttctggattctcagttctgttgagttgatgtacgtgcgtattcttattaagaaaatataagctttaaaaaagctttattgagatacaattgacataccatttaaagtgtataatttgataaatttggatattttcgtgaaactatcaacacaatcaagatagttaacatttatatcaccttcaaaagttttctccatcccctttgtcattcctctctcccccattcctgaatagccactgatctattttctgacactatagattagtttgcattttctataatctaatataaatggagtcatacagtatgtattctttttttgcctggcttttttcttagtttgagattcatcattattgttgcatatatcagtagttcagttcttctcatagctcagtagtattttattgtatagatataccatagtttgtgtatctagtcattcattggtggacatttgggtcggttacagttttgactattacaaataaaactgctatgagcattcatatacaattctattcatggaaatttattgtatttattttgggtaaatacctaggagtagaatgttctaatcatatggcgggtgtgggtgtgtttaatttttaaagaaactgccaaactgttttttaccagccacatatgagagtcccagttcctccatatccccaccaacacttaatatggtcagtcttcaaatttcagtcattctaataggtgtgtagggatatgtcattgtggttttaatttgcatttccatattaactagtgatattaagcaccttttcatgtttttatttgccatttatatctgctctttggtgaagtgtgtgttcacattttttactcatgttgggcttggtgattattattattattattttgagacagagtttccctcttgttacccaggctggagtgcagtgtggtgatctcagctcaccgcaacctccacctcccggtttcaagtgattgtcctgcttcagcctcctgagtagctgggattacaggcatgcgccaccacacccagctaattttgtatttttagtggagacggggtttctccatgtttgtcaggctggtctcgaactcccagcttcaggtgatccgcccgccttggcctcccaaagtgctgggattacaggcgtgagccaccgcgcccagccagtgtttattattaatgagctttgaggttacttcatatattctggatagaagtctttattaaatatatgccacacaagattttctcccagtttgtggcttatctctttatcctcttaacagtgttttcaagagcagaaattttacattttgatttaagtttcacaatttgttctttgatggattatacctttactgtcatatctctaatcgtttttaaagtcaaaattgacattatttcatttataattattctactagaatgatttcttaactatagaatattatgatttcttgtttgcatctttgagttttaagattttttgtttaattcaaaagctaaccatgaattaaaatgataaaattgaaacgtaaaaggcattgagtttaagtgcattggtcctggatttaaatttgtatgtttatttttaaattgtatattattttattagattctttagtttatcttcagattttttttaattctaggcttttcaaaataataaggtagttcttgccataattaggtcctactctaagctgtcagaatgttattgttaaagtattgctcctcctaccatttgattaattgggtgcagcacagcaaataaatttcaggaaacagaatctagaaaaaaaggacttgaaagtacatatgctgccacgaagcttctttgcttatagagcttggataggagatttttaaatgttggcctacaggaggaaaattaaaatcccaaaacctgctctgacttgctaattttctaaacattttctaatcttaaattgtgatgaattatttcctcattagagatattttcagtgaataattttcattttcagtatttccacatgtgacaccaaaaggaattaatggtatagactttaaaggggaagcgataacttttaaagcaactactgctggaatccttgcaacactttctcattgtattgaactaatggttaaacgtgaggacagctggcagaagagactggataaggtaagactaggtttttttccttttaaaaataatcacatttaagttttacgtattgtttgaatatttaaaacaagctaacttcttagggaagaatcttgggttgatagaaatagcagatgatactactactctgaagctttatgggcatcctaaactcatttgcctaacaagattcaccaattacttgtttagttactatacagtatgctttcttgaaagatttaatataaaagtttttgtgatgatgttagtaatgctttggaatagaagtgttgagccatttaacattacacacctttaggtgcatgatgtatgaaactgcatttaaggcatatgaactaacttatatgccaatttacaaagttaaacatttacttattatagtaatactcatgtattttttccatggtcagtgataccatttaacatacattatgttgtttgagcatttgccctatgttcacattttcccacctttgtttaaactgcagcactgataatattatagtatgactctttagtttctagtgtgaagcatggctcagtggatttgttaagtaggaaaacttctatttataattcagctttagaataatagtaaaatgttagagttgaaacataccttaaagttctagtccaatgccatcattttatagaagaaggaattgaggcccagaggcttgtcaaaaggtgaaaagtaatagagttagaggcatttttctctattcttttatatatcagctctggatgccagattagacatcagccagaatcatattcattctgagttatattgcttgcagagtttgaaggcctttgaatttgagcgggacactaaggaaagcaatgatagcactatgtgtttaggaaggttcccatgttttagaagaaaagagagctgttcagaatgcacaagtgcaggtgagagtaagccattttgattaggaatatgtcttcttttaaaataggtaatgaaaacatccttttaaggtatagaaaatttattatcattctggagccaaactattattatcttcaaagatttcaactctatactcagtgtggatcaaattgaattattagaagagtccctgttcacaaaaaaaaaacaatgtattgaaaaacaggacaactccctaaatacattagactaatggttcaagattatcattcagctagtccagactagcttatttccaactttttggcaactttctctctctttagtctctttttccttcactaagggatcatattctttggtcatatactctaaccacattgcctaaaataattttttttaaacctttgcacattatataccacttcctgattattttagcattcaagtttatttgccatgttgaaaaggggagatagatttttgattgctttcagcattgttaatcttaccagttctctttctttattgggtagcaatgagcagagcaaaccaaagatctgcgggaaaaaaaccacttttgttgcttctccatgcaacactctccaccaaagaacagccagaaaagatggcaggcagtattggttaaaatctggacactactgtgttttatagtcttcttacagatctatctgatgtcaaattttattaaccttttccactgtaattttttctcaaggttgaaataactggatcccagttacattttacatggaatgtaagtgtgtgtgtatttgcacatgtgtgtacacacagtatgtgtgtgttcatatatatatacataatatatgcagggtatgtgtgtatttattggtaagcaactctattcaagaactttctaatcttttgtatgtagagtgtgtgtgtgtgtgtgtgtgtatatatacacactaaagactagaaagttcttaaatagagaaagttgtttatcaacaaatacgtctttcaggtaattcttagaattgagaaagaaagtacaatgataacaatatggtttcactgaaattgtttcattcaggtgtgtgcctgctgtgtgcttgactctaagctaggaatgggaaaacagtgatgagcaggaaatagtctctcaaggggcttaaaatctaatgagagcaattaaataggtgataataacagctatttaataatagaattgtctatattatacttttatgtagatttataatgtcagttccaggattctttcagctaattgaaaatactattttgtagtgatgatttttattggttacctataataataatgatcctttccactgtagaagaagtgtacttaattgttagccagtcatgtccaggaaaaccaaaaattctaaaattaggcaattatggttaacagtgttaataagagataacctgttcattgaagatacattttcttacattattagattcacaggtgtgtacttttacatacattttcactttcctgtaagtctttaatattattgctgtgctgtgcatttttgttttattcatttaaaattaatacataacatacatacaatgaagtgtaccaatcttaagtatactacctgattttttttaacgtttgtatacaccccttaaccatagacagatcaagatatataacttttctagcaccctagaaggttccttcatgctccttcctattccatatcataccaccaccccaagaggtgatcatatggttttaacctatgtcattatagattagttttgcctgttctggaacaacatacaaatggaatcatacagtatacttttgagtcaggccttctctttccttcaacatttgactgtgagattcattcatgttgttatatttaatagtagtttattcttttttattgctatacactattttattgtataactttttattgtatgacttcaatttgcttatctattttcctgttggtggacatttagatttttttcattttttggctatcatgaatgaaactgctatgagagttcttggggcatatctttaggtatatttctcataccttggagtagacttcttgattcataggggtatatgcttaactttagtggatactgatgattttccaaagtgattatttctaccagcaatgggtgaggattccaattatttttaattcttgacagcattttggtattgttagggatgtgtgggtgtgtgggtgttgttgatgttgttcactcttgactgtacttggtattgtgtgtgtgtgcgtctgtgtgtgtgtgtgtgtataggtgttggtgttgtttgattttggggacagtctttctttttttgagagacagggtctcactgtgttgtccaggctgaagtgcaatgactattcacagacacagccattagtatactacagccttgaactccagggctcgggtgatcctcctgcctcagcctcctgaatgaccaggactacaggcacatgccactgcacctggcttagtcattctggtggatctgtagtcccattttctctttagtacacaaaaatcaattaatgaaatctttgggtctaatgaacccattgattcattgatttccactgtctttaacgctgatgtggtatttagaagtagtttgctttgtgtgagttcagtttagactttagccattaagttcagtgatacactgcataacgacatttccgtcagtgatggaccacatatacaactgtggtcccataacatgataatggagctgaataattccttttgcctagtgacatcttgatgatcctgaccctgtgtaggcctaggctaatgtgtgtgttgtctcttagtttataacaaaaaagtttaaaaagttaaaaaaaataaattttttaaaaaatagaaaaatgtttgtagaatacagtataaagaaaatatttttgtgctgctgtacaatgtttatgttttaagatatcttattacaaaagactcaaaaagtttaaaaaattaaaaagtttataaagtaaaagttacagtaagctaaggttgttattgaaggaagaacatttttaaataaatgtagtgtagcctaagtatgcagtgttaaaagtttacagtggtgtgcagtaatgtcctacgccttcacattcattgactactcactcactcactcaccctgaggaacttcaaatcctgcaagctccattcataagtgccctgtgcaagtatactgttttttatcttttatatcatatttttcctgtcccttttctatgtttagattcacaaatacttaaccatcatgttaaaattgccttcagtattcagtgcagtcatatgttgtaaatgtttatagcctagatgtgtagtaggctataccatctaggtttatataagtacactctatgatgtttatacaagaattaagtcgtcagtgacacatttctcagactgtatccccatggtgaactaacatgtgacagtaaatacatgtggctttcactagccttctttagatcacaagcataatctgttctcttatgatttttgatgatcacgctcttcagagtagtgtttttttgggaataaggggaaataggaagagctgtttacatttcctgtagccagagtgaccatgaatcctggtttgaccaaggcagttcttaattcagcaagattattactaacattccctttcgctttcaaaagtgtggtgcttacattacccaatagggggaccaagcaaatcagtcttttagaaaatggaatttggacaaggtaaaaaaaagaaagaaaagaaaaaagccatgtatgactatttgaaatgaggaaataaaagcattagattatttacaaacatactggactccagtatcagttttgacccagtgaaccccattgttgtggaaataagttttatatgggaccaacctttgttattttaagtgttgaccctgggtcttttaaccttttagagctataggccctatcattaaaaggagagtgttaaaatacataactaaagtctttttcaacgctaaaatacagtcttaagcagcagtgagaaagtataagaaggttttctttcttagaatatctttttagcattcattgatcccacctactgagttcttttctggtattacttgctgtttttcttcataccaaaataaatgtatctcttaactggggttggtgggaaggggaagtataagaatgtatagtaggtatttttcaggtgctaatttacctgggtttttttcttttcttttctttttaagtatacatgcagttacttaaccatttaaacacataacctacttttaaggtgattttagtggtgatttaaatcgtaggttgtggccgggtgcagtggctcacacctgtaatcccagcactttgggaggctgaggagggtggatcacgaggtgaggagttcgagaaaagcctgacaaacatagtgaaaccccatctctactaaaaataccaaaattagctgggtgtgatggcacaagcctgtaatcccagctacttgggaggctgaggcaggagaattgcttgaacccaggaggcggaggttgcagtgagccgagaccatgccattgcactccagcctgggtgacagagcaagactccgtctcaaaaaatacatacatacatacatacataaatagtaggttgtaagtaatttatagcctagagaaaagtgttttcttgggcagaataatactcttatttttcacaggagtggaatttttttgtgtcaaattgtaaaatttcagtgaaatgtagaggaattccacctaaaagacttcattgtaattaaaatgcctgcctcaaattacagatttttcacttctttttaataggaaactgagaagaaaagaagaacagaggaagcatataaaaatgcaatgacagaacttaagaaaaaatcccactttggaggaccagattatgaagtatgaatttatattttgatcttagagaaacacatagatcatgtctatcacaaaagtgattttttaataatactcttgtaacctttaaatattctaaatatataattttttcctcagtgtttatgttaattcagtgtatatttcatgatatataaatgccaggcatgctcaaatatatatttcttattgcctacaaagtttaggcttcaaaaggcttagtattaggcctgttcacttgataggacaaatttttatctcccctgtaaagatgatcatttttaatgttatctactttttttttttttttaacataaaagcaaactataaaggaaaaatctgagtactttgcagacaaaaagattttagtctgtactatactgtgagatctttttttttttttttgagaccgagtctcgctgtgtcacccaggctggagtgcagtggcgcgatctcggctcactgcaagctccgcctcccgggttcacgccattctcctgcctcagctgccctagtagctgggactacaggcacccgccaccacgcctggctaatttttttgtatttttagtagagacggggtttcaccatgttagccaggatggtctcgatctcctgacctcgtgatccgcccgcctcagcctcccaaagtgctggcattacaggcgtgagccaccccgcccggcctactgtgagatcttatccatagctgaacataaaactgttctaattgtctttgtttgaaaatgtctgaaaccagcttttttctccttgtgtttatttgttaagcaggtaataaaatctccttcacatgtatatacacacatacattaaaatcttataagctttctatattaagagaaaaaaatgtgtaagaaatatatttggtaattgccattaaacaatgttgaggctagcgcactggctcacatctgtaatcccagcactttgagaggccaaggcaggaggattgcttgaggccaggagttcaagaccaacctggacagcatagcaagacttcatctctataaaataaaataacaaaaattatctgggtatagtggcacatgcctgtagtcccagctactgaggagcccaagactgcagtgagctacgattgcaccactccactccaggctgggtgacagagcgagactttgtctctttaaaaaaaaaaaaaaaacgtgttggccagcacggtggttcacacctgtaatctcagcactttgggaggctgaggcggggggatcacaaggtcaagagctcgagaccagcctggccaatatggtgaaaccccgtctctactaaaaaaatgcaaaaattagccgggcgtggttgtgagtgcctgttgtcccagctactcgggaggctgaggcaggagaatcacttgaacccgggaggcagaggttgcagtgagctgagatcgtgccactgcgctccagcctgggcaacagagcgagactccgtctcaaaaaaaaaagtgttgatatttctgaaatgagcagtttaaaaatggggtatcaaggagtaccactgaggtggaacagaagaataaaatagttgtagttatatttatgaaaacagaagaattttttcttgctacttttgctctagaaaggaaaactaaacagctgctctgctgttgctgaatttttttgcattggaatcaatttccaactgtgagagtgcattctgatgagacttaaattgtaatatttttaaattattctcaatttatcccttctaaaatgtattaaaattacataattagctatcctctgaggttttaatatgaggtattataatgatgatttttgttttgaaactaaacaaattattttgctattttagaattattattttggaagaaataccaactttttaaagtaccttattttttaatattataaataaaatgtatattcattataggaagattgtacaaaaattcaaataagccaataaagcccatgttttaaatttaacaatatatggtacagtttatcatctaccagcagtatgtaagtataatttgtgtacatatttatctctgcttccatcaacacaggttttgttttttttttcctaggggtagaggacaggggtggagggaagaggggccttgtgctaggtacatgcatttactagtttcaaagccaaaaaattgctttatgtatgtaattgagcattttaaaaattatgtttatcagatattcatgtttcttttttttttattttattttacattggaagtacacatgcatgtttgttacatgagtatattgtgtactggcagagattgggcttctagtgtgccccttacccaaatagtgaacattataccaaatagctaattttttaactctcacccctccctcccaaccttcctccttttagagtccctacatttccatctttatgtctgtgtgtacctattatttagctcccactcataaatgagaacatgcagtatttgactttctgtttgtgagttaatttgttctgggaccaaactgaggttcgggctgctatttctcacggcccaataacgagatgcagatgaactggggaggaagagagttatttctgtaactggttacagggagaaggtctgaacatcatcaccagaccaactccaaattacaaagttttccagagcttatataccttctaagctatatgtctacctgtaagtgtgcattcacctaaagacataagttactaacttcttttaatctataactaaggtctgagtcctgaagaccttcctttggagcctcagtaaagtgctagagtgattacccttatcgtgtctcctactatatcacataggtttgaggagttccttcagacccctaatacacttgtttgtggaggactggggagtttcttcagacccccagtaaaacttgtttaatcctaaatggctcctattaagaattccttcattattgaagaaacaaggagttgttcaatgggaacagagtttcagttttgtaagatgaaaaagttctagagatcttttacattgcaatgtgcatatacagtaattaacactattgtactatacacttaaaaattgttaagatggtcaattttatgttttttttttttaccataataaaaaaaaaacaattgtgccaaaaaaaaaaaaaaaagaattccttcattattttatcacgctttaaggcccaggaaaggcctaggcaaaactcttgatgggcttttgttacatcccagcctttgtataagggcactggcttttaatatttaacttaaacattcagtcagtactgaaatggttgtttagtgagacctggcctgtgacaagttcactttggataatggcctccagctccatccatgttgctgcaaagaatatgatttcattcttttttatggctgccacgtttcttttttacgattaacttggccatgtcctttggttgttttcttattcgttttttttgtttgtttgtttgtttgggttttttttccctattgatttagaagatgtatagaatttgcctttttttttttttaatttttttccttcgtaccttaaaaaagtttggtagattttgacatataaaagttttaaaccttcgtgtaattaactcctcagtcctttgatccacttttctccacatttggtatcatgcttagaagggcattttctattttaaataatcatattttctaattttttattttccaatggtctcttctaaatatattaatacatctggagtttttaaaataatgatacaatatagaaacctattttattccactagcatttgttgaataaacatcctttattcacctatttgaaatgcactttactctttcttagtgaagaaactggttaagggtactctaattattttttttctcactaagttaaattaaatatacaattctttagataaactgggaactgtttttacacttccccttcttttggagttttgaaccatctatcttttcttgtaacaatattatagtcgtatgggttttagacacttaattcaaactatgactctttttggttataatcagacattcatgatgttctaattataaaaaagttctaagtgtttctgacttctgtagcctcagaaattactttataatcttaaatttattccttaagacttaccataatgtggctgggtgtggtggctcacatctgtaataccaacactttgggaggccgaggcgggcagatcacctgaggtcaggagttcaagagcagcctggccaacatggtgaaacgccctctctactaaaaatacaaaaattagctgtattaggcatggtggtgtgcacctgtagtcccatctactcgggagtctgaggcaggagaattgcttgaaccggcaggcggaagctgcagtgagccaagacctcgctactgcactccagcctgggcaaccaactgagactccatctcaaaaaaaaaaaaaaaagacttaccataatgtagggcactacactaggcttggagaatacaacaagaaacaaggcttataaggatcctgcctaagggccctacctgaatgcataatgggaacaaaggctaatagacagttatcataatgtatgtcatgaaacacttttaatgcagggaaggtgttgaatcagagatgtcttcccggagggaaagaacctcttaggaggaaagaacctcttagcagaaaccttaagaatgagtaaattgagtaaagagtgttttccagtagtcagaagcaaaataatatttttcctcaggggaactgaaagtaattctctttggaaggtagagcctccacaaattgagaggaaagaatggttaagagactgactggaaagatcaacaagaattagttcagatcctgagacaataggttttaatcaagaaaatgacattttcacatttgcagttcagaaaagtcattctccctgcagtaggaagaatggattgaaagtaacaattgtgactgggcacttggacactttttgtataatatagatgagagttgaaggtggcctaaattagagtcaaagcaggaggaatagagaggcactgacaaattagatacagtaatcccattgtatcagtggttgggggggatacattacaagacccccccccccccagtaactgcagatagtactgaaccctatatacactgttttttcctatatgtgctatgttttttcctatatgtatgtacctgtgataaagtttaatttttattttaacaataataaaatagaacaattatagtactgtattatagtaaaaagttatatgaatgtagtctctttctctctcaaaatatcttattgtatataaaccacataaatcaaaaccacagatgggggagactattgtatttggaaagtagaattgaagggtgtgatgattgaatgagggaaaaggaaggaatccaagattaggcccaggtttctgcagatacgtgtggagatagaagaggaggtttcagacacgttgcaattgaggtgagtcatatgaggaagtcttctatattagatacaaagatctgacccttagaagagagatggtctggctgtgaatttaggagtcatcaaaggatgactgaagcgttggatataagtaagaatgctgtgggtagagcaagtatggaaccctgaggaacaccaacatttaaaggataggcagagaaggggaaacctacaaaggagccccataagagtgcttagagagggagaggggaatttaggaatctaagggtagagaactcttcaaggagagttgttaacataagaaatgctattctaagggggcagataagtagctcctgcccttagtaagcatgatgagataaaagggttttttttaaagtcccttttaataaagaaaattttatgccaattcctttagttcctctcccaaaggtttaccattaaaggaaaaaccatttcatttggcaaaatagaatttttgttgttgttgttgttgttgttgtttgagactgagtcttgctctaccacccaggctggagtgcagtggtgcgatcttggctcactgcaacctctgcaacttccgcctcccaggttcaagcaattattgtgcctcctcctcctgagtactaggtttatagacgtgctccaccacacccactgatttttgtatttttgatagagacaggttttcgtcatgttggcctggctagtccagagctcctggcctcatgtgatctcccctccttggtctcccagagtgctgggtttataggcatgagccaccatacttggccagaatttttaaatgctgtagttttcaattagactcctgaggctctgacatgattgcttaaggactagaaatccacatgtactaaatcactgtagattgaatgaatattaatattttttaaatgtagatgtggttaaatagtatttaaaatcattagaaaatatgcttgagtttggatattttgtgttttctctgatcaacagagagcaaagttgtcctgctgtcattttactgtctttgaaatgttttgattttgtaaagagaatcctgcaggaggaaggcctctagggtgttgttactattttttcatgaccctcttgtcccagatggtcattagatggtatattcactttgtgatgcttcactaagatatgcactgttctgtatgtttgttgtatctgaatagaaagttgtttttttttttttttttttttttatgaagtaggttgtaggggactgagtcctcataaccctaaaagaagaactccattaagtcaacatttcttatatgccaaatgacaagaacgtgaccccatacctcccacccttccagtgtagttccaggttatggtggggataggacgatgttgctagatactttttaatggactaatgatgacttggggttatgagtttaactgggaagatttcaccaattgttcatgtgtcttattttatatattttaacatttaagaaatgctaaacccaagcctaccttttagtctctacttttatcataatacaaagctgttgttccacttacttggttcatcacagcaggaacatatgttgattgtttacattttgttattgttctttgtatgtttatcttctgatgcagctgaggttccacttgcatgggaatcacttgagggaattattaaacatgtatattccaaggttccactgaagacctactaagaaataatttttggccatggaggcctgggaattttcattgtaagaagtctcccacacaattccccaagtgattgatggccattattctgccatctagccagactatcaagcatcaactcaacttttatttccccatgaaacaattacctgtgcttaggaagatccgcctctgaatgcctagccgtacttattagctatagttcttgtgcaaatttttacttacctcattgcaattttatatctctgttgtctctgtcataagtctcaactctgctactaaagaagccctagataatatatagctgaatgagcatcactgttttccagtaaaactttatggacaccaaacttttaatttcaagtaattcacacatgtcatattattacttttattttttccagccatttaaaaatgaaattcttagctcacaggctgtacaaaagtaggcagcagactggatttggcccttgggccatagtttttgccaatctctgctctagactattatcccaacacaatattggtcaatatacagtaagtaaatatatgagtactgagtgaattaattgtaacactcgtgattttacacagagcatgcatatgatctagtatactgactgctttgtaaatatgtgttcaataaatgtttattaggtcaattttcaaactcaagttaataccagagttatcagagttttctgtttctttaaataaactgcttttttctccactgtgtgttggaataggaaggccctaacagtctgattaatgaagaagagttctttgatgctgttgaagctgctcttgacagacaagataaaatagaagaacaggtatatctattattgaaaattctaagctgaaatttattttaacactataggcattccttggtgtatattatttcatgtaaatagaatttgaacattgtgaacttaataacctagaagcttaactgtgaatacattgagtcacaaatgtaaaataatctttttttttttttttgagacagagtctcgctctgttgcccaggctagaatgcagtggcgcgatctcggcttactgcaacttccacctcctgggttcaagcgattcttctgcctcagcctcccgagtagctgggactacaggtgcgcgccaccgtgcctgactaaatttttttgtgtttttagtagagacggggttttaccatattggccaggctggtctcgaactccagagctcatgatccacccgcctcagcctcccaaagtgctgggattgattacaggcatgagccatggtactggccgtaaaataatctttataagtcagttcctttatatgtgaatttccaagcaatagaaagaaaaccaataattgttaaaaggaaccatgcgtaattaacatgaacttaaatagaaatgctctttttgcttatttccctttaagtgtccagcttaaaacattcttttaatataaagcatatatttagtctaagtaaaaagcttctttgaatttttcttcaccaagtatgatatgaaaaggaagatgaccaaaaacttaaggtttttcatctatattagtattgtttttattaacccctttattaccttcactacttcaccttcagtttctttctcacttttgctttgttcagtgttttgtcatcattattgagtgtatagcagttacacccagctgctgtggaaattgaagaaaagtatttcttaaacccattaactagcttcaagattaatttgatactttgtcttctttaatttggcaacagtacagttaccatacgttacaactagatggtacttaaggatgaattttgttatttcctccccttgtttaagctatgctagttatggtggaagcttaacctttttggggggcaagtattaataaactgtggctacagagtatcttgccaaataatcatgtatgtgtcagttttatactacaaatgaatttgcatagaaaagttggcttgttcgtttcttatcattgctaagacagtcatggctattatgctcttattggtctacctaagggtaaatcacctgcagtagtaactgcttctcatgtgtatctttcgttatttttttaaaaattactgataaaaagttcatgtcacattaatttgtaaagcttattgctcattttttttatacccaaaagatgctatgtaccactcaagaagagtgggaacttttagttcctaaatgggctctacttttggaaacctaaagtactacctgaagtagcattatttatttgtttcccttagttttttgtctaggatgtgctgttttgggaaaaagtagtgaatgagtcaagacacctcagtcttactcttagttttacctctaactaactttgtagctatgaacttatcactgaattctctgggccttggttttctaatctgtgaaacaaaggagacaagatgattcaaaacatctcttctctctaaaatgctactctactgaatatcagtatggtgattgagttgggtttgagagaattgatgaacccttccgtaagctttagaaaaagaaatattcatggggccatccaatcaacttcattctattcttgacactgtactagatgctctgcaaaatagtcattgaacagagcattgtttttcttgcctaagagccaggcatgttgatatgacagagatacagtgtggtaatactctatagagtagtgagagcttcagtaatccataaaatcagttccatagatttagatcatttccctcttcatattcagtgtatattgcacagatctctcaacaacacagccattaaatagatattctccaagtgacacttacatcacacatgtttgagtttacgttacttgcaaacatagggaaagaaagatacatgggataaactggtgcatgagaaatgagatcttagcagttggttgaaataaatgagaacaactgaggcaaactaaagaggaagaagggcaagtggcagcttaacaggagtaagatgatgagatgaagggcagaataccttcatggagaggaggcaaagagatatacatgatatgttcttaggaacataactgaagcaaacaatgatattatttctaattatatataaacctgtgagtcagccttccaggggcggcctgctaaggtagaatcattggaatgatttggccagggtttggataggagagaattggcagcagcgttaagattgacccatgataaataatgctatgcaggtagcagggagtctgactaggagcaaaatcaacgaacttatcccttgcctaacatagtatctgtggagtcagaaagaagaggttaaattgggatatctgaggcaagtatcaggatttgccatgtctgcggagtagtttcataattctaatggttataagcactaaggcgttcactaagtgaatgttggtagttccaggttatattatccattcttgagttacaaaatacactttaaaaccttcccatcttaatattatatgtttttttagtcacagagtgaaaaggtgagattacattggcctacatccttgccctctggagatgccttttcttctgtggggacacatagatttgtccaaaaggtaagctaatgtcagagtttactaaaagtacaccttgtattgttcttcattgttggtggaaatatcttttatttgagacggagtctcactctgtcaccagagtggagtgcagtggcgcgatctcggctcactacagtctccacctcccgggttcaagagattctcgtgcctcagcctccctggtagctgggattacaggcatgtaccaccacacccagctaatttttgtatttttaatggagacagtttcaccatggccaggatggtcttgatctcctgaccttgtgatccacccacctcagcctcccagagtgctgggattacaggcgtgagccaccatgcccagccggaaatatcttgtagtatataagttttctccccttttcattaatttaagtaatgagactgtttttggttttatatattgtattccatatacatcctccaaaacagttagaaattttgttctgaaaataaagttctttcatttttatttaaggggaaagttgggggtgggcaaataaggagtggctagtccaaaatagttaaccagaagtatatccagttatactaaatctctctcttctttggggttaaatggtattactttgtattattggaagcactacattcttttttggaatgattttggaacataatacataataggtgcatgaagtcagcagttgctgctgtgcttgtttcatatagtgctttgttttctcttccctttatcttgtgtttggaagttggtactgaatgctctgttgtgcctttgttctgattacttggttttttctttgtctgtctctggtagccctatagtcgctcttcctccatgtcttccattgatctagtcagtgcctctgatgatgttcacagattcagctcccaggtactgtatgaatgtatagagtggacttgagtctttctgtgctatatttcagcctgctttcccagttcctagaaatcttttggttaggccactgattttagttttgaattttaaatagtaacattaagcattaaaaaggtcttccttgtctactaaatagttcctctgtcaggtttgcatgtgtcctttactattcacagcttggaattttgtcatataggaggtactccagaaagattttcaaactgaattgaaacaaatagaagatactgggttttgtatatcatgtaatatctgtttcttcagtcaggatttagcagttttgatggacgtggtctatatgatatgttatagcagaaaagcagattttaacagtctcacttttaagctaaagtatctccaaattatattcaacaaggaaatcactttttaataatatgtttcatttccattataatactaagctctattgagcagattgtgttttccttatgcaaattacctttggatattataaatgaatatttctgttcatatgctaaatctatggaaatttgttttaatttttagcattggtaagggtttaggaatttaagacaggaagctggatgcttgcggtctctaaagtctgtaccctcaaaataaaatcagattaccattggaagaagttttttttagtgtcagcgttagttctttttttaattttcttaatcttcacatctttgccattcaactttttatctttctggtgattgcattttattggactagattatattatgttaatcttatattaaagacctgagcactctggtcagaatgactcagtttaaaccctggttaggtgtatgatcccagtaagttttctaacttttttgtgcttcatttttatgatttagctagaacctgacacataataagtgctcaataaatgttaccttgtattgctattataacataatttctttgagctaataaaagttatctacatcattattttttcctctgtgagagtattgctataaaagtttttaaaagtcatagtttaaagagatttctattatttttatgtttataaataaagtttacattagtttttaacctgcaatagagaagaatattaagactttaatttttctgacttgtacagcgtttttctccttgaatactcttaagaaaaagatttagcaattctggatcagaaatcatccataaccaaatataccacagtatattttaccttttgcttgtccatttatgcatttttttttaattttacttatttattttcgagacagggtcttgctctgttgcccaggctggagtgcagtggcacgatctgggctcactgcaacctccatctcccaggttcaagcaattctcctgcctcagcctcccaagtagctgggattacaggcacgcaccactatgcccagctaatttttgtattcttagtaaagacgggttttcaccatgttggccaggctggtctagcactcctgacctcgtgatctgcccacctcggcctcccaaagtgctgggattacaggtgtgagccaccatgcccggccctgcgtatgtttttaaaaagagactcatattcataatgaatctgtgacaaaactacataatactgggagactttggtttattgtgctaagctccacattgcattaaaatcatatcacagactaatcaaaaatgcaggaatacataggctataaatgaaagaaaatataatgacagcaaagaaagaatgtaagccagtaataaagaatgcctaagaattaggggttcagaacccaaaccagggccctcactgtagtgctgtagaacagctgaattgcttttaagtccaggtaactatatcactgagaagcaggtgcctatatttttacaaaattttgctgacagcttacttcttcgtaatattaataaccttttgtaaaactcatgtatgtaacttgagagaaatcttgctggatttttttctctaatatatggtgctcatgattgatcagatcctgttttagcctttgattatgtactgttttatatgccagaagaggtaaaaatgaagaaaataacattaaggtcttcaagtatttgttgtccttgctaaagcattagttgtcattagcagacgtggactctagcaattcactgttgtaattaaattgtgtgccttatgttcagcagttcctttataatagatgactaattcccaattgataagattttttgtttcagaggatgttacactgccttatcagccattatcaaaggatctagcaagttgattctgtatagtcacacttgagaatatagcattggatgtagatctggagttaatattagttgagaaacattgtgttatctggaaaactcttccagttcaacacagtgtaaaattatagtagtgactatacagtagtgttacattttacagttctcacaccctatagagacttttgtattaagcaaaataagaggctcaaaggttattcattaacattagaaacacttatgttatattacattgcatcggtcttttctgttttttgttttttttttttttttgagacggagtttcgcttttgttgcccaggctggagtgcaatggtacgatcttggctcactgcaccctctgccccctggattcaagcgattctcttgcctcagccacctgagtagctgggattacaggcacctgccaccacacccagctaattttttttcatttttagtagagatggggtttcaccatgttggccaggctggtctcgaactcctgacctcaggtgatctgcccgcctcggcctcccaaagtgctgggattacaggcatgagccgccacacctggcctacatcgttcttaatacacaaatatacatcagttactccacagcgcttgatatgggaggtaaccaaattctttgttttataatatcttcataattaattaaaaaactaagtcgacatttttaatcacctttaataatttgccaaaatattatataagcataatataatcaattcttacttactccaacaaattttaaaagtccagatacagataccatatctagtttcttgatcatttatatcagctcccatacagaagccttctaaatctctggtaatttcactttgctgtttatataagtgttggctcatgactaccttgttcttcttgaaatgatgttttatagccttgaattggctgaaataatcaagtgtacaattgagagatgccctgaaaacagcttaaaataaaatatgtacatctactaggaaattagtaccaacacatgaatctgtctgatgggcagatattaggaatgaagtcactccagatctgagaaattaaagttgtaaaggactgcaagttctgtgtttttgttgttgttgttgttgttgttgttgtttgttttttcatttttgttttttgggtttttttgagacagagtctcattctgtcacccaggctgtagtgcagtggcacgatctcaactcactgcaacctccgtctcccaggttcaagcgattctcctgtctcagctgggattacaggcacacgctatcacacccagctaatttttgtatttttagtagagacagggtttcaccatgttagccaggctggtctcgaactcctgacctcaagtgatctgcccgtctcggcctcccaaagtgctgggattacaggcctgagacaccatgcccagcattttttttttttttttttttttttgtaaagagacaaggtttcacttgtccaggccaagtgcagtggcatgatcatagctctgtaacctgacctctgacctctgacttcctggacacaagtgatcctcctgtctctcagcctcccaagtagctgggactacaggcattccaccacacccaactaattgtttttattttttgtagagacagggccttgctatgttgcccaggctggcaagttcttgaaataatggctgtggccacaaactagaaaataattttcaggtgtacagagaatagaaagaatttagattcataaattgatcattttgttcacagttatttgcataacacagttcacatttaaaggtgtcaccttagaaatcaaaggggaagaacatcatcctctattgaaaaagaaagaaatcaaaggatgtacagtgaatttgcagcttaatctatggggagcatcattgcaaaaaatggttctgtgtgaggctctttcccaccctttgtccataggagcacattattgttgtagtaattatttcacccctctccctttttcagtgtacaagtgatacatgctaattttaacagaacttgaaagtagaataaaattaaaataatagtttactaatattccatttatcttctctcatatatatgagataaatattaaggtgtatgtacttatccatatgtgcctgattttttaaaatccttgtatatgcatctttgcacccttatctaattatttccttagaatatattcctagaagcataattgtgggaacaaaggccatgaacattttcaagtgtttattttattattttattttatttttattaattttgatacagggttttgctttgttccccagactggagtgcagtggtgagatcaccactcactgcaccttgacctcctggactcaagcgatccacctgcctcagtctcctcagtagcgggggctaaggactacaggcacatgccatcatgcccagctaatttttttatttgtagcagagacgaggtctcactgtgttgcccaggctgctattttatttattttttaagagatagggtctcattctgtcttccaggctagaatgcagtggcacaatcatagctcactgcaacctcaagcgatctttgcctcagcctgagtagctgggactacaggcatgggccaccactctcagctaatttttttttcaattttttattttttgtagatatgggggtctcactgtgttgcctaggctggtcttgaacccctagcctaaagtgatcttcccacctcagcctcccaaagtgctaggattacaggccacaggcctcagccaagttttaaaaatttttactgccaaactcttcattagaaaagttgaaccagcttacattcccaggccagttttctattgatatagtagcactgaatattataattcagttaacttttgtcaatacggtaggctaaaagtgctatgttcttagccatctctcttttgggttaacagtgcactattttgttattaataattattctatctaacaagccccctctatggttttgtggctttgtagtaagcatagttgtatttccttttttgaggtggagtcttgctatgttgcccaggctggagtgcagtggcgcgatctcggctcactgcaccctccgcctcccgggttcaagtgattctcctgcctcagactcctgagtatctgggactacaggcatgcaccaccacgcccagctaattttttatatttttagtagagaggggagttcaccgtgttagccgggatggtctctatctcttgacctcgtggtccgcgtgcctcagcctcccaaaatgctgtgattacaggcatgagccaccctgcctggccaacatttcttttacatgcataaaagagatctgagctgtttttgagcccttctagactttcttttttttttttttttttttttttttttttttttttttttttaagtagatgaggtcttgctatgttgccgagacttaacctcaaactcctaggcccaagcaatcctcccaagctgctgggactacaggcatgaaccaccatgcccaacttagacttttattgtactatcaaaaggcaattttcttttcaaatttctgggtaatagtgttagaaaaatcctacttggtaacatccagaaatggcatcatactgagtgattcaaatgtgagatggaagaaaaggttagaattggagtgaacgtcccctcttatctcaaatgtattttatctccattttgtttcatagtttattagtttgaagatgctttgaatgtcacctaatcattttcaactctaggtccagaaaaatcaagggcatgatttctgaaattacacttagcctaattaaaacttagaaacactgttcaccttcttcaatgtttttgactgagtctttttcatttataagtgacaggaggtgttactataacattatttcctagaatgtcaaattttgagcctaatagcatggtaaatttggctatatttgttgttttttgtttttgttttttttttaatgaaacttagtatttccttgtttcccacttcttttttttttttttttttttttttttttgagacggagtctctctctgtcatccaggctggagtgcaatggcgtgatcttggctcactgccacctccgcctcgcaggttcacgctattctcctttcacagcctcctgagtagctgggactacaggcacccaccaccacgcccggccaatttttttgtatttttagtagagacggggttttaccatgttaggcaggatggtctcgaactcctgaccttgtgatctgcccgcctcagcctcccaaagtgctgggattacaggcgtgagccaccgcacctggcctcccacttctttttaatatgtcgtgtcataactgaacagtaaagtgagcagattatcaggttaaatctgaagtgtcagtctggtcaccagtgcccaagttactgcccctatggtaatattggttactttgtattttcctacagcaaacataaaatttgttatagtgagatttttacctgtatacctctcttaactttaatgttattacctcaaggaagatattatcatgaatgaagattccatgatgaaagttttgcagagtttattgcagtaatttagtacttcattagaatctttagttttttaggagcacagtactgaatgtttgtttctttgttggaccttttgaaaaccggttttccattgatgcagtgtagctgttacaggaatatcatttttaaaacgtttttatacagcatggctgaaaattgaacctgggcctccctcgtggcctaccattgaaggaacagcattttttgcctatctagaaagacaatgttaaatgtgctatctatatattttttaacttgtgctacctactacgcgtttatatttgtggaatctgttttcttttggacaaaaccacaaatcaaaaacacctcatttcttaggcatttgaaatccctaattcagaataatctcccaaacagaaacacaactacctgcattctttttgacaaaagagctaagtagcattagaaaattattttaaacccaattctgttttttaacagaataaaattcttctgttcttcacattcttctttcataggtaacctattgaaagtagggtttatttgggggaagcatttctttctgtctcttatctcataataaatacaggtgtgcttaactactagtttcctacctcaaagatatactcaaatctaaagatgtttaagattttgggatctgaagagtaaacatttctcctaatcacaatgtgacagagacaaatgaatcaagccaatgctacttttatttatgcatactaactggaacttttctttttggaaatcagatacattttgtatgtattagtaatttggaatcctgcattggttatcctcgccctcccaaagcagattctgaaattataaaggtgcacaggttctccatgcaacaccaaaagttatattttccaaggctttgtaaaattgtagaatgtcctgttaaatttctgtcaaatcagtaactcacactgttttgagaattatgaataaaggaataaaatattgttagtgtttatttagtacaaaagtagattatagaatctcagcatttttgtcaaaaaatttctttttgatgattgacagatcaggagacacttaaggccatacctgctttcagtaatcaaaaatgcatttaagatccagaaacttgaggtagcagaacatcactatcacatataacatatcctttggtatagaaaattatattcccagagtgagtttcttttttaaaaccattaatgaggccaaggtgggaagatcacttgggaccaggagttcaagaccagcctgggccagatggcgagaccctgtctctacaaaaaattaactggatgtggtggtgcactcctgtagtcccacctactcagaggctgaggcaggaggatcccttgagcccaggaaattgtagtggcagtgagctatgatcatactactgtactgcagtctgggccacgaagtgagaccgtgtctcttaaaaaaaaaaaaatgttaggcatggtggcacaggcatatagttttagctacttaggaggctgaggcaggaggatcacttgagcccagaagttcaagattacagtgagttatgattgtgccgctgcactccaacctgggtgacaaaataaccctgtctctggcgggtaggggggaagttgattatttactttgaaatatgttcaaaactgattcctgttctatattcctaatgaacagaatagactttatataaaacaaatagttaaacttaaggataaaattttaatggaagtataatatatatatcttccagctcttctgtcttctaatgtatttattacagaaaatgaaattactttgtttccgcaatctttgtatcacttcagttctccaataaatctgagaattctggtagtgtgaaatattcagctttctttgcttatttacataaaatgtataaggacaatttgtgataattaagagttacatttaaatatcaggaaaaagttataaatttaaattaaaaaattttaaaaggaaattattagaaattttaaaagaatgaactaaaaggtgattatatgtaaatgcttgcatatatgaatattagcattgtccccaaaataatttagaacaaagaaattggaatcaaataaataaaggtttgattatttttaaattggcttatattccatgataaaagagaggtttatcagtggcataagaaaggtttttcaccttttttgtattgaaatctttgacatatacatatatatctttgctcatctttgtgtatctttgctcgtatgagagcaaagatataggcaaagatatgctctctctctctatgtctttgttcataccagaccttcctgatatctccacataatcttaaatataggaacattagactggatgatctctgtgccccctttatctctactcttccattattttatactttaacacatcatctctgttttatgatatagaatggaatatttcttttttcctgaaaatgcttattttggtcacttgatacacattaggccaatatgtgttacttgagtgacccatcttccttcttttcatttctgtctcctgtcattaacctggatatctggaatgtggactaaactcttcaaacactatgtaaaacctactaacctttgtgcatttggttgctcagctactaagagcaccatttctgaactgaagttaactgaagaccattctgttttagagattatgacataccttttggattctcatgcctttttcctcccttctcaaggttgaagagatggtgcagaaccacatgacttactcattacaggatgtaggcggagatgccaattggcagttggttgtagaagaaggagaaatgaaggtaattccccctgaaatgttatagattgccaaaggcgtctctgtttcagtcatattatcattactattgatatgaataaggatagcactttcaacttacctttaaaacaaattattacatgtgatcaaagcagtaccatatattgagcaataaaatgtctttttgcttttctggctttgcctttactaaaggtttttatgattataatataaatatatgattaaacctttctgttttgactaggccatgaagaaaataaaatttagagaattagatatgaccaggtcacaattagctgatggtcctgtatttggatatttccttttgttttgtttttttaacatactgaatgttgtgcctagatgacactttgtttctctccctttttggtctataccctccttcttttcccttctcttactgcacctttatttgatatttggacattggtcagttaatcttgtttacatccctaaacacaaggacagaaaataagagcagggactgagagatacagagatggattgaaaagcaaaagcaacattgaattttggattttctcattcctaaggaactatgctaaataaagatacaaagataataagacactctccaagctaaagctttagttaaggaaaaagaatattgacatttaaaagatactattggccaggcacagtggctatgcctgtaatcccagcacttttaggaggacatggcaggcggattacttgagctcaggagttcaagtcaaacctgggcaacacggtgaaaccccgtctctaccaaaaatacaaaaattagctgggtgcagtaccacacacttgtagtcccagctacccaggaggctgaggcaaaagattccttgagccagggaggtcaaggctgcaatgagccgcgtttgtgccactgcactctagcctgggtcacaaagtgagaccctgtgtgagatatatatatatatatatatatatatatatatatatatgcatgcatgctatacttggctccatctgataatgtactgagtgaagagtacagatgagtggtggagaaaatcagaaaagaaagatctctgtgatttgaaacaattagattgttttacaatgcagagaagcatttgaactacatctggaattaaaaagaaagttgtgacaagggtgaggtgagggcattttaggaaaaaaattataatgtgagcaaaaacttgaaagcaaactttttagtcaggatttttgtataatactatgttgaccagaattattctagcaaataaggatataatatttagatgctgggattcctctccctgaataaggacaaagtaagaaatgagataaaagaaggacagataaatgagatatccagaatgttagctataattctgataaggtgattgtagaaaatagtttgagatcagctgctacagggtcttgttactccagaattaagcatgttcctggcattgctggataatcacaaaccttcactacagaagcaggccaggatgtatgctcttcgcggaagaaagggttgagccagacctgccttatttcttcttctgtagtcatcgttcagtcaccgtagagtcacctccctctggggaggaggaagtgaagtactaaagagaagccaggagtgatggtctggatgacgtccctctacctggaatgaggaatagaaaataactactcctacagcccacagtgttagagagaaattgggcctagataatgggaagcataaagttactctctaaagagaacaatcgttgtctataacaattgtctacaacagtagactagccactgtatgaaaagtatctttttttttttttcttttttttgagacagagttttgctcttgtcacccaggctggagtgcaatggcatgatcttggcttatcgcagcctccgcctcctgggttcaagtgattctcctgcctcagcctcccaggtagctgggattacaggcacccgccactacgctgggttaatttttgtatttttagtagaaatggggtttcaccttgttggctaggctggtcttgaactcctgacctcaggtgatccgcccgcctcggcctcccaaagtgctgggataacaggtgtgagccactgcgcctggcctgaaaagtgtaattttaagaagatcaagctgatagggaagaaactggagaacaagcagactacttaaaagagtcaggcacaaagtgatgaaagcctacctagaacagtagaaaagtcaaactgttggatgtcttagcgaagacattttagacaaaaaataataatgtgagctagaggcctccctgctctgcacctttggcaccacatctaggaactgccagtgccatggtgtcaatagattcctgcctcacccctaatcatctcttctatgctttattaagaacagtttttgactggtggcagtggctcatacctgtaatcccagcactttgggaggccaaggcgggcagatcatctgaggtcagaagtttgagaccagcttggccaacatggtgaaaccctgtctctactaaaaataccaaaaattagctgggcgtagtggcaggcgcctgtaatcccagctactcaggaagccgagacaggagaatcgcttgaacctgggaggcggaggttgcagtgagccgagacggcgccattgcactccagcctgggcaacaatagcgaaactctgtctcaaaaaacaaaaaagaatagtaaagagcttactagctgtgtgaactgtaaagggaggaatcaaaagtctagagtttctagtttgggtagctgggaaaacggtggtcccaataatatgagtaataaataggtaggggaaggtagtctgttgagagatactctaagaaaatctatgtgaaatgcctaacagtgtccagccccataggtccttcataaattggcacttggttctcccccatgatgacatgtttcatttctcaagagtatttatcacataattatctaaagtagcaaactctataattttaaaataattaattttacttagcatttaaggtatgtaacctcagtatttaaagcaagatagatctgtatttacgtttttgccatcttagctttcagccattgatttaacaaataactgagtgcctattgtgtttcatatactattctagctgttggggatacagcattgaacaaagcagacttaatttagtatctttaaggagaatatattctagccaggtttatttggttttcttagccatgttaaacagtcttttgagaatggtaaataatgcctaattcaaattgatacatttatttttaaacaactcacaataagtcatttatcacatatgcatgtttttatctgaggtttaccttggatttataattttaagtacttttttgtctgttaatttgaaatttttaattttcttttagcagaatatgttctataaatagactttcataaaaatctaaagagcagctgtattaaaagcatgctttcctgcttttatgggcttgatttttaattttcaaacagttttggaattatgttctctttaggtatacagaagagaagtagaagaaaatgggattgttctggatcctttaaaagctacccatgcagttaaaggcgtcacaggacatgaagtctgcaattatttctggaatgttgacgttcgcaatgactgggaaagtaagctgtcattattaatatattttaatctattattttgaatttaatatcaaatccaacctagttttctgcatctcctacatagtttacaaagtcaacgtagaaagtatttggaaaatcatatagaggactagcaatacatttatgtagagcttttcagtgtatgaaatgcttcctagtatgtaatttgatccaataacctcagtaatcctacagtgataggtaggtattattgcttattttacatacaaataaagtaaaattcagataggcaaagtgacttgtcaaaggcaacaagagctatatggtggagaagccaagactgaaattgaagatttctgtttcatcatctactctttcctaaactgtttccgtggtaaatcctaggtgaatccttttgtgattactttagaattattttatttttttagacagagtttcgctcttgtcacacaggctggagtgcagtggtatgatctcagctcgctgcaacctttacctccccagttcaagtgattcttctgcctcagcctcccaagtaactgggattacaggcgcacaccatcacgcccagctaatttttgtatttttagtagagacggggttttgccgtgttggtcaggctggtctcgaactcctgacctcaggtgttccacctgccttggcctcccaaagtgctgggattacagatgtgagccactgcacccagcctagagttattcttagtgtgtattccccttagacacaaaatttcctaagtatagatacttctcaacatcatcagatgtttatcattggcagtttgacatctctttttcacagaaatagccacctaagattagatataacaatttatttaacatcaataaattggggaaaagggaagggttttagtgttagggaattatttgtgcctgagtgatgcagtggtgattagaattgctttcttgctgtggaagatagataattgggccaaagaaaatgaggcttcctggtgatcagacctcacatccctaatctgtaaccataatactaagtattagctaccttccatttggatgtaacctagatagggcaggatcctgttcaatttaccatactgtccattcgtacttgactttcaacataagtgaattgatcacattctaggaaaagataatatatctttttattattctcttcatttcagcaactatagaaaactttcatgtggtggaaacattagctgataatgcaatcatcatttatcaaacacacaaggtaaagatctcttcattcatcctaaaaggatttcaatgtagttcaaactcagacatatagattctctaaagtaaaattggggaggttattaaaagccacaaaaatccaaagactttattaaataatgattcatgaatgtcatgtatttaaaaggtatatcaacttgttcagaacagaaatatgtgcaggcaagaatctgagagatacaatctagaaatagagtgcttgataaagatcaacggttagttccctttgtgcactttttatttttaaagagacagggtcttgctgtatttcccaggctagtctcaaactcctgagctcaagtgatcctcctgcctcagcctctcaagtaattggaactactggtgtatgccacactcttagctttctttatacacagtttaagtctagaaaagagccttctgaaatactgaaatccatttaaatacctttctagtatctagtttctataagaggtaaatgatagttaccaaatatgaaagtgaattatagcttcctgtgacaacaacaataagggtaatggctagcatggtattagcctatgttaagactaatagatataaaagtaaatggattatctgaaagcaaagaaaaatcacagagcgtgacttgagaggttagtcatacaccagagcatacagaaacataatttaagttagctccctttcaccttatttcttctgctattcttgatatttaaaattatagaatcaatagttctcttgccttattctgctctttctcttctgaaaactgcccaataacataatgtgtatagcataataaaaggaattaaaattttggagagatccaccaaaaacagtattaaacattataaaagaaatgtaatgatttaataggtactttgtttttccaattcagtgagtgcttcatttttctttttaaatggtttttgagtgcagtatatgaaaacattataagtctgttatgtatttcttaaactcagtcttgtcatctgagacatcttatatctaataattaggagccatacttaattttacacggtagctgctcagaaatgcataacaattaagattctgtttcagcatacaaattttgaagtctaatttgaaatctaaaatttagtaaatgtcagaatattaattaatcaccctataatttggaatgaagataaatgaccaataatttagaaccaaaagaaccttattatctgaaaataatccatcatggaaaacaatctgctgaaggtattctgctagataaatagtagatggagggagggtcatataagttgtatcaggattgaaaaataaaactaaaaattattaaaataatcttatatgtaacaaaatttgttacagttataattatttgccaattcttggaataaacaaattgtcctggaatcattttttcaagaaaatcacattacattcgcagtgtatgtaactataccactcacactatatctgaaatttatcatcaccccaaacagaaactccgtactcattaagcaacaactccccattccctctcctcccattccataataatgttctgcttagactcaaagtctatagtgttatttacactacaatatttttccctttaaatttgacatcttttgcagtatggtcttaaaagagggctactggtctcttgatatttaagtcattctcattctttaaatttctatcttatcatcctgtggatttgtattcattaggtctaaatttgccaaatcttcatgtattacttactgtctccacacaatttacccaacactatatttatcaactacatgaaattttgtatctttaaaaaatgaatcatttcatcttgcaaatgatttgtattgtatgctatttattactctcagtaatcaggaatgacgctgcataacaaggactagtccagatacatatacgagataaccaaaataaaagtaacttaaataggataaaaggttttttttctcatttaaagtaggtagtcccatttattgaagacctaggctccatgtcattcccatagtatatgtttccccttgcataccttaatattgaaatatttaatctaagtgacttagaattctttctaatgtgatttgattcaaataagtcttttttcattaaatctttgaatctaagtagaacataatcatggagtatgaggagagaggaatggaaagttgttgcttactgggtacagagtttctgtttgggatgatgataaatttcagagatagcaatatggttacataacactgtgaatgtaattaatgtccctgaattgtaccctaaaagttagttaaaatgacaaattatacgtgtatatattttactgcaattaaaaaaatagaacattattccttttattatattgttctgcaaagctattaactctgttcataattaatcatttggtagatatcctcagatgctttccatttaaaatttgagagattttaccttcaattaagacatttattggcattacgtttctcttgttagttccatgttagatctgtttttcaaaagatttttacttctccacagagggtgtggcctgcttctcagcgagacgtattatatctttctgtcattcgaaagataccagccttgactgaaaatgaccctgaaacttggatagtttgtaatttttctgtggatcatgacagtgctcctgtaagtacatgtatataaatgtgtataattaaacaatataaagctaaatacacaatgcgggacaaaaatgataaacacagcccatacactatacttgatttgataatggttcttagattttatgttggattgactgctaggaacagtatagcccatgtgttgtctgagggcaacagtcatgcctatgaacattccaccagggccgtttacctttccttctaatgtttcgtgaaacagccaaaagggcagtacatacactgggcagtaggctacttcccacagttatctcttaagccgttatcaactgccagccaaacctctgtggtttaccacaatttagctccatttactacttaagaggaagggatcctgggcaacatggttagaccccatctctattaaaaaaaattttttttttttttttaattagccaggcctggtgatgtgcacctgtggtcccagctactctggaggttgaggcgggaggattgctttgagcccaggagtttgaagctgcagtgaactatgatggcaccactgcactccagagtgggcaacagagcaagaccttgtccccagaaaaagtgggtggggaggaatcctggtgtcatatcagcttggtgcttataagatttcactggagatacttttaagagttacgattttggttaacctaatataatattagaccagcagagtttacaaaatactgggtatctactgatgctttgttttttgttttggcagctaaacaaccgatgtgtccgtgccaaaataaatgttgctatgatttgtcaaaccttggtaagcccaccagagggaaaccaggaaattagcagggacaacattctatgcaagattacatatgtagctaatggtatgtattttattgtttttgctctttgataatgtggctgttcttgatcatgacctatatgacaacaatttggacaaatgcctttttagttcttatccattagattactaatttttaatttggagaaaggtatatcagaattactagagaatctttgaaagtacagatgtctgaatttcaccctggaactactactatatgagtatttctgaagctagagctggataggaaaattttaaaactttatccctaggtcactgtatatacccttcttttttttttttttttttttttgagatggagtctcgttctgttgcccaggctggagtgcagtggtgcagtctcagctcactgcagcctccgcctcctgggttcaagcgattctctgcctctgtagctgggattacaggtgcccacaaccacgcctggctagttttttgtatttttagtagagacggggtttcaccatcttggccaggctggtcttgaactcctgacctcgtgatccacccacctcggcctcccaaagtgctgggattacaggcgtgagccactgcgctcgacctagccttcatattaagcaccattttcttagatatttgcctcatagaacagatttattattaggaatataagcaacagtggggaaggaaattaagagttcttttactcattgtcagcctttttagctttctgaatcaatgttcccctagtccttattagttgctagttacatatttatttctctttgacattcattgtcaggctttttgttttctgagtcagcgtttccctagtccttattagttgctagttacatatatttgtttcactttggataggtcttttcattgcttgctttgggtccttacttcacctgctttgcacctggagtaatcattgcaacctctctcatcaaaagtcataccttctttatacagggccataactgctagtatgttcaaagaaacagttgtacctgagtaagttactatttcattatagtacagatttgtgaataatctgccctaaataaccttaagtggtgctatactaatttttgcaggtaatttcgggaactaagaacattgtagaaaggttatagatgctttcttatttgctgtctgattatgtctgatggatagtgttaaggaatgaagggttgggacttaaaagatcataattggtccagctgggtacagtgactcagcctgtaatcccagcaccttgggaggctgaggcgggcggatcatgaggtcaagagttcgagaccatcctagccaacatggtgaaaacccatctctactaaaaatacaaaattagctgggcatggtggcgtgcacctgtaatcccagctactccggaggctgaggcaggagaatcacttgaaccccggaggcggaagttgcagtgagccaagatcgcgccactgcactgcaccctggcaacagagcaagactccgtctcaaaaagaaaaaaaaaagatgctaattggtccaatgtgaggaatattttaaaaacaagggaacaaattaagtgcttcacatatgtttggagaattgtatcttaatacattttaattttcctttatcttgcagtgaaccctggaggatgggcaccagcctcagtgttaagggcagtggcaaagcgagagtatcctaaatttctaaaacgttttacttcttacgtccaagaaaaaactgcaggaaagcctattttgttctagtattaacaggtactagaagatatgttttatctttttttaactttatttgactaatatgactgtcaatactaaaatttagttgttgaaagtatttactatgttttttgatgttcccctatagagtattgtttcgttggtttttgttgttgtcgttgttgttgttttaaacagggtcttgctctgtttcctaagctgaagtgcaatgacaccatcacggctcactgcaacctcaacctctggcctcaaacaatcctctcatctcagccttcccagtagctgggagtccccacaggcatgtgccaccatgctcagctaattttttattttttgtagagataggggtcttgctatgttacccaagctggtcttgaactcctggcctcagacaatcctcctgcctcagcctcccaaagtgctgggattacagacatgagccaccgtgcctggccttgaaaattgtagtttatagcctttaaaacttaattcttttattgtttcctttttcttctaatgcttatgtaaagaaattttgatattatagaactgtagaattgtagaagtgcaaacttcctgtattctttcctttcccagaaactgttatttttgttgtatattcctccagatttttctgtgtatgtactgacatatttttgaatgttaaaatgtttatacttactattatacaaaattcttgttttataacctttttttcacttaacaatgtatcttgactatctttctttataagacatgagatgtgtaaaacatctcattcttttaacatctgttacatgcatgttgcagaatttattaactagtcccatgttaatgtctgagttggttccatatttttactgtcaaccagtacagcactgaacacctttatgcaaagaggtagaatctttaactttattttggtgttgttgagacaaagtttctctcttgctgcccaggctggagtgcagtggtgcaatcttggctcactgcaacctctgcctcccaggttcaagcgattctcctgcctcagcctcccgagtagctgggattacaggcgtccatcaccacgcccagcctatttttgtatttttagtagaggcagggtttcaccatgttggccaggctggtctcgaactccttacctcaggtgacctgctctcctgggcctcccaaaatgctgggtttacaggcgtgagccactgcactcagcccaaaatctttaactttttaaagtaagtgatacgttaacatgattaaaagccaaaagtggccaggtgcagtgggtcacacctgtaatcccaacactttttgggagactgaggtgggagaatggcttgaggccaggagttcaagtctagcctggataacatagcaagattccatcttgacaaaaaacaattaggcgtggtggtatacatgtatagtcctaggtacttgggaggctgaagcaggaagatcgctttgtctgggagtttgaggctgcagtgagctgtgattacacgactgcactccagcctggacaggtaatgtctgtcaaaaaataaataaataaagtcaaaagtatgaaaaagttatacagtaaaatttaccctgtcttgcattcaccatatagtattaacatatgctattactagtttcttctagaaagtttttaatgcttgaatgaacaaatacaagtgtattttctacacagatacactttttttgttgttaaagaagcagcagcatactataaacactgttcaacatcttatatttgcatttattttatcttgaaggtctcacatatttgtaaggagcttcctcattttgatggttatacagtatcccattgtatagatgtacataatttatttaatcagttctgcattggcgaatattacagtttccaatttctgccagagcagtgtcataattgtatccatatgtcattttgtacttgcaagtttatatgtgggaaaattaatagatgtggtactactggccctgctaggggtttgtgcataatttagatactacttttcatagaggttatagtaattgaccatctcaacagcaataatgaattggagtccctgtgtcccacagtttttcatacaacgtgtaaaacaaaactttataactttcccaactcattaggtgaaaaatactctctcagtgtagttttaattgtattcctcttcttatgactgagtttaagcctgctttagtccattgagaatcttttgtatagtactatttctataaattctattttgtaataacatttaaaatattagtagatattgccaattgtgatacacaaatggtaagcaataacatgaatattctctcattctcacctacactggatgttaaataattgactgagaaatgtatattcttgagtccttttctttagctaaaaataatagtcaattatataatgaaataattttaaacaagtctgatttctaatgatgtttatagtatgtctttcttttaaaaaatgcaaaagctaaatttattgtccgatactaactaatatcccatactaacataagggatattgcattgatgtctcagttgtttagctttatcccaggaaaaagggtatttgaaaatattaaataggttccagtcttagttacctgaatgattggtgttttggaatatagccttaccctttagggattctctcttcaagcacaagtgcactgcattcagtgtgctgacaatttttatatcttgtactttagaattgttatagctagatctggacacattacttcttatcgattctgagtctgtgccatatttatcaaataaaccagaaaactgatggcacgtgacagcaacaggcttatcaccctgcttcgctgtgtgtctctttgccatggcctctagggtttttaaagtggtgctgtttcactctatccaagaccagattttgtttcactctaactatatctgccttctctcttcttcactatgacctcactgaaacggcctccctcttgatgctttatgatgacttccttaccaaaggttctcagatattcaaccaagcaaggcagaaatacaactttgtattaaagcaagagaaatctgaatgcagttgtgtgtaaaacatgctctcaattatatttgagaagaataattttttaaacagttgaaagataaatggtaggatattagcagcatttgcttctagacttggatttagagcggtgtttcattgactctctgtgtgtgtgcatgtgtatgttcacagatttttcatttgtggacctgggagggaggagcttggaatctgaaaaaattcatctctggggaagagaggtctattgtttgtgggtacatgtatatgtgtgcaaagatacagctgaaaagattcattggcccaaactcagatttggctttttgagtccagattgagcttctttctaacaaagatccaaattcaaaccttaacatggtaaaatctttgttactgtaacgtaactttttttttttttttacaataattatggaagataaatgtatgaagtcgaacccagcattgaaaccctaggaaagcgaacattcttaattttggtgatggaaaaaaatagtaacattcaataatgtgtgtatcatctttagagaaagttctgtaaagagttaataagatccaaagttgtttaacagtaaaaactttatatatatattatatataatatatatttttatttattttatttatttatttatttatttatttatttatttatttatttatttattttgagacagcatctcactcctgtcgcccaggttggagtacactggagcgatctcagctcactgcagcctcaacttctcaagctcaggtgttcctcctacctccctgggtagctgggactataggcacacaccaccatgcccggctaattttttatacttttagtagagttggggtttcaccatgtttcccaagctggtctcaaactcctgagttcaagcaatccgcctgcctcaacctcccaaagtgctgggattacaggtgcgagccacctagccccgccagtaaaaacttttaaactcatttgacaaagaggtctgagcatgtttgttgattaaataaggcaggcctctctctcatagcttgaatacattttttaaattcttggtaagtagtattgtatgtcataatttttattgcaggctaagaggaaagaaatgccatgttgtggagtaaaaatccagagacctttcactgattacctctgctcacctatattgccctttttttttcaggtgcctgtgccccctttattttacacaactatgcaaattgtgaggccaaggatgtgactgcaaacaattaagatttgatttacatgaataagctttcttctccatgaaaatacactgtgtcacttcacacttggtctaacacacacacaaaattctcaccctaggtggcacagatacactcagcatgcaatattaagtacaatttccattttatttttctccagagaatagtccatcttcagtctttaaggactcagctccttacatgggctttggtgggggtcatggggcagcacccgcaggtctaaattggggtggaggtgttcgatccttctccttcatgagatcgattcctgactactttgttgtgagttgcacaactcacacagtaatatagcttcacataacagcttgggaagcacatagacatcaaagacactcgcttcggaaatgtccctgactgctgcgaccttcactgtgtttcaaatgacgaatttcttaatggccttgtccttgggcacgcatcaggcacggttcgtgcagcaaacaggctgcacgtggctgtggccctttttggcacaaccattgttccttcttttctttgtcatcttggaggcctggactgtagagaggactgttcccgtttttttttctaacttttgaaaaattccatatacctttgattccttgctgatggaataagttcaaatttgtaaggttaataattttgcattcataatgataaattttaatagagattccatgcattccatgaatatggagggtgggagaactctgttctggtagtcttgcagctgttcgtagcaaacatactgctgagttttttacttgtcttttttttttttttttttccttcagtgactgaagcaaggctgtgtgacattccatgttggagaaaaaaagaaaaaaaaaagctgaatgctctaagctggaacgtaggatctatagccttgtctgtggcccaagaccttggccttgtgtacaaaaatgacaaaatattgcaatagcaaagctgaacatctaacactagctatctcttgctagatctccttgctcagcatataactataaatacatgtaaaattacatgtatatggctatatttttatttgcttgctcctagaagagaaaaaaaaatcaactttgaatcacaactaggaattgatgctttaatttttggatactttttcagaatttttaatttactatggtccggcctaagatcctctgttgtatcaggttttgtgcacaaaagaaaagcacaaaagttgaatgcacatggggcatgtgctttctgtgcaccaaatatctggatgaggttcttttttcaggcctacagtcaaatctgtgtccagaattttttgacttttttgctttgtataatcatagaattcattgctgctgatttctataatgattcatgttgtcatgtgtctcttaataactgagggctgtcagtaacctgtgattttgccttttctatagtcttactcccatgaagaaccttggttctgatggagaaagtgaaaagctttatttcttcccctagatatctttatatttctattatattttttagttgtgtactgtgtactagagatttttttcagtttgttatgaacacaatttggtaagccctaaattggttctgcctgtctccaaacagaaacatctgtacaaatcttgttggtatagactactttctggaaaatggtcaagataagttcatgttttcttgaaatttctaagatagtatatggtatcacttgtttaaagcaaatcagactgagtttgacatttaattcaatatttctggtattcagtaacgggtatatatgtttgttcttccagtttgggtcagtttaaaagatatgttgcaaagtatacatagaaaatgtgagcaatgcctctctttgccttttgatcagaaacttcagcagagcggtaaggattccacatgatttaaactgaaatgcttttctttgttgctgtaagaacttaaaatgtaaaatacctttttcagtttaagtcctgtaaacaacattgaagcatggagatgaggcaaggaatagtactcactgaagttgaaatgactgcccacttcaaaatcttcattgtgtttacacaccagtgtatttatacaaatcagaggcattttgtagatgctttgctgacttgttcagctctgtaaaaacacagaaatcagacccattttgtaaagcggaaaatcatgttacatggaacatgtcctgtatatatcacatacatggtaatggagtcttaatgataagtgcaagataataatttaatgatgggattagtctgatcgcttaatatgcacaatcctggaagtgaattacttgcatcagatatagtgatatttattattctgtacagagagaaaaatacatataaaacatatgcttacattacatgcacgcggatttcatgctccataatcttttctattttttaatttacctttctgtaaatgatgtgcatggaatatgccttatagaaaaatgctgttcataatttgactacgtggaaaagtgcctatatggtggtaatgctagtaaggcaaataagacaaattatcatgttggtttactacatcaccagttaacattttatattgtgatgtttaaaaaagaaaaatttatacctcaaatgtgtattttattttacaatcagctgtggggtatggggttgggatgggagaatgggggggttggggagggcaggtttattcaccatagccgctgataagaatcttcaaaaaaattctatatgcgcactataaatgtttctctgtttgccatttctggtaactatcatgaacacagacagttaactctttcataactgaattggatagctttattttacagaagtatggcaagtttacaaagcaatatctaaatctaattatcattagttgcatttggactaaatgtgatgatatacttttgcaattgattctgtaaataaaaggattacactaaaatatttgtattaaaagaagaaaagataacattttacctttagataactgcacttgtacctcactagagttaatcccacccaatcagattgagaaataaattggggaatgtggaaagagtccaaaagaggtcagaatttggagaggtactggccttctggacaacatttagaccctctacaattattttcattaagctgattcctacatcctgaatattcatgttttctcatctacagatatttgtcttcccccaaactaaaagaaaaaaaactaccctttactctcttttctactcagttactcttttgtgctatgttagaaacttgaaatatattggtgatgtggggattttgtccctgactgcccactgtacaggacaagagagtacagtgtttcagttggaattcaggactcctggttttgaggtagaggatgatcactgcagtacttggtttggaattgccacaggggtagctaaaccaaaggagggttatatctgcaagggaggtgtaagaaggcaaaataaggaaaaggaggaatgggttttctatttgttcagtttcatcaactaatttatacacttaatacaacttcagtgtcaattgctattaagaaatttttagttgggctgagctggttctcttgtgaaattgtgctggttatctttaagcttatcagttatttgtccaattaaacacttttcaccagtatttagtccgagttgtacagacgatgtatttggattttgtcatggttcatctacagactcaaaacataatcattttaaagtaccttgggagtgtgtagagtaacttctataatagctttatgatcctgatgatgttttttaaacacaataaagttggatcttccatgttacaatcacagaattaaaaccagtatttaaagtggaaaagtattaaaatattatggacaaatatgctggcttgatttgttttccttaaccctgagatattgccctactctgaatagttaagagcttgaaattcagtgttcttcccgtaacccagttagggatcaagaaaactactgagttgcagcctaaatttttttttttttttttttttttggagacagagtcttgctttgtcacccaggctggagtgcagtggtgggatcttggctcactgcaacctccacttcccaggttcaagtgattcttgtgcctcagcctcctgagtggctgggattacaggcatgaggcactatgcccggctaatttttgtatttttagtagagacagggtttcgccatgttggccaggttggtctcaaactcctgacctcagatgatccacccacctgggcctcccaaagtgctgggattacaggcctcagccatcgcgcccagctcagttttttttttaacaaaatataacaggaggaatatatcaagtacatgacatgtaataaatattttgtgtatcttttgtcatatgtattacacatacgtgtgtaatgggttacagtttacaatgaatttcttactgtggatcacatccagaagttttaaaagattggtagagaagccatattcacttgggtgtttctaaaatggaagcacagtgctggtgaatgatacacacttattttgtaattgagctgtatgcatttaatcataaataaataatctcatttatttaaatctcgtttaatctcagctccacttgttgcactcaggtaatttatgccctagaacaaccatgaaatgggaagtgtggacttccatttcactcagtcagtggattcatattgaaaggcactgagcatatttctctcctagtgttcaaagatacatgccatccaaacaatgtgatctgtaaacaaaagccaactacttaatctggtgggatgctggagggaaaatctgacttgtgttgaatttgatgacagagaaatattatgtggtcctcattcctagagggattttctagggcacttttaactgtgcagtttttctttagacttgactttggcatataacctgcaaataaggtgtagttctaactagcagtttcaaatgaggttgcttttataggatcttccagattttcttgccattattcgaacttggttacaacagagttcatactatcatttatattgtctaccttttaagacacattttctgtgaacgttccacatctgtatactttgaatagccttgcacaaataccataagtgaagctactttatttggcctcttcattctctcttcctatagaattctgtgaggttagtactagaacaaatctttaagatctctgaagttattagaagatgccaaaccaggattttcctgtcacccaggctctgtggttgatgaggtggtgtgtgagggtatctccgccgtgtctgtaccggcactatgccttttctgactcctccccactcaacagtcctgtggaggtggtagcggtgattggtggtaccacccctgttttacagatgagggaacaggttggggttacaaacctactgattccctgactcttaagtttttttttttcccattagactctactttttaatgcctatgtgtaatatctagaatatagtgtttgatggactagaaagagctaacatgcttgaagactagcaattttggtgtatgggtcttagtcccacacttcaatattggcttcacaaaattccaaatacacatggttccttaacaatggttcgatttatgattgttcgactttatgcaaagcactacaaatacagtacactccaacttaccatggggctgcgttccgataaaccagtcatatatggaaaataccgtaagtcaaaagtacattttcagccgggggcagcggctcacacctgtaatcccagcactttggaagactgaggcgggtggattgcctgaggtcaggagttgaagaccagcctgtctaacatggtgaaaccccttgtctctactaaaaataaaaaagttagctgggtgtggtggcatgcacctgtaatccccagctactcaggaggctgagtcaggagaattgcttgatcccgggaggtggaagttgcagtgagctgagattacaccactgcactccagcctgggtgatacagcaagactctgtctccaaaaaaaaaaaagttttcaacttacgttattttcaacttgcagtgggcttatcagcacatagccacatcataaatggaggtgcttctgtcaaaagtacattattgttttattttcaacttacagtggggcttatcagtatgtagccccatcataagtcaaggggcttttataacgatgtgtcttacaaaatcccaccagatacagaaaggagggcagtaaagatgaaatttgatcacaattaggtgcttaaactttcttcctgtcctccagctcagaggatgaaacaggaaactgagtcataaaacactactacaaacaagcccaaggattttatcccagattttcaacccaaggatgagctgcaatataactatcactgttttgttggctgcctgccacagaatgaccactgaggaaataaagcgagctttggattcactgcagcttggtttactgtggttcttttctgtattaccgttgttaggattgggaggtttaagtggtaactgggtccagcagcagggaatctgcgtgcagcagctaaatcaaggtttagtcaatgtccaaaacactttagcaaattggatatcagtaattccccagcaccctaaaacagttcccagagcaagtatttattgagctcctactacatgccatgaaggattggagataaacgataaccagcatatagccttcattgttgtcataaccaggcttttaagaaatgtatccaaagttaaaggaaataggctggcccgggcgcggtggctcacacctgtaatcccagcactttggtaggccgaggcaggtggatcacgaggtcaggagttcgagaccagcctggccaacattgtgaaaccccgtctctactaaaaatacaaaaattagctgggtgtggtggcgggcacctgtaatcccagctactcgggaggctgaggcaggagaatcatttgaacccgggaggcagaggttacaatgagccaagattgcaccattgtactccagcctgggcgacagggcaagactccatcttaaaaaaaaaaaaaaaaaaaaaaaggatttgagatcagaagcatttgaataaggtacattgaacaatagatttagccacatttgagatgtacaaaagtgtttttaattcttggttctcagttctcaaaagatagataggaaataggttgttgctgtgttttaagtttaccaacctctgtacattgatagcaccacattaatggtattcattttaatttaaaactacaatttatagtctgtgactcacttttcattcccagcatccagtaggtttttgttgttgttatttctaagtaaatttccaagttcctggttaccatgtgttaaacatactgagaaagaatgagacttagaagtcagaagaccagaggttctcttgctctctcacttgaacagcttttatcttgggcaaatcattttaatgtgtctaagtctattttaatctataaaattatacaaagccacctactatggctacatcacagggtggtttggggaagagcaagataatgtattttagtgctttaaaaactttaaagtactatgcaaatactaaggaatactaaggcaactacaaatatgtgctaggtgctgggttttgaatggtagagataggaagatgagcaagagacaggaataatgacaagttgcaaacatttggaggctttgagcagaactgtaagttacttggcttgtctggggtttagtctacctccaggacataaccagtaagggagaagactagggggagaggcacaggcagttggtagaaaaccttgaagtgtgtaaagtttgatctttgttctgccagcaatgggagacaccgagggactttttggagcattattattgtacacgttttagaaatatctgtgggtcttgccacctggtttcgtttgaatagggaataagtcaaatggttttggttttgttttttgatacagagtctcgctgtgtcatccaggctggagtgcagtggtgcgatagctcactgcaacctccgcctcccgggttcaagtggttctcatgcctcagcctcccgagtagctgggattaaaggcatgcaccaccacgccagactaatttttatgtttttagtagagatgggggtttctccatgttgaccaggctggtcttgaactcctggcctcaagtgatctgcccacctcagcctcccaaaatcctgggattacgccataagcctgatggtggtggtggtggtgttttgttgggtttttttttgttttgagatggagttctgctcttgtccaggctggagtgcaatggcgcaatctcggctcactgcaacgtctgcctcctgggttcaagcgattctcctgccttagcctcccgagtagctgggattacaggcatgtgccaccgcgcctgtctaattttgtatttttagtagagatggggtttcaccatgttggtcaggctcatctcgaactcccaacctcagatgatctgcccacctcggccttccaaagtgctgggattacaggcgtgagccactgcaccccctcaactgttattcagttctataatatgtccttttcctttgtatttggattatataactactatgatattgcttgttgtattagtctagaagctctactaataagctaggctgtagcttatcagctcaactgaccagtagaacacaaggccccacctaaagtcagagagcagtttcaatggagtgtatgtttaaggtggcaaaaaagtgaaaaaaaaaatatggataggttgtgaatagcagtaaatgaacctggaggggcagaagagtttttaacttcaatgagaaggtgcaaggatgagatccaggaaaaggaacaccattatcttcttttcccctaggacttaagctttataaagagatgccagctctcccagccagagatagtggcagataagcaaggggtcaaaagaaatgcagggcagcccacagtaggtctgggctgcaaagggttatggctagttagctgcaactgctgaggagagacgatgaaaacaaagattgactgagtcacctctgctgacaatccctgtggtgctctgtggaaggtactaggctgttctctaaagtatcaatacacatgagattcatatcatccactacaaaaatatacatgtttccatctttggatgataaactgattctgtgtttatatgaggacacaataaatacagcatttcatagactacgtagagctagatacctccttagaagccagcgaatccaactgtcatttcacaaggaaactgaagacgagataggaagtgaatagcgtaaggtctcacagctagtcagtgccatagcaaggactggaatggaagtctctggatttccagctccctcaacactgccttcctctgttgtgactgttttctgtttggcataagtgtggagtatattaatttattgcctcggccattcaacaaacttagacctttaatgtaaggcacttgtttaaggtaacaagaaaagacatagtccctgccttccagagacctcagtctggaaaaaatgggggcaagatttatctctgcagtacagaataaaaaatctttggcttttatttttatatattttttatcatttaattttttgtttgataatgtatataattcaatataatttatcaagaaatattaacagcctggccaacatggtgagaccctgtctctactaaaaatataaaaattagccatgcacggtggtgcatgtctgtaatcccagctacttgggaggcttgaggtaggagaatcacttgaacctgggagacggaggttgcagtgagctaagattgcgtcactgcactccagcctgggcaacagagtgagactgtctcaaaaaacaaaattattggaggtgcgtgtccagaactttttctgatggggtgttcaaggtttgagttctactggcatagttaaatgctgtcctgagcaagttaaagatggcttttcccccaataactttccatttaaaattaccattctcttggctataccagcaagcttcagttatttaactgttgtacagttgaataaggtactggtccatgtcctgttaggaagcaggctgcacagcaggaggtgagcagcaggagagcgagcattaggctgagctctgcctcctgtcagatcagcagcagcattaaattctcataggagcaagaaccatattgtgaactgcgcatgtgagggatttagttgcactcatgagaatctaatgcctgacctgaggtggaactgtttcatcccaaaatcatcctcccaaccccaccccatctgtagaaaaattgtcttccatgaaaccgatcactagtgccaaaaaaaggtttgggaccactgggtaaaagcatccaggtgtgttgaaagaggattggcctgaggtaggcgagctctccatacagatctgagtaccttttgttattagaggatggagttttaagaacgagagctcacaggttatgtcttagatcagaaaggactgaggaagtgcaccaaagcttgatttcattgtaagagccctttgaggttatagcccaagtctagacagtgaaatgggcaggaaggtagaggctcctctgttaattccttcgtgagcttcagggctacaggagaacatcacacatcacgcagggctaatactctatttgctttattgtgtccaaggattctactgagtacaatcccagctgattttagagtggagacagaattgccccaactgcaacccccccacctccactccagcccacttcaaatttgcaagtgacatgaaagcaaaggacttccataatcaacacagggtagatgaccatagcccttctagtttggattacttcccgatgctttccttccaacacacacacacacagacacacacacacacacacacacacacaccccgtatgcttagttagctggcgcgcacacacatacacaccttgtatgcttagcagctggcacaaggccctcctacttttatgctccctgccaactggcttcagaattagccaactggaatgctgttgcctgggtctaatcctgctccagcactacaatcctgggacattaaagttcaaaggagtcaaacttcatagggcaggtggggtgaggatggggagtggacagtgatacatacccttaacaggagctcaatttttccccctatttggccctttgcagcagagtgcagggaacaaacaggagggtaaacggaataggtgatggcaaatgcctctctctggggcagtcactccacaggttgaagagatggagaagaccttcagtgttgttctgggacaggaggggggcgtgtgaggagcaccaaattcaaataacattttctagttagttattacatctctcgggttaattccaattaaatttttattagccaacactcggtctctccccaggtgtttcccaaccttgtgctactgaataaacagttttgtaaaaccattcattcaagccccaccaggcacctcatactgaaattccaacctattagtgcagcagcagcagcaactgttaactgccacgttccggccccaccccagaacaagagaatcagaaatcgctggggcagggcccagcagtctgtttaagcaggtcctctgggtaaatgcacactcatttgagagccgcagtattaaagccatcttttgcattcagcctcctaactccagctgttagtgtgaggctcttcttttggccttagggagcagctgttagaaaactcacatcctgatgcaagagtgcccatacctccctctgcagctctcaaacttgctcaggatggaaaacaagcggcagggataggggtaggagggctgtgttccaagcacaccaaaatgaaaaaagcaatccgttaagctttaaatatataattgtaaactaaatcatctgccatcttctctcggcttccagtgtagaggttacccattatttttgctaactggcaaagtaattaataaattcaagacttacctagcgtaggagcatacttcgagaaacactggtcatgaaaaaatctccacaatgaacataatgctcaggagattggtattgatgtgttttgctcttcagtgtgagatgtgccccttagatttaatcctgtatcgtctcctgaaatcaaacatcctgtcctgccacatgcatctcattgctcagcagatcacccaggcagagagcaggcttaaagatccttcactctcttctgtccagcctgttccaccctggagagggctgagcatacaggtgaccacaggtcatttcagagaaaaactcaaactgattctctagtatctgggccttggttctttcttagtgctcacacatacctttttacctctaattacagcaaaagtgtagtcaataattttctgtaaattactgactcacagtaatttctaaagaggccatcctcagctataccaagctgtacaaattcccctctccaattcagctcacacagcttaaatgcttgcaatggctgtttggttgtggctgcccctcttctccttaactagccctcccactctcactatccaaaagatgtctagttgagatgataaatctgaactaatcaaaccctctaagagagctcattttaatgtaatagaatactgctatcaatcaatgttgtagaatttgagaataaatggtcatgtgagtcctagcatgaattacaggttactactatgaccagactttacaagcttccagacctcagggctagggttaatccaaagaaaaaaggttactgcttacacttattggtattaacttccttttcattatttactgaaactagaaaaaagtattctataacaaaatgtatacaatttagtaattgtacaaaacattaatccagcaagatattaattacagtcactaaaatgaacactcaacatatttttcactgccacttccatgaaaagctcagaaaaagtcactggctaaaaagtcacaacaaaagcaatttaagctttacgtacaacagaaaaggtaaatcttccacaataacaatgcagacacaatcactaagaggctctccatgctgccatggtttcctggaatgtttttcagagtccatcttctacaagagacatcatcagctttccaagagcaacacttgaagcattagatgtaatacaaaataaggagttctttattatttatacaaaacttgtacattaaaaaaaattaagattcaataactctgctgaccccctgagaaagctaagagcgttcgtgggtccatcaaagagccctgtgtgaatgtttcagtcaccaacctcctggccacaggaactaggcacagttctagggccattcacgtggctccttcactggctctgaaagctgactttccctttcattaggctcggcaagcaagccagggtttcctggacaacattaaagaacattatcttctctggcccaggctagagtattttatcagtacacaagttgatttttatttcttgaacacttccaataaactagcataagttttattacaacatatacagatttgatacagtttacaaaaaaaactagatttttcaactaaataaaaatgtcttttaagcaattaaagttggcttagagacatggtatttttctttcaaaactgtgtttctacaatgatttctaaggtcccagtcttgcttgtacttgacagtcaccctcatctaagcaacattaagagctctgatatctttagtaaagaatacaaaaccctgtgtttcttaaaagcctaatgctgaaagacatgttatagccaatccagacaaacatttatatttaaacatttatatttaaacaaaaggcctctctgaacaaatagcctgcggagataaatacagtgatttgttttcctgatagaactatttagcatgtttaacacattattctgtagtttgggaataagagtgtttcttcccttgaagaaaacaggtccccttctgaagaataatgctgattaccccccaaaatcaaaatagaccagcaccaaatgaagtattaatttacaaacatgaacttagaacttagctcttacttcttgaagttctacatcccagacttaataaattaactacaaaatcaggagtttcatcagctacagtataatttaaaaatccattttcaactggcaggagtgagggagaaggtcaattgcactgatcaccatgaacttcaagaatttcatcaaaacttttttcccagcttatatttgccttcagaggtgagctgtagattaccatctctgatgctttaacatacaatattcttgttgaaatctcttcaaagagcacagcatgtaaagcactaaactgtgttcagatctgaggagtctgcatggaaagaacctgagacctctctgaaagagccaaaaaccaagtggctgtctcagtgatcacatctattcatcctccacaagacaatgcattgagcttttttaattcacagattttatgttagtcctttagaacccaatgcccatgttccagttcagaactgtcgggctattcaggctgtcttcttggtgcaagctccttggaggtcttgtaaattgatcttcgacctatggtagaaaatgacaaagtagcaatatataaatatcaggagtgtagaattttaacttggaactacagtagatgaatagtaagtttttacactgcatattttttgaagtatagggggaacatgttaaatatatctttgagtcttacctgttgtgaatcatgtgacttttgacaagatgtcctgctgccaatgctgccataagtgacaattccccagccattacggtcccacacacaattcgggcaagctgccgggcattttccccaggattatctttgcatgctccttgaacacctagcatctgtagccagggagagacacaacaagattcacccttaaaatcatgaccaatttcttactaaatcaactaaaaacagggcaactgtaatggcatcagaatagaactagactccactggaagcactaactttccaagacttgacagccacacctgacagtgcataataccatagctaacataatattcacagcctgactggcagtacccttaactcagtagatgaacattcatttgctctcttcatctactttcttatctaagcataagcttaaacatgcttatttggacacaatggattaggctgatatgacaaaagagtttggaaaagaccaattaaaatagaggtgagtgatacatagtctcagatagaaagagaaacccagagagtcagaactaggcttgtggactctatgcctgatacatcatacctgcaaacaggcttgctgaggtagtaggttggtcccaccacccaccgttcctatctctatagatggcatggtgcagctgatatataaatcttcatttgtgggaccacttgcttccattaaagtaatacagtttgaactaccaacattctgtgctgcatcctggaaacaagaaaagaaaaaatatacaatatacttctttcacttagaaagacgtaacacaagagaagtggaggctggagagctcacctgtccacaggcaatgtagatggcggtgacaatgtttgctgcatgggcgttgtagcctcctatgctcccagccatggcagagcccactaaattcttgttaatgttgacctcaatcatagcctctgtggtagtctttaatacctacaaaacagagctgtgtacatttagatgttcctccagaaggttcaggggaatgttacccaaatctatctttctgaacctccagaaaacaaagtttagatgtggccccatttaagccctgtcctccattaaaaaataaaaaaaattaaaaaaaatcagtaaagtttgttcctatggatgatacacacagacagatgggcaaggtacaacagtcatctttgatggaaaacactgtcccatatatttaactttatttaaaatgttaatactcctttcccccatttttaaatacaattaaagattacaaaataaaaaagataaattatccatccagtcactcacttctctgacaaccttggctggaatgacagcttcacaaacaacagattttcctcttccctctatccaatttatagcagcaggtttcttgtcagtacaatagttaccactaacggctagaatctgcatttcagggaaatactcgtgaagttttgaaagtgctttctctgtaccctgttaacaagaacccaaaacacacacatattaaactgcatgaaatattcatccttcatccttatgagaagaatttgtatctatgatatatttctaagtataataactatacttcaaagaaactgagcacaaaagtaacagctgttttgttaaccatcacaattactttcttggtcaggtataaattcctaatgtgtttctttctcggtatgaaaaccaagttctttgtagtcattgttgaaaaagatgtagataaaagatgataatgttaaaaatattcaataaaaatactcatatttatatgtcactggggaatgagtaataaattccatcttctagttattcagctgttacctaaaaccccaagtaatgaagtctgtaaagagaagtgggtcataagagttgatcttgtgattcgactcttatgtcgttgagctttatattacataaaatacaaataagcttcccaatgacttccaattaaatggcattaattcaattaacaactcatacctcaataatccaaaacatatttattggcaattaaaaacataattttattgtggtgaaacacataaaatttaccatcctacccatttttaggtgtacagtggtaagtatattcacactgccatgcaacaaatccccagaactcttttttaagttctgggatatatgtacagaacatgcaggtttgttacataggtatacatgtgccatggtggtctgctgcacctatcaacctgtcatctaggttttaagctccacatgcattaggtatttgccctaatgctcttccccttgcccccaaccccccgacatgcctcggtgtgtgttgttcccctccctgtgtccatgtgttctcattgttcaattcccacttacaagtgaaaaggtgtggtgtttggttttctgttcctgtgttagtttgctgagaatgatatttccaggctcatccatgtccctacaaaggacatgatctcattccttttttatggctgcacagtattgcatgctgtatatgtgccacattttctttatccggtctatcattgatgggcatttgggttggttccatgtctttgctcccagaactcttttcatctcacaaaacaaaaactctgtacttactaaataacaaccacccattttccccttccccaaacccatgataaccaccattctactttctgtctctatgaatttgactattctagacacctcattcaagtggaatgatacagtatttgtctttttgtgactggtttatttcatttagcataatgtcatcaatgtttatccatgctgtatcatgtgctataatttccttcctttttaatgctgaataatattccattttatatagacatatacatacacacacatacaaatacatctaatttgttgtccattcatccaacaacgaacactaaggttgattccaattcatggctattatgaaaaatgctgctacaaacatagctgtacaaatatctctctgagaactgctttcagttcttttgggtatatgcccggaagtgcaactgctggatcatatggtaatttcatgtttaagttgttgaactgccatactgtttattggcaattttaaagcttatacagatgctccttgacttttgataggtttattaggctgtaaaccccacataagcagaaaatatcctaaattgaaaacagacagacggacggacggacagacggatggatgaatggagtcagggtcttgctacattgccgaagctggcctcaagctcctaggctcaagctaacttcctgccccagcctaccgtgtagcgaggaccacaggtgtgtgccactatgcacaactatttttttttattgtttgtagagatagcatctcactgtgttgcccaggctggtcttaaactccagaccccaagcaatcttcttgccttggcctcccaaagtactgaaattatattggtgttcttaaagacaaatcttgaagaggtcagcttcaaaggtggtctcttgactggataaagttttgaaatgtcaatactaagattgttcccagtcctaagtaaactcaggatatgtgtaatgccaagtctaaattaaatctatcaaatgtaaggaataccaatcaacaaatgcctgatttgttttttataaaagtactttcattttaataaaagtactttcagatactctgcctacacttacctttgaaatcatgttcatccccatggcatcccctgacctggactggaaacggatataaaggttgcgtccagctatacttgtatgaagtttctgtagacgtgcaaatctataaataaaagatgcaaagactgtgttttattcttttattattattatttctttgttttttgtttttttttgagacggagtctcactctgtggcccaggctggagtgcagtggcttgatcttggctcactgcaacatccacctcccgggttcaagaaattctccagcctcagcctcccgagtagctgggattacaggcgcgggccaccatgcccagccaatttttgtattttgagtagagacagggtttcgccatgctggccaggctggtctcgaactcctggcctcaagtgatctgcccgcgttggcctccccaaagtgttgggattacaggcgtgagccactgcgcccagtcacaattatttcttaataaacttacacagttcacataaaaacaaatgtgttagcttgaactatactatggttatcatttgtgttgattatgctactttattaattttctttatttgaagtaagtcttattatactaatatttctctcctatttgaaaaatctttttttctaagacagttctctcctaggcaaagtaacatctaatcaaaattactagctcacacttttttttttttcttactaatttacctctgtggagctattcatttgaatcaacattctttttttccccccaaccaagcataaatattactcattttaaatgaatggctttaaagttgatattctgttatgtgctctttagcaggtaatatgttaacaattatgtttggtaatcacagaaaatgacactggttctaaaataaacaaatagatataactgtacatacaaatccactcacacacctgctagtgctgtcaaatgcctcctttatcactgcgaacccttcagatgtttcgagccaggctttcacttctgcagagtcacaagcacgtggaagacgcacaactgggccacgagtcatcccatctgcaaggactcggctgctggcacctccaccaagctacacagtatatgttagagaagcaagcacatgttacccaaaaatgctcatgcttgacccaaaaggtatcactaattgtccttaaaactcttctcattgccttacttatgatgtatttttaaactggcaaatatataaatgccaacttacacctattgctctgcagcctctattggtgctggccacaagacaaccttctgttgttgccattggaacctgaaattctttttcatctaagcaaaggggtcctgccactccaacagggatgggcatatatccaataacattctcacaacaagctcccatcacctaaaaggtaaagtcaggcaccaaatgaaaatctatatagtaaatgcacaaaattttatctcagcttgtcagtataactatcttcaaacttaatcctttagtatgtattctttttaaacaaaatgtttaattcacctttaaaaagtgtttaaaatactaaaatctttgagtaatgactataaaagcaggaaatatatttttaatttctatgacctacatcataagcagaataaaaaattaggataaaatgatttaaaaggaaaatgttttataaaactatgtacatatatgaaactaatcaagaaaaaagattaaaaacatacaaagcaaatctctcttaatcgagaaaataacataccaaggagtaattataatccctgtaaggtaggtactggagagaagaaggttctgaaagcttcttggaaagtaactgtcggcgaatagatacaccacgctcatgagtttccatcagagtttccaacttgtaggctgggatatgcttagcattgactaactggatgatctcagcatcactaaggaattttgcacctttctaaagaaatggagaaaaaaaatgaaattgtggtcagagagagagatgaaacagaagacttgaaggactgtatttcatgttataaaccatttaatacaaacaatgctaagctaaaataatgtaatttttaaattaaatcactgtagtttttaattaaaagatacctctgcaaaataattcatttaatgcaaaaaatgccaaacaaaaataatataaataccgtatcattagattttacaatacaaagacaggcttgcactaatacaccataaaaagaaaaataaatgtgaatttagcaaggtttcaagtgtgtgtcagatataacagctattgtttaaactctagtaaacttgctatttttgatatcctgaacaggcaatatattcacatggtttaaaaactaaatattaaaagagatataacaaaaagtcttcatcccatccctgtctaccatctgcccagttctttgctacctacacataaataggtaccactgtttcactgtgtatccatccagagatgtttttaggcatgattataaatatgcatatatatatatatacacgcacacatatgggtatatattcacacaagtgttgggccaaagggtatgaacatttacaatcttataaatttttataatttttacaaatttattaatttgaataaacacggtccaattgccttctcaccaccaatgtaagaaaagacctttccagcctgggggcagtggctcacgcctataatcccagcactttgggaggccaaggcgggcggatcacctgaggtccggagtttgagaccagcctgacaaacatggagaaaccccgtctctactaaaaatacaaaattagccaggaatggtggcgcatgcctgtaatcccagctacttgggaggctgaggcaggagaatcaattgaacccaggaggcagaggttgcggtgagccaagatcatgccattgcactccagcctgggcaacaatagcaaaactccttctcaaaaaaaaaaaaaccaaaccaaaaaaaaacccaaaaaaacaagaaaagacctttccctacaacctcaatagagtatgttattaaactttgggattattgccaatctgatgagtgaaaatatctcaagtacaattttaatttgcatttctcttaggatgaagttaatcaccttttcacatttttaagagccatatgtacttttttcctgacaatagactgattatctgctctttttaaaaattagataaaaatttagtctcatcaatttgtaggagctctttatatattagagattagccctttagccttaaatataaattgccaatattttctcttggtttattagctgtctcttgactctgcttgtggtggtgatatacatacatacacatacacacacacacactcacaatcaccaccctccacaaaactggtaccagtaattccattttgtgggtttattcaaggatcttctttgcaaacactaatattagcctaatttttcaaaagaatagtaagataaacattagctggtttatgtattatcaatgcaaattcattcattctcttagtaagtttactgagcacctatgaaatccaaggccctctcaagacatggacttagccatctaagagcccgatgtctaataatggagatattcatgtaaatgtgatataagcaacaaggtacgactgccattaaaaatgcacagtctctatataatggatgcttcagaaaagaaaggttacttctgtttggcggaattgaggtaggtttcatagagatgctagcatttgccctaaaggtgtgaacacctggagagggggagacatgtcagatgacaagaataggaacccagagttgggaactgtatttaaagaacaatgactaagtttagctaaaaagcatatgattgaagaatgcaggccgggcatgcagtggctcatacctgtaatcccagcactttgggaggccaaggcaggcagaccacttgaggccaggagtttgagaccagcctggccaacatagtgaaatcccatctctgctaaaaacacaaaaattagccagacatggtggcgcatgcctgtaatcccagctactcgggaggctgatacacaagaatcgcttgaacctgggaggtggaggttgctgtgagccaagatggtgccactgtactccagcctgggtgacagagtgacactctgtctccaaaacaataataataataataataataataataataaaataaaattttgtcaagtatacctcaataaagctggcaaaaaattgcattttaccaataaacgtattaacatatatttaaaagaaagaaccatattaagcagacatggatggaacatgattatttgcatgaaagcatgagtagattcatatggtcatgtaggcagaaggtcctgttcaaatgtcagaaagaaaagcaaacttcctcatgggtatcaagcttacaaaacaaaacaaaaacaaactttcttctatctttgaaacttgtctctgtgttaaactctttctaggcctcaacacacctatgagaatacagtagtcactcatctctatgataaacagtaataaactagaaagagttttgactctggagtcagaaaatcttggaccctgctatcagctttatcatttcctagaggtactactttgggaaattaaacatattggagcctcaatgttctcatctgaaaaatagataattgtacctacctctcaaggttgtgtgaaataaagaaagaagatagtatctgttagtcatgttacaccgtgcccagaacttagctgtagtgttcagcagatactagatttttcttccttgaaaaagctcctttgtaatgaaaaatgccacattggagtttatgttatcatcctcacctctgcattcccaagtatctgtagacattcttcattaggccgaggttccctgggaagttcaatttcaggttcctgtgtcaccagtactgatgaagtatcgagtaaggaggagttaccaaccacaaatgtagctctgtttggggtatctgtttcagccactaagggttttataacctcaactgttcaagaaatcaaaagaaatctcacaacacggcacataattttgaaaacagactactttttgacaaagcaatgaaggattgaaagcgaagagaataacaagttaccttttctttctcggtttatccctgtctcttcctctactgaatcacatttctggttatttctgaccagcataggttcacgtctacaacaattgtctgggactttcttttgtgtcactacaggagatgtgatagggttttttaatgagagtgtagattctgtctctgtttgttcaaagaagatgtacttgacagccagaaggagagctaaacttagggtaataacttgttcaatatccatgctgatcattctaaataaaagaaagcaaattaaaatcttattcagaaatgtaaaggacacaatctaaacttacattagcatagagtgttatgattaatatatcacaaagtagatttcaattaacttacttagagagataaaactgccagagggaaacacttggttcaattctcttggacacattttcatccagtcctaatgaaaccttagaagtatctgctgtactgttttgaggagaaggatcagctatccagcgactgtgagcatgaacaagaaccaagcctagagactgaaataaaatttttaaagtaatgtatcctctgcatatcaatagaacttaaatttcttatccctagcaactggacagccagacattatctctcatagcttccccttaccatgaaaaaaaaaaagccccaagcttgctatgcaactaactaaagtagtgaccccactgaactactgaaaacaccccaaagaacaggctttcaacgagagataaggtgggggaacttaaaaagtctgtttaggagagaggggctaataaagaccaggagcctcaaagaaatgaacacattaagaaaaaaaggaagaagggggtgcaatatcattgaatgggccaaaattgtagaaaaaaagaaatcttaaaaataatgagattggaactgaggatactaaaagaagaagaaaaccatgtcattaccataatcatcttgaccctctgagttacaggattcggcttattttcttcttcttctaaaactcgggcaaaatggctgagctgccaaattggacgaccctcgcggctttcccgagaaagctacaaattaagtcagtgtgacattagaaggtattgattctgtttaggtaaactgtgtaagcagaaatcttactcttctactagtgccatatgtaagaattggtcttacctctaataccaaggacacacaagctgggaagaaagtcatgaacacgaagtagttggcaagaactgacatgcagccaaagcagcacataatttcaagctgacgtacccctggttagagaaaaattaaagatacaactagtaaagtctacgttattttttatgctgcatatatcacaaggatatatttgtcttccctgcaggtggacaaaacatgaaaatattagtacattaagctccttgccacttactggaaatagaattagcaacttagaggtgatgccaagccttaggaaacagcaggaataacaacagaactctaagtccctcaagagcaaagctcttgccttctctcatgtccccatatcacaatgccaggcagaatggtagtgtttaatacacaattgataaaacatatgtgtttccaattcctttttgtcaagcagtagtgccttattattaaataaggagaggacaggctactctaacagagcaaaaccccagtgacactattgatctaatcccacttgttaggagaaaagcaatttgccaattaaccaaggattttttatataagtagaatatcctgccagttatgccagtcctgatataaggtcaaaataatattttttgtgtaccaacaaactctaatttcaatataacctctatgatgcctactgaagttcttataattttggttatttcattgatctgtttggaaaatgatataatacaaaatgccaacttaagactaaaaattaacaaacatattgtactacaactgtttaaggtatcatttggtgatctcaaatagaaaacagaattatagaggctagaagagaccttagatgaccaccaaatccttctccctcactttacaaataaacttgagtataatataaaacatatttctgatgtcgctcaaacataacaatgctttgaaacacaaatttgaattgtcctataaaaactgctcacaaaaactcaaagttttattttattacctacattttaagatataatttgactgactagaacaagcatatattgtatttttttaattcccaatgctttgaaacataaatttaaattgtcctataaaaactgctcacaaaaactcaaagttgtattttattacctaaattttaagatatcatttgactgactagaacaagcatatattgtatttttttaattccacgattaccctcaaatgtggaaattcaagagactacaaaatcacaataacaaaagcattataaatcaaactacattttaaatagtagctgaatataatcttttcaaacttgaggccattaaaaccatacttgaccaatgctttcatgacttgactatctactatttctctctgcacaatattcactcatgttgttgccatatgctctccaggcattcttccttactgtgtccccagataagtctctctacacacaaagaaacagcaccaatccacagacatccaagaagctaagactttcttctttttgtactggctttttcaaagggttacttccaagttaatatgtgttaaatctgtccttttttaccgtaacccaaatctctaattataccatttctgtatagctgtaaatgtctcactgtcttctccaaccacaaatctaatcacttcctttgtctacttctctgaccatatcatgacaaaactcatcgcccagctgctttccacatcattattatttcaatgaataatcccatggtttcatggcccaactattacttcctggcgaatccccttctcatatattcttttgcttgaataaaatcaaacaagtacattttcacctgatcaacattttttcttgagtgtagtggtggttacaagactatgtcattgtcaaaactcataaaattgtactcccaaaagtaaattttaaagtaagtaaatttttaaaattaaaaaatattttatttgctaaataaaatctttgttgaataaaataaataaataataatttgctctcagaaagttagaagcaatattacatttttaatatactatctactgaagaggcctaaactaatgacaataatttacccccttaaaagttagataatttacttctgaaagaatgaggcatctcattgagggctctaaggtaccaggaaatacacagtagttaaccaagtatggtctttataagaaagccataaaatataatcctaatgattaggagaccttcacacagcgtaatatattccttctggcaaatttccatgccagtctgtaatttttattctacataatgaagtcctatgtttgatattaatatctaattctctactatccaattaagaatgaagaaacatgtgttgaagctaatgctgggtacttgctgagatgtactgcttactatcggattaaatatttccaatcaccttattaggtgaatcttactcagatctgtccaattcctgactcttttctccctacatgataattaaaacacaaagaaccaagtcaccaattgagtctaagtaacagcaggggctggaaagtgttttccagaccaaccttggaatgcaatgttggttaaaaaaacaaacaaaagaaatcaaatgaataaaaatatcacaaagtggaacacaaagagaggatggcaggagtgaaaaataaatcagtaacctgctgctaagtttccaccaaagcaaacaggccagatatacccacacactaatataataaaaaattttaagagtaatttaaaagtcagaatttaacaataaataatacaaatccaagatgttctttttcctctttagcgacatacctattttaaaatatggcaaaaattgcttacaaacctgacatggtaccaactccaatcacaagacattcaacaagagcatcgagggtaaacgtaggacctaaaattgccattccacgagcaatattttcccttacttcatcctaaaacagatcaaacatatcaatgaaggcaagggacagaacaacttttttaaatgttagagcatcctatggcttatattaatatcaaattactattcaaagagtaaaatatacaatatgataaaactaacaggtattcaagatacaaagtatgattgtaatataaaggattttaaaaaatttttttttgagatgtagtctcactttgtttcccaggctggagtgcaatgtgcaatggtgtgatcttggttcactgcaacctctgcctcctgggttcaagcaattctcctgcctcagcctcccgagtagctgggattacaggcacccgccaccatgcccagctaatttttgtatttttagtagagactgggtttcaccaggttggccaggctggtctggagctcctgacctcaggtgatctgcccacctcggcctcccgaagtgctggaattacaggtgtgagccactgcgcccagccaaatttttaaaaaagaacatatagtgccctgattccctttccactgaataagatatttgttaggaatattcctttgaggtagtgcattaactctgtcatttaaatcacacataattaaatcctacaacattctatatttttacctaccatgacagaagcttagttgcaaattttatgagatcatattagtattaataaaaccaaacttatttccttgttaatatgttcaaatgatcacacactttcatcaacaaataatcagggcagaattgtgtgctattttatactcaagatactctgatataatattgttaaaatggttaggttcttcaaagtgactaatgaacattaagatgaaacttaaaataggaaataatgccagtgttaatttaaggggtttaaaaataaatctggccaggtgcagtggctcacacctataatcccaccactttgggaggctgaggcgggtggatcacttgaggtcagaaattaaagaccagtctggccaacatggcaaaactccgtctctactgaaaacacaaaaattagccggggatggtggtgcacatgtgtaatcccagctactcaggtggctgaggcagaagaatccctcgaaaccaggaggcgaaggttgtggtgagccaagatctcgccactgcactccagcctgggtgacagagtgagactacatctcaaatcaatcaatcaatcaatctaccctgggtttctcttccattagatcttgttctgctctctgatgtgtttcactaggaaaatactcttatttacccaaaaattattattaccataagttctgaaaactttcaaaaagaaaaatgggggcaattccaaattccagtagctacagaatcataattgagttgttagatacaggggactgttcctggggcacttatggagaccagtcttgggacttgagaattaaacttaaaactttgggcaattcttaaatcttgtgctatgaagaaacgctattaatccttcctattaatgtaaactgaaaaaaggaatactattcacattcctatcttataaataatacttacctgtgagttggaactgagggcaaactttgctaatgtgcttgctctggaaaggtcaatcaaaagtaggaaaaagggcaaagcttcactggaaaagaacaaaatgatcagataaatttaacgggaaaaagtatgattttaaaaaaattctttttagaacaaaacctttccccctccatactgtatgatcctgtagtatgtgtacctttctgcagacaaaaaagtataccctatatttctttggcatcctcaaagctaaacatagtagttgctcaaaatatttgttaaaaatatttttaatgttaaaatgtaagtatatttacatttaaacaccttttgataattttgtatcaaagtatcatccttagtaaaaaatatctccttggattaccattagggaaaaaaagtggaatatataaaaattttcattgatcactacctgtggaaggataaactaaacaaactttctgtaaactaaattggcaataatagcactaaaaagctcttaaaaaaaaaaaagcaaagctctaaaaaaagcaaaaccactgtctcacttctaggaatgtatcttaagaaaatgattacaaatatgaacaaaaatttcgttacaaagacattcatcacagtgttgttattaataaaaaaaattacataacctaacagtccaacattagatgattaataaactacaagacgtttagacagaagagaatacatatagccattacaaacaatttagtttaacattaaggacatggaggccgggcacagtggctcacgcctataatcccagcactttgggaggccaaggcaggcggatcacttgaggtcaggagtttgacaccagcctgaccaacatggcgaaacacagtctctaccaaaaatacacaaattaaatgggcatggtggcaggtgcctgtaatcccagctactcaggaggctgaggcaggagaactgcttgaacccgggaagtggaggttgcagtgagccaggatcgtgccattacactccagcctgggtgacaagagcgaaactccatctcaaaaaaaaaaaaaagggacatggaaagatgttgataaactattattaagcataaagaaattataaaacaatatatatgatatcagatattttctttaagtataaaaacagtagaaaaggatatatgccaaaatgttaatagttattaaaattagctaatagtaaaattatacaaaaaaatttccccttattttcttaacttttgaaaatgtacctttacagcatggggaagaaaagttttttaaaatgtattttgacagaaagtatatttaggttttaaatacttacttcaagcctgtcaattctttgtctaagaagtgaatgacaactgtactgaatacaaaacttgagaaaattgtgaaaaggccagcaatacctaaaatgacaaaagttcaatactaaaaaaactttatcctttactacacaaataataacagtgtcacacagcattctgagataatactagtttactccaaattattaaggtctcaaatttcagaatgtctaattgccaataataaggaaactattcaatgcatgcagcacactttcagcaatacacatatttccaaatacatgatttgaatgaacaggtttatttccacagcaaatcaaaaatctgatgacaccagaagttaaatatgtaaaactattacccaaaatatattttgatccaagttgacgtaaattctggaactggaagtaaatatacaggatggctatgcatcgtgttattgtcagaattataatgtcactgctcaaaacatcctaataggagagaaagaaaaggaaattccattagctttgacttttaaaataagtaatcaaaactaagaatttttattttgcatgtgtaattcatttatatagtcatgagaacataaatgtaagcacaatacaagtccaataaaaatatcaaacctacaaatcaaaaattaaatccaacttttaatcaaaccactgtggtaagccaatacatcaccacaatttttttttttttgagacagggtaacatgctgttacccaggctagagtacagtggtgcaatcacagttcactgcagcctcaacctccaggttcaagggatcctcctgccatggcctcccgagtagcaggactacaggtacatgctaccacacccagctaattttttaattttttttgagatggaatctcgctctgtcacacaggctggagtgcagtggcgcgatctcggctcgctgcaagctctgcctcctgggttcacgccattctcctgcctcagccttccgagtagctgggactacaggagcccgccaccatgcctggctaatttttttgtattttttagtagagacacgggtttcaccatgttagccaggatggtctcgatctcccgacctcgtgatccacccgccttggcctcccaaagtgctgggattacagacatgagccaccgtgcccggcctttaatttttttttaaagactgggtcttactatgttgtccaggttgcccaggctggtcttgaactcctaggctcaaacaattctcctgctttggcctcccaaagtgctgggattacaggcatgagtcactatacccggcccacaatcatttttgactattagtcacttataaaagatgtatttctcaaataaagtcaattacattcatttgtaaagacaaagcaaaataagagcatttccagtgcattccatgtaagcagaaatttgaggtaagttccaaaatactaaaataaatattttactctaacttttaaaaattatgtgctccctataggggcttaagggctcttcaaaaattgaaaatgtaatttactttagtcagtatcaaattaacttcactaacctcttcaaactttggacattcataattccaaccacagatcttattgttaccagtaaacatgttcatggacatcatgcagatggtcagtgtcactgtccccactatgacttcccagggatgggaggccacaaagaggccatgcattcgaaaaagtcttgacaacattgtagctacagaatccttggatcctggaaggaatatcaagggtgaacacttagtatacagctcattgtatttttaggaaaagattttaaggaaaagtgtgctataaaccctgctttgtatgcacagtgtcccatacatatgactatttgatactgttccttataattctggaaaataattataaaattaagagaactatgttatttcttcttcactcaaacaataaatcctttattacttactggcaaccaactttaaagcagccatttcttaaaaattatatgaattcaaacatttaagatcaaaccagataagtatctcgaccttattacctaagccttgcaagtagaagagcaatcaagcagaaaacacaagtgagaaacagctattcacattttctaattacctagatataaaatgcatgttaagtatcttcttcatcatctacattctgattacacaaaaggtaaacacccaagaatccacttattgagtgtcctgctataaatcatgttagttgataagatcctcaagggcagggacctcttgtactttttcattccatagaacatatggcataatgtcactagcaaaaggatgtttaataaaccttcctaacattgctgtcaacagaaaaaaagtcttttctgatagatgtttctacattaataaaacagggttaagaattttgctgtggtggctgcttttcttctagcagattcatcaacaatagtgctagaagaccaatggaaaagcattagatgtgaaaagctccaaactttcacaactaatcaaaagctggaacagtactagaagaggatgactggctgaagtatctgtatatagcattcaaaaaaattcccaaaagaacatatagaagattttgatttactgactaccatgactaaatttcctgtttgctaaataataattatgacattctgattttgaaaacaaatcttctattaccattggtctccacaaataaacctgcaagtcttacttctttcactaaaatcaatgcctgtgataaggcatattagtaacctgcaaaaatcaaccaaaaagatttaaaaagctcattaactgccactctagcaagaattcaaatgaatctcacatttagtaataaataaaagtgattcatctgttgaagacagactataaaaaggcaatcaagtaagtgaaagaaagcattaatctatttataaagggttaggggaaagaccaaaaaaaaaaaaaaagagcagctttaaggaaccaaagcaaataccaagtgtcatctctcactgcatcactccatgttctctacatttcagacataccacaccactagctaaacagttttcaaactgttgatccacaacaactgcatcaattacatcatgacatcaattttgtcgttaagaacaaacatttttaaataaaataaaatagaaaacaatattataaaaaatagctgttgggtaagccaggtagtatgggtaggtattatttcttaaaactatgtttcaagaaactatacctatataagtgtgtgtctggcttttaaattaacgtgtatttcctactgtgggtcacagttttaaaaagctggcagtacctaaaggaatataaatgtggcatgtacctgcctgtgtttactcatgctttttcaaccttccaccctgagtcttattcatcaatttaccctccagcaccttgcactcatatacagcattgctcaacaaatgctggcttaaattcttaagctatagtagcatgtattttatgacacatcttgaaacagacctaaagacgacttttttttaaggcacctagatatggatgtaacccatgccctctagtttaaggctaaatgcagagcattcagggaacttattaatggggtacgggaaggagaaacattttacatacaggctgagtatcctttatccaaaatgcttgggaccagaagcgtttcagattttggatgtttttgaattttgtaatatctgcattacatttattagcttagcatccctaatccaaaatccaaactccaaatgctgcaatgagcattttctttgagtgtcaggttggtgctcaagaaatttcagattttggagcatttcggatttcagatcttcagattagagacagtcaacttggaactatcctggaaaatgaacaacagcaacaaaatactttctattaaattagcaggtacttggacttttaagtattggaaatctttaatcaaatcttagatttgaactctacttaattataaacaaaagactcactcactaaaaggctagattttcatcatggtattctatcacataatttctttcctacatttaaaacacaactctaccaactgttctaaaggatcaattagcatcaaagttccagaaagtaaattaactacatgtttcaaaattaggtcaaaattatttctaaccctctttccctgaaaaaaaaactcttcagctcagattattcctcattatgtcaatcagattcattgttttaaaaagttaattcatttgagttaaaatcttagctgcaacccagaaggaacactaacttgtgaacaaattggtttaacatcataaacccataattatacattagacacattatgttttccctcaaaagattttatggtggcattgtaattctgggactttttttcctaggtgtaaagtcatctttgcaatattcaaggaaaaaaattacacatgattctgtcagccgcccctaaacacagagaactccacctatttggaaacaaactgagcaatcttatgagggtgtgtcaaaagtaaccataattataaacaatctcatttctcaggaacatcctccccgttgccctgtgattacgcaaagcatttacatgccatagaattcaatcgtccaccttcatcagcagttgcaaatgtcacaagcaggctacaggatagctcctgcaaattaagttgacagtatttatgcaatgctgcaataaaaattaatttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaaaaattaattttacttaaagaaacaaataggcaaggtatgccttacttattcagactaaaaagtatgctgcaaacttttacagattctttaaaagaatggataattcttaaatgtcaatccaatctgctacagaagccacctaccatggccaactgcagaaaaggatgttttggcatcttacttcctcctactcagcactccgcctgcattacacattccagtatttgattatatactatctcacagtgttctcaaattaataaatgtgtacattttgtctctttgaagccaagaactgcgtcttatatggcagtcattttcaatcccaacaagatctagcattctgctgctcaagctggtattccagaaagaaggaaaaaaaaaaaaaaaaaaacgaatcttgcactggcaatcaggaaatctggattctatacccaattagctcacattctattacatgttgttttttaagtcatatctattctcttcattcacttatgaagctagagctccaaagttctctgacaaagataagtgttaaatggaatcatatgaaactgctatttttgtaggttagttgaattttaaatactggcaatttcacatgggtcaacctaagtagaccatgtaattccataatgtggctatctatagtctagaaactagaccataaaggaatacaaagagtgtgtgcatgcacgcatactcacactcttatcttgaaatggttatcccacatacccgacaattttcatgttaatgctgtaacctatgtgcaattttgtttaaccttcatgttactaattcccatttgttttggccaccaagtttatcataagttctggaagaacactacaacaaagcaggcctgcaaaatccagcctatccccaaagtactgtccaggtctttgctagattatctctaaattgcaaaatgcctttcactgcatggagaggaaaataaattcataagtaaacaaaaagtacattctctaccttgtgggacgccgaaatcatgcacatttagtatagcccagaaacaaatgcttcctacgactctgcaggaccatgtctaagaaggaatatcctcaaatcctgaaatatttcaaacgactacttaagaatggagtacatcgacctcctcctactgcagaaattaactgttctatatttgtatctccaaggtacatttttcctaaaagaatatcagcaccaaggagactacaccccttaccaaaaaaaaaaaaaaaaaaagagggagaagaatcttttgagtcattgtgcgaatccccacgttgggctccgcatcctctcaagccgttctcctgtaaataaccagacacatctacaccaatccacggttctttcatggttctaagttagtcagcagtatttacagagatctttcccgtcacctaaaagaaaggtgctaacgaacagcagttcctgggcgtgaatgcccggatcccgggatgcaggcgcttctcccgtctgccctgcgagctgccggcccgacagccccatagacccctagcatttctcgaatccaggggcctccgaggtcaccctgcctgacaccctttccgccccgattttcgtgaccgtgcagccagcactgcctactctgactgaacagggacgatgaacgcagctacgccccgcgggtccaccgatgatgaccgcagtcacgaagaggccagaccgccgcccgcctctcaagcccaccccgggaccccgggttactccggcactgatgccggccgccgctcggcctgccgggcctcaaggacattccttgcagtccccgcgggtccgagctgccacaccgacaaagcgcaaccgcagccccctccaggtccgcaggagctgccggtagccacttcccagggccgagggaagctccagaattgccaccaacacagcccaaaccccgctcccacccatctccgccccgctccccgccgcccctgcccctcttctcggtcaccgcccgcctcacctccagatctcactagaggccaccgaaccccggcgccgacgctcagcctggctccagttaacgcagtcgcggagcggaaggagccctcaccttacgcacgctcggagctggacgagccttcgaccaataagagaggatcgttcgattgtctagccaatcgcctgggggctgctcggcctgacggcgctacgtcacgaacggtcgccttaacaaccgcccacagctctctgcagggccaagaacaggcaccgcaccatctctcaccacggctcggccaaccaatagccgttcgagtcccagcactagggcctgcctattggtcctagagctgtgggggcgcacgcatggcagctgcctaggcggaggcgataggggaccaggcgggtggagtgtcccacagcctcagtgcctgacccgtgctcgtcctggctgtgatagtacagtaggaggcagtgataggaagcagaatcggagcgtgagggaaaacgcagggtcaggtcgatgactgaaagctcagttactagcgcgggagagatggagggaagcggaggcggccatgagaaaaagaggaatataaaaaaagggaaggtggcggcgacgggcacctcaaacctgtaactggccggtagccgaaaccagcgctttcccgagatttacccattagtgtaaatggctccggtcacctgcgtctctctctcttgtgtgcgacatccattgcatactggattctctctgaaatgtgcctctcctgcgtcttctgtgcgttccttctgctctccgcctggtgcagggctttattatgtcttacttaaaacagtgcaatagcctctcctaactggtcttcccagtcttacacgcatgcacttcccaatctgtcctgcagaactcccacatgcagtatgtggcatactacttcctattatgccatagacccaaatcagcgtttctcattgtctactggattaaagaaagaacctgtcaccactaatatggccccaccacacatttctgacgtatctctactttcctgtgcgaaccttacagttcagccaggagtaactggcccttcttcagtcacactcagtacctttttacctccctgcttatgttctctttgtttaccttggatatgcctacccattttaactgctgagatcctaaatatcccttaaggactttttcatatgccacctcctttcctaattccctcaaacacatcatcactcccgaccttgaaaacccataaaatttccgtagtatttttttatttgtcttactatcgtatgtggaaatttattaaggacaggaattgtatttcactcaatttttaaagcccatattttgaaacacattacgaagaaaacactaaacactccttagttttaataaatgattatagattcttataatccttatataataggtattattcccattttacaaaaaagtaaaaattaaagtttgtcaagcaacttgctgtagatcacatagataatgagcaaaactggaatttgaacccagatctaatgcttaggctggttctactgttccccactgcttcagtgtaagaccttcattcatatctctttaccaaatgttgcctttgaaatgctcattatgtgaagtacacactgtggttggcatgggagatatagtgacaaacatgacagacatagtgcctgcctttatgaaccttgcacagtaaagaaaacgggtgaactacccaaagattgcagtgttctcttagcagccttgtcaaaaaaaaaaaaaaaaaagagagaaaagtgtgtaagtaccgagagcctagaacctgtcatatttttaatgccgctagaagtctcaaggaccaaatatctcagaagttacaggttgtacacatgcctactaatgtaattcaaataaggactaaagttgttaccaaaacaggctttagcccaagatttagaaattttcattcgcaaactgcctaattgggaactccaataggaatatgagttccaaagcaagcaataaagaaacaccagttgtctagttttatgctcttaaaataaattctatatccttcccaaaaggtatttcaaaagaatctttatagcacttaactaataatttgtacttagtgataaatcacaaaatttggtatggacacaaggtagaaagggagggtgggggaagcgccaaggaagtccatgtgccgcttcctcatatgcatttaacccttcaaggaaagagtttataaaagtataatttttttatttttagagacagagcccaggcgggcgtgcagtaatgggtccggaattggagggttcttggtctcactgacttcaagaatgaagccgtggactctcgcggtgagtgttaacagctcttaaggtggcgcgtctggagtctgtcccttgtgatgttcagatgtgttcggagtttctttcttctggtgggttcgtggtctcgctggctcaggagtgaagctgcagaccttcgcggtgagtgttatagctcttaaggcagcgcgtccggagtttttcgttcctcccagtgggctcttagtcttgctgggctcaggagtgaagctgcagaccttcgtggtgagtgttacagctcataaaagcagcgtggacccaaagagtgagcagtagcaagatttattgcaaagagcaaaaaaaccaagcttccacagtgtggaagggaacccgagctggttgccaatgctggctcaggcagcctgcttttattctcttatctggccccacccacatcctgctgattggtagagccgagtggcctgttttgtcagggcactgattggtgcgtttacaatccctgagctagatacaaaggttctccacgtccccatcagattagttagatacagtttccacacacaggttctccaaggccccaccagagcatctagatacagagtgtcgattggtgcactcacaaaccttgagctaaacacagggtgctgattggtgtgtttacaatccctgagctagacataaaggttctccaaggccccaccagagcagctagatacagagtgtcgattggtgcactcacaaaccttgagctaaacacagggtgctgaatggtgtatttacaatccctgagctagatataaagactctccacgtccccaccagactcaggagcccagatggcttcacccagtggatcctgcaccagggctgcaggtggagctgcctgccagtcccgcgccgtgcgctcacactcctcagcccttgggtggtcgatgggactgggcgccgtggagcagggggtggtgctcgtcggagaggctggggctgcacaggaacccacggagtgggtgggaggctcaggcatggcgggcggcaggtcccgaaccctgccctgcgggaaggcagctaaggctccgtgagaaatcgagcgcagcgccggtgggctggcactgctaggggacccagtacatcctccgcagccactggcctgggtgctaagtccctcattgcccggggccagcagggctggctggctgctccgagtgtggggcccgccaagcccacgcccacccggaactccagctggcccgcaagcgccgcacgcagccccggttcccgctcacgcctctccctccacacctccctgcaagctgagggagtgggctccagccttggccagcccagaaaagggctcccacagtgcagtggaggggggggctgaagggctcctcaaatgctgccaaagtgggagcccaggcagaggaggtgccaagagcaagcgagggctctgaggactgccagcacgctgtcacctctcagtaacacgatcttagctcactgaaacctctgccttctgggttcagcgattctcttgcctcagtctcctgggtagctgggattacaggggtgcaccaccatgcccggctaatttgtgtgtgtgtgtgtgtgtgtgtgtgtgtgtgtgtgtgtgtgtgtatatgtatacatacactttgtttttctttttgagacggagtctcgttcggtcgcccatactggagtgcagtggggcgatcttggctcactgcaagctccgcctcctgggttcacgccattctcctgactcagctagcttcccaagtagctgggactgcaggtgtcagccaccacgcccggctaatttttttgtatttttagtagagacggggtttcaccgtgttagccaggatggtctcaatctcctgacctcgtgatccgcccgcctcggccccccaaagtgctgggattacaggcgtgagccaccgcgcctggcccaatttttgtatttttaatagagacggggtttcgccatattggccaggctggtctcgagctcctgacctcaagcaacccgcccgcctcagcttcccaaagtgctgggattacaagcgtgaactaccgcacccgcctaaaagtataatgttaagaccccctttaaaagtaatgaatgacccacattgccatcttaatccatcctctttactatttacatatataaatgtgttaggcttccaaccttaacatttctggtttttgttgtcatgagtcatgcttaaagatggggaattataacaaaaacaataatactaaaatatttatattgctgcttctatatgtcagccacttgtctaagtgcttttgatatattaactccttttattaaaagtccactgaggagaacaatagtagaatctgcattttacaaaggatgaagctacagaaacagagatgttaggtaatttgcctaattccacatagcttggaagtagcagagccagaatataaactttgaaatgtggctcccaagcatatgccctaaaccactccactgtcttatcttttgtattagcataatgtgcactattttgtattagtacatatcgtatgattgtttaattttctgatgcttcattacaaaagacttttcataatatcagtgaagagttgtacttgtttccctttacagctcccagctgtgttcaaatttgtattttccagccttgggcagttttctttctctttgtcctgcacagtgtttttttgttttgttatgtaattttaaatttcaggataatttttttagactagcttattgcaaatgataattgaccacacatagctgttggcagatatgatgactgactatcactcctgccaaaggtcagtagatatccactgagggccttactctatgataggcaaagggttaggccctcaaggcagagagttaaataggaaaatatatacaaacaaacccttcctagataacatggtcagtgttctgagtgaggtatacacagggtccagtgagaaaagtttgggttgtgttttgaacaagaggagcaaatggtctgaagtctattctaggcacaaaggctagtattgtgagcatgagaatggaggtgatgcagatatagaagaaaatttaattggttagaaatcttaaagtactatagaatacaagacatttaaaaggtaggaagtcatgagcagcttggcagaagatctcaaagtccctagtggtgacattttacatgcacgaaagtctcagctgctgctcctcaataacaaaactaaagatactgcttctttgttcctaaaacttcccaaaaggaaatgaatagatgaagcctctcttgaccttaggaagaaacgtctctacaagactgagtacacacaaagatttctgctgttcactgagcctgctttcactgtttaactggtcttgtttgttttctccattcctctctttagaccttgccctagctttgtagaataagttgggtagtagtaacaaattgtattagaataatttttttttcttttaaaggaatttattttcttctgggaaacctgcataatgtagaaacagtataactatgatgatgcgtaagtgtccatgtctgagattcttagggatttggttcacacagaagtcaatgaaagatcaagaaagaatgaaacagacagggtgtggtggctcacgcctgtctgtaatcccaacactttggtaggccaaggtgggtggatcacctgaggccaggagttcaagaccagcctggccaacatagagaaaccccatgtctactaaaaatacaaacattagttgggtgtggtggtgcacacctgtagtcccagctactaggtaggctgaggcaggagaatccctggagcctgggaggcagaggttgtagtgagctgagatcgtgccactgtactctagcctgggccacagagcgagactctctcaaaaaaaaaaaaaaaaaaaaaaaaggagtggaacaaattagaactaattgtgacccaagtatgagcaccacttctccctcaagagcaaactctgggccaggcacagtggctcatgcctgtaatcccagcactatgggagtctgaggcaggaggattacaacctctgcctcccaggttcaagcaattctcctgcctcagcctcccgtgtagctgggattacaggagcccaccaccaagcccagctaatttttgtattttttttagtagagatggggtttcgccatgttggccaggctctcgaactcttgacctcaggtgatccacccgccttggcctcccaaagtgctgggattacagatgtgagccaccacgcccggctcattcctagctttatataagctcccagatagcaaaatcagttgacagagaccagaaggaaatgaaaatggagggaggagataaggaagagctcggaaaagagctggataagatcctaccaggcaagtgtgaaaaaaagacggaaggataatggtctaaggggacctgcctcagcttttctgagcaaccccattgaaagagaagcctaacagcaattgctcaaggcaatacctagctaggcaatcttttaatgcaaagttactgtcacttataagtaaaaatggcccaaataagctacagaactctaactatatctgctgcaaattgcaacaaatttggctacaagtaacagataactcaaaagaagcttaaaaagataagcatttatttatttcttgggtaaaggaaactggaaatagataatccaggactagcatggcagcccatgatgctttccgggaccctcctgtctccctgctccaccatgctcagcatgcagcttccatccccagtgtcacttgtggtccaagatggcaactggagtgccaaccttcatatctgcatttcggtccctctggaaggaacaggttcaagacaaaagggcaaaaacaaacaaacaaactaacaaacaaacaaaaaaacccagcccttgttagctgtttttttatatctcacattttatatctcagtggccagaactacaaggtcatacctaagtacaaggaagctggaaatgtaatctttatttttcacaacaatatgcccagctcaaaactgaaaaaagcatcttccatgctatccacatactgggtgagcacataataagtacacgatacatttgttgatcacctaactcaaaaacaggaaacaattttactatcaagattttgggggaataggaaaggacataagtctaatatcaaagatgtattattttataaacattagcttgaaatgtcaatggaattcttaataacacctagacttgacttttagctaagtgtttcaaggtataatgttacaaatggtccaccattaagaaataatctagggaactaacaaagtattctgtatcttaaaatagaaaaaaaaaaaggcatcactggtcttattcgttgctatacctccagtacctattaacagtcaatgaatgaatgaattacagcaactttccaagcaatttgtgatcttgatttccctctgatccagattccttgctttttcttttgcatgtttttaatacccagcaagttctcagtgctgctttgaccctgtaccacaggctgcctcccactctgaaatttcttaggcctgtgagacctgcctcccagagaaggcttccagttctttccatatttgtcccagctgcactgaaccgaagctgcagttatttgtgcttccaaagcccatggatttgggggcacaatgagcc

SEQ ID NO: 12525 - DNA, 7141 bp, Human
  misc_feature (1)...(7141): n = A,T,C or G
ggaggaggggaggtgcagggaagaggggccggcctcagctgtcaccagcacttttgaccaagtcctgctactgcggcccctgccctagggcttagagcatggacctcctgccctgggggtcatctggggccagggctctctggatgccttcctgctgccccagccagggttggagtcttagcctcgggatccagtgaagccagaagccaaataaactcaaaagctgtctccccacatgtagcctgtcacctttcttggaggtaaccaggtgacccaacctatcatacaaccctggtgtcctgatgccccaacaataggcagttggatgccttgtactgcatgcctctcctgggaccaaatccaccagccttggtcagtcattcaaggctcttctcggccaggtgcagtggctcactcctgtcatcacagcagtttgggaggccgaggccggcggatcacatgaggtcaggagttcaagaccaacctggccacatggtgaaaccccatctctactaaaaatacaaaaattagccaggtgtggtggtgcatgcctgtagtcccagctactctggaggctgaggcaggagaattgcttgaacctggaaggtggaggttgcagtgagccaaaatcacgccactgcactccagcctgggcaacagagcaagactccgtctcaaaaaaaaaaaaaacaaaaaaccataggccgggcatggtggctcacgcctgtaatcccagcactttgggaggccgagacggacagatcacaaggtcaggattttgagaccagcctggccaatatggtgaaaccccgtctctactgaaaaaaatatatatatatacaaaaattaaccaggcgtggtggcaggtgcctgtagccccagctacttgggaggctgaggcaggagaatagcttgaacccgggcggcgaaggttgagtgagccgagattgcaccactgcactccagcctgggcgacagagcgagactccatctcaaaaaaaagagtagtaagttccacccacctcccagtatggtgacttgccatggcatctggcacccctgacagttctcttcacactgccatgggggctctggcactcccacaccataccctagggcagggtccctccctcggcctctgtccattctcttcacactgccatgggggctctggcactcccacaccataccctagggctgggtcccttccttggcctctgtcctcagcccctctgacgttagaggagttggaacccaggctcccccttcccctctcccaggtgccccatggcagcccagactctgtgtctgcagttcaggggcagggagtcaggagggcaggcacaaagcgttctcaggaagaactggcaatcgggcgcaagggtatcatctgcccgggtgctctgggcaccctggagtcctctccccacctcccacccccacctgatccttcccagctgccaccattcctctcccaccacaccacccaggccaaaatcactccatccatgacgcctacagtagcccagcgtaggtctccctggaccacatttatcctcaagggcctgtgtccttatccccccttcacccccaactctcccctgccacagccagccctctgttcctctcacaccccaagctcattcctaccttcactggcctcttactccccagctgaaatatcacctccttagcagagctttcccagtgagataacccccccgctccccgcagagctctcccatcacccagggtgtttccttcatggaactcatgacaatgtgaggttgccatgtttctttgctaagaggtttcttgtgtaaacaccaggaaggaaaggacctgtgcctgtcctcttccctaagcacttgaatgaatgaatgaatgaatgaatgtggtatgggtgcctgagtgagcaggaccttgaataagtgtgaggtcctctctaggcttcagcttcctccgcctcctcccctcaccgcagccgccttcctccacccatccccaccatcccagctgctgtgaaatgggcaaatgtcttgcctccaggacctgggaagggtgatgcagctcacctccctcctgttcacaccccagccaccccagccatcccagccgggtcccagccacccacacagcacctcctcctggccccgccctgcccagcccctcccaggtgcctgaggtggagccgccagttcccacagcaccccagcggcctgccatggggggtctaaggccctggtcccgatacgggctcctggttgtggcccacttgctggccctggggcttggggctgtggtgttccaggccctggaggggcctcctgcatgcaggcttcaggctgagctcagggcagagctggcagccttccaggcagagcatagggcctgcctgccacccggagctctggaagagctgctgggcactgccctggccacccaggcccatggggtctccaccctgggcaacagctcagagggcaggacctgggaccttccctcagccctgctcttcgctgccagcatcctcaccaccacaggtaagagagccaggcagccaagtcggggggtgcggctccaagaggccatggctccctgggggctttggggttcatgcagcccttccttcagccccaaagagccagatggagcccaggccctgtgaggcctgacatcacagctggggctccccaccaacacaccccaactggtgcctccacttcaactgccaggaagggtgtggcctccccagtcccaccccaggcaccctttgagacccaggagagctgcccagatgccacagcctgtggccagataggggatacaatacagtgggatggattcttggatggaagcaaatagaatgaacctgggaaggacagatcaggaccatggcctcgggtgggggagtgagggaagataggggaggaagtcggcatgagatgcttgtggatcaggagggcacagacagggatgagggagtcctgcagagaaatcgcgtgggcacaggcccagggaaaagcagcaatgagacccacagccctgggttttcgtattttttgccccacaaagtgtctcagtattttttgaattggaatttgtatttccaactttttttttttttgaaacggtgtctgaccctgtcacccaggctggggtgcggtggtgcgatcttggctcactgcaacctccacctcccgggttctagcaattctcctgcctcagcctcctgagtagctgggactacaggcatgcaccaccatgcccggctaatttttgtgtttttagtagagacggggttttgccatgttggccaggctgttctcaaactcctgacctcaagtgatccacctgcctcagcctcccaaagtgttgggattacaggtgtgagccactgtgcccagctcatatttccaacttcttttggaaaatcaggaaacccactcacactgagccagaatccctgcaaggcaacatcctgactggagcagaatggggcctgccctttggatacagctcacactttccagtgtacccctgtccccaccactcctgtttgtctcccatctggctccggtaggcatgtgcgtttgcagctctgtattagctgatcctgttctcccagcacaccccgcactcccacccctccccgcctggcacatgccctctctcgcccatgctgcctctttgcagcccttcgtgatttgcctgcccgactcccccaccagaaggggcagggcctgggctgattcagatcccagtacaaagcctggcacacaggacatgacacacatttggggaaagagtggatgatattccaccagctgtggaatcgggagtatctgttaagggcagcgcagttctcagaattgtcccagctacaaaaggcctgaggaactgtcttctttcatcctttcattttccaaaaaagaaaagaatggcctagagagggtaagggatcccctgacgaagaggagcagagccagctagaacctgggcctggccagttcaaggccaccagagggcagccttctgcggaaggcagtattggggtaggcagggaccccagcagacatggcactcagagctctcactgtccactgactctctcttctccaggttatggccacatggccccactatcgccaggcggaaaggccttctgcatggtctatgcagccctggggctgccagcctccttagctctcgtggccaccctgcgccattgcctgctgcctgtgctcagccgcccacgtgcctgggtagcggtccactggcagctgtcaccggccagggctgcgctgctgcaggcagttgcactgggactgctggtggccagcagctttgtgctgctgccagcgctggtgctgtggggccttcagggcgactgcagcctgctgggggccgtctacttctgcttcagctcgctcagcaccattggcctggaggacttgctgcccggccgcggccgcagcctgcaccccgtgatttaccacctgggccagctcgcacttcttggtaagtccagccacctaacagcgtgtgggggaagggggaagaggagcctggactaggactcccataaatcactggggggctgggccttgcaggtggagggacctcactccagggcacggcgtgggaggggtagtcgaagagctctggtggcagcgttgagaagggggtgagtggtgccagttgccagggcaagtcactgcgctgggaggtgggcggggagcatcaccagaacccaggcgctgccccagcaccttctcctccccaggttacttgcttctaggactcttggccatgctgctggcagtggagaccttctctgagctgccgcaggtccgtgccatggggaagttcttcagacccagtggtcctgtgactgctgaggaccaaggtggcatcctagggcaggatgaactggctctgagcaccctgccgcccgcggccccagcttcaggacaagcccctgcttgctgaagcgtcaggtgaccgagttcagctccgtaaggtggcggcacctgaggaggaagcagccaggagtggctggggaagaatctggagatggagccgcggtgagggtgggcgggaggcctcaggggatactgttaatcataaaatgagcaacgacttcggctatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcaggaggcgcgggcccagggactgtgccgcctccaccctggctctgtcttgcctcccggcccctgagcccatgtcccaccttcgatggccagcatggcccgcagctcgcggctcagcagctcgaaccttcgctccaagtcctgctcctccatgctggaaggtggcggggggtgggtggcgggggggtggcagttcaggaaaaggggcgtagggagagagtgcccagggctctggccactccctgaccccatcccacctccccagcagttcccgagggcagggctgaccgcagagctatcctctagtctccagaccacattatcgcttttcttctgttttctccaattgctgggtgtttgtgttgctcctcccacacaccccccagaaggacccccgaaggattatttggatgaacagtactcataaacaggaagcactggctacagttattctgaaaaatcccaaacgcaaaagggaggcaaagctgtctccaccctgcaggatgacaaaggcaatggccgcagagtggcttcggaccccacatgggaaccagatcagatctctctgggcttctgttttccttactgtaaaggctggagtgcagtggcacgatctcggctcactgcaatctctcaaccccaggagggttcaagcgattctcctgcctcagccttcccagaagctggaactacaggcgcccgccaccaggcctggctaatgttttgtatttttagtagagacggggtttcactgtgttagccagatggtctcaatctcctgaccttgtgatctgcccgcctcggcctcccaaagtgctgggattacaggcgtgagccaccgcgcccggccggttttcttattagtaaaaatagttctaatttaagagttttacccttaatttttgt

SEQ ID NO: 12526 - DNA, 46319 bp, Human
ccaaacttgccaattttttttttttttttttgagacagagtcttgctctcaccaggctggagtgcagtggcacgatctctgtcactgcaacctctgcttcccgggttcaagcgattctcctgcctcagcttcctgagtggctgggattacaggcgcgtgccaacacgcccagctaatttttgtatttttagtagagacggggttttgccatgttggtcagccttgtcttgaactcctgatctcaggtgatttgccctccttggcctccccaagtgctgggattacaggcgtgagccaccgcgcccggaataatgttctttctttaaaaatacaaattagcaatccccttaattccacaaagaggaaaagtaaaagaacacagaaatgcttgagttcaatttgctgagaccaataaaatgcactttcaagaaaactgcacagcactagcattggaggccacaaaaataagatacggactctatactcaaggaatttatgaacaaataaatttttctgctggctgaggtacttctctgactgttaaagcaggtaaaacgaagaaatgttcctccgagacttcctacctattctaacctctcaaacttctaattgcaacaatggcagctttatttttatcttaatatttatgtgttgagggttccatataagattagatttgaataaagcactgtatgcctttaaaaaggtttgaaaatcactggtctaataaaagaacagtgaaaactgacaggcagctatattataaaaagaatactggattgagggttcatgatgactgttttattctagttgttgaacatgtacagccatgtcgaaggaaaagttctatttctcacctctcataaaggatggcattttaaaggtgaattttaatgtcattcatctaataaatatttgttgcatgcaataagcacaatgttattcatatattcatagtaaagtaatagggagaaaggaagtacggaatatcctgaggatatcagctgtcatcagagatgtaacaagctgggtctcagagcacaagtttgccaattgattaaaaaggaaaaaaaatgaggcatcgtagatagaatcataggtccagaagaacagaattagaaatagctaccactgaatgaacatttcctccatgcatagacttttatcctcaccacacctatggagatagaagttattatccccatgcagacaggggtatgccaaaatcacaaaactcgtgagtggcagcgccacgtttgaaactggggttgtctgatttcaaagccaaggctctgggttcacagaagtacatgtacttaagaggtgtgaagcaacatgggactactggaaggaggcggtgagccacgaggctggaaatgcaggcacctgctctcgctcacttgaccatagagcaacttgggcaaagaaggggtgggctgacattggagtatggaacaaacgcatgatttcaaataagcatgtgtgtatccatcccagttctgtccgctgaaaaggcctagaagcaataacacaccaagccctgtcgaatggtggggtccgccaggacctccaggcttgctccccgccctacccgccagcttctccgccacattccactgccgcagcagaaccggtgtccttcacctgcctgcgtcttctgcagttcgttaagcagcgcccttagctcctgtgacactttagggagaaagccgcagcaccggcgatgttggccgccattaacgcccggcaaagcgcccggaactagaagcagcgaagaacccgggtgggcagcgaccgtgacagccgagccggaagcggagctgcgggaggggcctcgacgctcctccatcttttattggagctcaccgctgccagtcgcgctgcctgcccgtcccacccttttcgtgcaggcattcagctaaatgacgggcggagcccggcggcggcttccggtcgggggaaaaaagttgggccgaaggaggggccgggaagacgcaagaggaagaagagaaaacggccgggcggcggtggctgtaggttgtgcggctgcagcggctcttccctgggcggacgatggacagccagggcaggaaggtggtggtgtgcgacaacggcaccggggtaagggccgcgcgaggaggccttggcggccacagacgccggcggggacgagcagctggcgcacgggccctcggcccccagggctgcacctccgggccctcggggcgaaggggcgcggggcggtgcctcccacctccgcgggcgtgggagcgagccggccgttccctggtctcccttgagcctgccacccatttagcctgccaccccctcacccttccgggtgggggcggcgggcgagaccggcactggacatggagcctactgaccgcccggcagggacctgctccgcgctaatgcgggggcaattgggctaaagcggacggaagcgtaaaaggctcggtttgtgtgttccgagaagggctcttttccccagggccaccggtttgtaaaaaggagaaagacctagaggccttcctcttcctgtatagttgaagatacaccaaacgagaagcaggaagcgggtttacttaaaaaaaaaaaaaaaaaaagggaagtgctgtcatggagtgtggacctcagccctttcgctgtgtttgttgggctttttattagttttttcgagggaaggggtccagatcggcagcgcatcgttcactttttgttttacatactagtatttggcccaggagtaggcccacggagaccagcatgttccattgagtggttttgggtgacctaggatcccgcaagactcaagtgttaattccactagccttaggggaagttaattagtgttgattatcccacccccagcccccttttttcccttcgtttcagtatacaggtaatgttagcctttaagattcaaaaattgtaaaatctgactaaagcactgatttagaaactatttgaaaattgtttctgtaatcccagcactttgggaggcccaggcgggcagatcaccagaggttaggagttcgagaccagcccagccaacgtggtgaaaccccggtctctactaaaaatacaaaaattagccggccgtggtggtgcttgcctgtaatcccagctacttgggaggctgaggcaggagaatcccttgaagccaggaagcggaggttgcagtgagccgagattgcgccactgcactccagcctgggcgacaagagtgaaactccgtctcaattataaaaaaaaaaaattgtttcattcagacctccctcttgccagattaaaaaaaaatgtattttgggtagcaaagtcagcaaattagaagatggaaatattatttattctggatgacttctatagtgatttctaaccattttgatgttgcaacattttgtgagttttctcccctccctcccataaatatgatgtatgaattaaagttcattttacttgaacaaaacactttggaatctgaattgttgagggggaaaagagctggtatttactgccataatactgcccttgattagatttgttacacaattttacaagcaataattatggtagcttcatctgaactgtgttaaaaatggactagagtaaaaagagtgttaacgtacattgaggccaggcgcggtggctcatgcctgtaatcccagcactttgggaggtctaggcgggcggatcacctgaagtcaggagtttgagaccaggctggccaacatagtgaaaccccgtctctactaaaaatacaaaaattagccgggcatggtggtgggcgtctgtaatcccagctactcggtaggctgaggcaggagaatcgcttgaacccggtaggcggaggttgcagtgagccgagatcgcaccactccagcctgggcgacagagcaagactccgtctcaaaaaaaaaaaaaaaaaaaaagaaaaacaaaacatattaatgtgacggtttttaagaatgtaatatttttaaaaaggcagatccactgctatggaaacgtctaagattttaagttgaaaaaggttttagaatgattcagtttaagtgtgtgttccttattaaagatgtatgtccacaaacttgtatccgcatatgaaagttttggagggatacataagaaatgttcataatggttacctatgagacagaggataagggagtgagggaagatggagaggacttcatgacctttctgaattattggaaaaatgttctttatttgaacaaagcaagtattattaaactatatttaaactaaattaaccataaacgcatgttacatgtgcggctaaaattcagttaaatgtgctttttaaaaaagtattagcctgatttccactatagtttcaaattggcctctaaataaataaaaaactttaaaaattgaatttaaaattttttgttttgtgattgtgtcagatactctttttagaaagtcaagccagttatattttaatgaattcttttaggggttcaaggtaatgagccctgtatttgtagtatatatgagtttttaaatattaaattagaatgggaatgttaaccgaagctgattttttttttttttttttttttttggacacaggatctagctctgttgcccaggctggagagcgatggcgtgatctcggctctctgcaacctctgcctcctgggctcaagcggttctcctgcttcagcctcccgagtagctgggactacaggcttgtgccaccacacccagttaatttttttatttttgtagagactgggtctccctatgttacccaggctggtcttgaactcctggggttaaaagatctgcccactgcggcctcctaaagtgctaggattacaggcttgagccactgcaccctgctgtcagaagctaatgttatgttactattccattagttagctaacattagaaggctgattttaggctgggcgttgtggctcatgcctgtaatcccagcactttgggaggccgaggtaggaggttcacttgaggtcaggagtttgagaccagcatggccatcatggtgaaaccccgtgtctactaaaaatacaaaaattagccgggtgtggtttctgatgcctgaaatcccagctacttgggaggctgaggcaggagaattacttgtacctgggaggcagaggttgcagtgagccaagatcacgccactgcactccagcctgggcgacagagtgagactgtcacaaaaaaaaaaaaaagctgattgtagtatgttattgattagtcttgtgtctaatccatgtttttaagattcttttccttaagacaagtgatcaattcctgtcataaatgaaaaaagtgagtgtaattaattcaaataaaatttatctgttcttatgcttctagttattttaaaattttatgcagattttctatggacatgattggtttcaaatgaagaaacagtgctgttaaaatacatgaatcatataacaggaatgctgtaatagttctgagtatgtagaggactaggaaccgcttagattgtgtattctgtttcttaccatttgtagacatgaataatcatcttgattttatttagatacctgaagttataatgattcctttataattaaatattaaagaagatattcagatgtaattttgcaaatttatggaaatagttgttatcctaaggtgttttcatttgctccttacatgccttaggttttaaaattgtaggctggctgggtgtggttcctcatgcctgtatttccagcattttgggaggccgaggtgagaggatttcttgaggccaagagtttgagactagcctgggttagtataacaagaccccatatctagtaaaaataaaaataaaattacaggctttttaaaaagttacgattcttttaacctctctggcagacccaaattaaatattctaggacaggagtgtccagtcttttggcttccctgggccacattggaagaggaattgtcttgggccacacatgaaatacactaacaatagctgatgaactaaaaaaatcaccaaaaaaatttcataatgttttaagaaagtttgtgaatttgtgttgggcctcatgcagcccgtgggccatgggttggacaagtttgcctggaaacaagtttgtacttacgatcacatgaccaatgttggtcccgcttgattttctatctcccagcttgaccagtgtctcagtagggttgcccagaggaggaaaactcatttgatccaataatttatgtggattttaaccattcaaacctccttctgaaatcaagccacttaaagtggcccagataggtgaaaatctggaggtctgtgaaactctaggtttaggtcctcttcacgagctaggcccaggcccctggtgttacgtgtcttgttaccagactagggtgatttcatcagcattgagttagatcaccaacaaaatgaaggtttctccagtgcgtgctatgttgctggcacagtgcttaataaggtccagtcgtacagagaagcttatagtgctagaataattgcatttgcatttatgtaattgacatttgtagttgattgtggcctgctttatcgggcttatgctactttatatgttgaatttaggagtgtttgaaacagaaacaaaccaaaaccaaatttggtttcatcttgcaaaatgctttggtataagtagaataaatattttggtggcctaagatcagaacagtcactgtgcagttaacttactaaagaacatcagtaccatgagataaaattagtaaggggaaaataaatattaaataagcccaaatggggctttataaatcccaggttattatttttttgaagagaaaaaaaaaatgtacttttagagcagatgtagatagaatttttcatttttgcttgaaagaacattatactgttcatattcttaccatttgatgactcagtgggaagtaagggaactagtttaaaccacactgctgtgaagaggaaactatatatggtaaaatctatttcttaaacacagccttactgcacacaatgaaagaacgaagtcaccaagtcttaaaatgattgacatgggggaggaatttcaaggattaagatgataccaatgataccaaatgatagtttagaaaggaatgttttctttgtattttatcacatcatggtttagttttttttttttttttagacagagtcttgctccgttgcccaggccagagtgcagtggcatgattttggcttactgcagcctccatctcccgggttcaagcaattctcctgcctcagcctccccagtagctgggatcacaggtgtgcaccaccacgccaggctaatttttgtatttttagtagagatgtggtttctccatgttcgtcaggctggtctccaactcctgacgtcaggtgatctgcctgcctcagcctcccaaagtgctgggattataggcgtgagcactgcgcccagtctagattttttttaatactgattattattattatttgcagaagtaatcagattgtcagttttatattattgaaaaattggggccaggcacagtggttgatgcctataatcccagcactttgggaggtaaaggtgggaggattgcttgaggctgggagttcaagaccatcctgagcaacagcgagacccctgtctccacaaaaaataatataatttaaaaattataatttttattttttctttactgcttcttgcagagcaggactaccccataggcagtgtgcccagagtagccagtataattttttttttaattattttattttattattgtttttgagacagagtctcactctgtctcccaggctggagtgtattcatgttatctcggctcactgcaacctccgcctcccaggttcaagtgattcttctgccccagcctctcaagtagctgggattacaggcatgcaccaccacgcccagccaattttgtacttttagtagagatggggtttcaccatattggccaggctggtttcgaactcctgacctcaaatgatcctcctgccttggcctcctaaagtgctgggattacaggtgtgagcccccacactcagcctttttttttcctgacagggtctcactctgttgcctaggtgggagtgcagtggtacaatcatggctcaaggctcaacgtagcctcaacctccctgggctcaggtgatcctcccacctcagcctcccgagtttctggggctacaggtgtgtgtcaccacgcctggctaatttttgtattttttgtagaaatggggttttgctctgtagcttcaggctggtctcgaactcctgggcccaagcaatccacccactttggcttcctacagtgccaagattacaggtgtgagccaccattcccagccaattattttagttcttgttattataactgttaatgttttcacttttgaagtaatgtgaaatagtgcaatttttgctatcttgatggatgaatatataccctgtatgaaaactggtgctgagttctatggcaacatctgcttccaataaactactgctcaagcagaatagttttattaataagtgattgataatctttaatttgaatgaaaagtctttttttttgttaggcagtaatagtaggtttacagttgtttttatagtttcagggatttcagtttttgtcttctaacttgggaaatgtttgttgcttaaaatatactcataagaatgttaagatacgaactacccatctgaacgattataattggaagactttgagtgatgtgattatttgccactttgccatgttgtatgtccagtgtgtgtagctctgaaggagaggggagacgtgtcaaccttagcagcctcttccctgcactaggatcagacctatgctccatcccaggctcctcctgccacctccagcttctcttacgatttctcacttagtaaacttatttatttgcattcagcatgccaaaaatgaaccttacaaactggtaggttctcttttcattcattcattcattctataatttttttgagataatttatacgcatataagtgagcattttcatcctgataaatggatacttttgactatatctgtttattacttggaggtaggcataataatttaatatcaaaatagtatttaattcccatatttgagatatttgtgtaaattatgactgacattaggctggcgatcatgacagatgttatacagaaatgtgggaacaatagggataatgatgagaacagattctcttccatatcatttaagtttgtatcaagtaaactggattttgacttaaaagagagtttgtgatttgggagagaagagtgtgtgagaggtgtgtgtgtgtgtgtgtgcacgtggtgtgtgtgttatgttttagtttgaaaatactaaaaaatactagatgttattcttttcctctgaggtagtttttcctccatgtcttaggtcacattatttaagaagacactgagaaaaaatgaactactactcctgaattctgttcattttaagggtgggaagtgtattccagttcatcactatcaaccactgccaaggggaaatagctgtgagcaagtgggttatctattgcatatgctatcatatcatgctaacttctgccttaaaaagtaatccaggctgggtgccgtggctcacgcctgtaatcccagcactttgagaggctgaggcgagtggatcacgaggtcaggagattgagaccatcttgaccaacttggtgaaaccccttctctactaaaaatacaaaaattagccaggtgcagtggcgagcgcctgtaatcccatctactcaggaggctgaggcaggagaattgcttgaacccaggaggcagaggttgcaatgagccgagatcacgccactgcactccagcctggatgaccgagtgagactcagtctcaataaaataaaataaaataatccaaaagaattgtattatacttttagaaatggatagctgtacctgaaaaatgcccttaccttggtggctcaatataaactaagactaggtttgtgggcttgtaagaagacatctgaataatatgttttatgtagtttctattaataaaatgtaaacatgaggtgaaaggataggaattgaggtggcattgggagtgtgaactttcctcatttcagacgaatttttcataaaagctttaatctgattgtcatgactgtaacatatttgaaaaaactctgtttttaaaagactaagtggggccgggtgcggtggcttatgcctgtaagccccaggctggtggattacatgaggtcaggagttagagaccagcctggccaacatggtgaaaccccgtctctactaaaaatacaaaaattagctgggcgtggtggcaggcgcctgtagtcccagctacttgggaggctgaggcagaattgctggaacctaggaggcagaggttgcagtgagctgcgatgacgtcactgcactccagcctgggtgacagagcgagactccatctcaaaaaaaaaaaaaaagacaagtgaaattctggatggcagaatgtcctaggctatttataattaaatgtggttcatcagcgtcatctccaacagggctgctgtagagatctttgaaaataccaaatttttatgttttggagagctacataagatcttgctaagttttaccgcattaaacaaaagagtttcttgtagatagtagctttcttttgttgttggttttttgtttttttgggttttgttttgttttgttttgttttttttgagacaggtctcattctgttgcccaggctggagtgcagtggcgtgatctcagctcactgcaacctccgcctcccaggttcaagtgattctcatacctcagcctcccaagtaactgggattacaggcatgcaccaccatacctggctaatttttgttggttttagtagagatgggtttccatcatgttggtcaggctgatctcaaacttctggcctcatgtgattcaagtggtgtgcatagtagccttctatcaagaggtacattgctcttttctgtctacctttgttttattactgtcatgtatcacattcaggtactatttttcatccttaattctaagaatgtgtggtgcctggagccatagaaaaacagactttttctgaatattaaatatattttaaaacaatcatggtatcatactgttaagtcaacagcaaaacttttaatatttattgatcatttactgtgtacctattatgtgccagacgctgttctaggcagttggaattcatcagtaaacacagtgtagctaacattaaataaatgcttgttaaagagggtgcagactatgattacatttcctttcttatatagcttcctcctcccaccctgaaatttttaattgccctttccttgcaatgtctgctcttactagactatgtattatttattttttgtatgttttttgagacagggtctcacatgatcacggcagccttaacctcccaggctcaagtgatcctcccacctcagtctctggaatagctgggactatagcacatgccacaatgcctggccaatttttaaattttttgtaattttttccgggggggaatcttgccgtgttgcccatactggtctcgagcttctgggctcaagtgatctacctgcctaagcctcccaaagtgctggaattacaggtgtgagccactgggcccagcgtaaacagactatacaagaatttgtaactgccgggcacagtggctcatgtctgtaatcccagcaactcaggaggctgagacaggaggatcattggaggccaggagttccagaccagcccgtgcaacatagtgagaccccatctctacaaaaaattttaaaacttacgctaggcgtggtggctcactcctgtaatcccagcactttgggaggccgaggcaggtggaccacttgaggtcaggagtttgaggacaacatggtgaaaccccgtctctactaaaaataaaaagaattacctgggcgtggtgaggtacacctgtagtcccagctactcagaaggctgaggcacgagaatcacttgaacccgtgggcgggggcggtggaggccaagcttgcaatgatctgagatggagccactgcactccagcctgggcgacagagtgagactctgtctcaaaaaataataatgaaaataaaaacttattcgggcctggtggcacatacctgtagtcccagctacttgggaggctgaggtgggagcatcacttgagcccagcagttagaggccacagtgagctgcagttgtgccactgcactccagcctaggcaacatacaagaccccaactctaaattttaaatattttttaaattaaaaaagtattaaaagctcttgattctctcaagttttactgtagttaaatcctgtagaatatcagcttcttatgtataaaatggaagtcttatcacaatgatatgttctcggagcagtacacagagaatgaaattatgttacccggtattactaaatatatttatctaaatgtaaaaatgtaaatagggccaggcgcggtggctcacgcctgtaatcccagcactttgggaggctgaggcgggcagatcacgaggtcaggagatcgagaccatcctggctaacacagtgaaaccccgtctctactaaaaatacaaaaaattagctgggtatggtggtgggcgcctgtagtctcagctactcgggatgctgaggcaggagaatggcgtgaacccgggaggtggagcttgcggtgagccgggatggcgccactgcactccaccctgggcgacagagcgagactgtctaaaaaaaaaaaaaaaaaaagtaaatagctagccaggcgcggtgactcaacgcctgcaatcccagcactttgggaggccgaggtgggcagagcagctgaggtcaggagttcgaaaccagcatggccaacatggtgaaaccctgtctctactaaaaatgcaaaaattagctgggcatggtggtgggtgcctgtaatcccagctacttgggaggctaaggcaggagaattgcttggacctgggaggcagaggttgcagtgagctgagatcacgccactgcactccagcctgggcgacaagagtgaaactccgtctcaaagaaataaatagccaaaaatgcctaataaatgtttcttttcataatacggtgatattagtttaaatgacacttggttttcccattttggaaaatgacattctctaagcgatttgcccaaaatgaatgaaagtctgctttagaattgaagctttagttctgttcattttctcacatttctctttctaaaaatacttagcattttgccgggcatggtggctcacgcctgtaatcccagcactttgggacgctgaggcaggcggatcacctgaggtcgggagtttgagaccagcctgaccaacatggagaaaccccgtctctactaaaaatacaaaattagctgggcttagtggcgcatgcctgtaatcccagctacttgggaggctgaggcaggagaatcacttgaacccaggaggcggaggttgcagtgagccgagattgtgccattgcacttctgcctgggcaaaaagagtgaaactccgtctcaaaacaaaaacaaaaaaaaccttagcatttgttcagcgaatttgtccatcccacagatacttctggagtgagcactgtgtgccaggagctctgttaggtattggattccagcacgaactgctcagcttagctccctgctcttatgaggcttttggtctagtgagggaacttaggcactaatttagcagtaaataaacatgaaccctggaagtaggcaatgccgtgaaagaagttaaaaggagatgttgcgatagattgagtggctacttcgggtggactgaaagcaccaaaagtttaaaatgttatataaatgcaaagtgatatttttcagatgctgtcttaaaatatagtaaatatcctgatgctaacccacttttattttactgtttcattccagtttgtgaagtgtggatatgcaggctctaactttccagaacacatcttcccagctttggttggaagacctattatcagatcaaccaccaaagtgggaaacattgaaatcaaggtaatattttatttattgataaatgataatcaagacatgtgaggtgttcttataaaagtagtttaacagttcttttaagtagttttaaaatatgttgccatgaaaagcaaaggggagggtagaagttctcatatttttaatttatatcaacacctgaacaggggcacaaaaattgaagttaatttcatctgattttgtttatgtatggcttgatgccattactctttggagtaaaatacttaagtttattacattaatgtgaaacgctgtgttagtgacttaagtcctattacataatataatttttaaaagaaatcggcctggtatttttatgtctttcaattccatatatttgtcattgtatgtgagtgtctctttggcaccttagactttttcttttcatgtttttatggcctgatccctctacttttttatatagccatttaggaaaacacagggtgtaaatctcattgattcctcttttcattaatataacttatttccataatgtgcagaaggaagccattcaagcctttatttggccttggattatgtatcttaccataaagaggaaggaaagttttcattgcctactcgctgtatttaagatgaaagactacatgaaaagacgatcgatttttctcccatattaaagggatcagaaatcaagtaggagttacaatatttaacaagaaagagaacagtgagaggacagtagtcaccagttggctttaagttcttcaggtgactgaaggatcaagttatacagaatgccatagaatttagggtcttttttagtgaattatttgtgaacacgctagcattgtttgtcctatctggatagtctttagcaagccttcagtgtaaggttatgagtcatttgaaatatgcattagggcgtatctctttgggacatttgttttatgtaggaaggtggtaatgggtggtagagatttgctatgtagccttctgcttttgggatagagagttgagttacacaatgaataaaaatacaacctgaaacttgggttctgtgttagtttttttttttcagagttaaagtagcgaatttttctggcctctcctgttaacaaaaaaaataaaatgggacactcagtgtaagtttttcctttttaaggagcttttggaatatttgtgggattccttacttgcttattgtgaactcctttcattctgaatgaattctatcttaaatgaactttgactggaaattagctaataatagtgataaggataaactgtttaatgaagttgaaggctatactttttattcagtgtcaggtttttaaagaatggcttttttatatactggacaataaaatttttgaggtatgaagaaatatcatgtatagccataaatttattttgcaacataggcacaaataactacacatctcttcatgcccactttcttcgtgtttaaggccaagtgatagaaatcaaatttgtcagtatgctaataaaacatttttgccaaggaattccctagcagcatttgcttgtatggtttgtcattctgtattctattggctcaattctgttcactctgtgcaatcttgtaagcctatcaagttaaattattcttcgagtagaaaacagcaaaagatacctgtgtcaaataaatttaacttgaacactagagcttggaaaaacaaccctgagctatctaacactctgcctactcagctagacctttgctgttatcatttatttttcttaattaaagttcttaagttcagtaatgaattaaagaagcttactttttggaattcctgtgcttagtattttgacttatactttttgtgtcttgttagctaaaatgtggtagactgaaaaatggaaatttaaatcgtttaatgagttaatttgcattcaggaataactgtccatgttaatttggccctaattattaactccattaaatatagtagtactgcatctgacctcaacctaattgtctctattgcttgtatgtttaaacatttcagtgaggattttatttaggccttttctgactcttacttctaccttctctctcttcacctttcttgacccgttgaagtagaataacaaaaagatggtaagtgaggttacacacatgctctgtttgttttccacttttgcttgatgggacagtagttgttgttttgtgtccctttagtattggggagggggggttatttccatatttttattttaagtactttgatttttaacctttttcattgcttcaatttgatagcaactaattaagtcctatactttcctgattgcgtacaatggaccaaacaagaactaattactaacatagttttgaattgttttccttgtttttcttgtagatgaatgttataattaaaatggaatgtgttgtgcataatattagaaaccagatggctttatataggatatgtgtgatccaaaaaattcaagtgaagttgttacatttgaataaattcactttattgaccagtattaaattgaacattgactgtcatagcctgtatatatatttgcatctagtgtggtatcatatgtgtacttaataaactgagtaaaattttaatatgtaaataaaccatagatagaaaaagagaattctttccatatcatccttactgatgagcagatttcacaacgttatctgaggataaataagaaaaaggtaaagcttttctataaacaacagatttcccccccaaacattgtacagtgtgtttttctttataactataagcttgctggtcttatctcagacatttaactcttcattgtatttttctgtgatagtctaagtgcttctgtagtagatacttttcaagtttgtttttaatattgtttgtaagaatctctgacaaaaatcaggcacttctaatatatattttaactagtaatagtaactttgtgaagttttcttttgaataaacaaaaacatttaaaagaggaaatttatcctaaataaaagatcataacatttgtgtttatattctaatgagattaagaaaagggtgtgcttgctgggcacggtggcttgtgcctgtactcccagcactttgggaggcccaggcgggtggatcacgaggtcacgagttcaagaccagcctgacgaacatggtgaagccccatctctactaaaaatagaaaaatcagccaggtgtggtggtgtgtgcctgtaattccagctactcaggaagctgaggcaggagaatcgcttgaacccgggaggcagaggttgcagtgagccgagatcacgccactgcattccagcctgggcaagagtgagactccatctcaaaaaaaagaaaagaaaaggaaagagtgcgcttgtagagaacagtgtaggcttattttaacagaagtttttgaccgagtgaggtgtttcatgcctataattccagcactttggcaggacgaggtgggaggatagcttgagcccaggagttcaagaccatcctgggcaacatggcaagaccctgtctctatagaaagttttttaaaaagtaaccaggcatagtgatatgtgcctcccaagcaacttgggaggttaaggcaggagtattgcttgagcccagaagtttgaggctgcagtgggtgatgacagggccactgcactccagcttgggtgacagagcaaaaccctgcctctattagttaattgaacaaacaaacaaatgttttcagtggaattttcttctagggatttaattgtgcttttgaacttgagtttactctgtattctaatttgaggtgacattgttcaaaatgattcttggcaaatataatccctactacccacttttcatgaagtataaatacctttgaaacagcatctcagttactgtgatttttttcattgtttcagataggtgatgttcagtggcggggcaggtggttaaaacctaaggtctgatctgatcacttataacttggttctgagtgatgaaggcaagttatataacacttagtaggatttttttattaaaattttcgatatgaaaattttttaattggatagcttgaatagtcaaactttgtacttcttaaataagttaatactccattttaaatgtcctgtttgttctgaggaaggtaaggatactcaattccaaacatttctttcagttaatcctttatagtatgtgtggtcctagaagtagatacatgaggcatttatttagagttggcattgggtcatgtaaatgtaagcccctatttgtacattaaataaaaagtaaatttctgttgaaatcagatcagacttatttcaaattggttgaaataatactgattatattatctaattatctaatctgttatcttgtacaacacacaaaaaagacgtaaagttagtaacaaaaatggtatatataattacaggtatagatttcccccctaacattttattaagcagtattaagaaaatgtagcaatattgaaatgattttacaatgaaacttgtatatccatcacctggattctgacattaatatatatcatactgatttattacatatctgttcatctgttcattcatcagtgcatcttgttttttgatggatttcaaagtaagttgcagataccagtatacttctccctgaatacttcaacatgtgcatgttattaactagaattcacaaatacagatttttagttttgcatattcctcatagaagaatctaaacggttgggtgtggtgattcatgcctataatcctagcactttgggaggctgaggtgggcggatcccttgagcccaggagttcaagaccagcctgggcaacatggtgaaaccctgtctctactaaaaatacaagaattagctgggcatgtagcctgtagtcccagctacttgggaggctaaggtgggaggatcacctgagcctggggaggttgaggctgtggtaagcaataatggcaccactgcactccagcttgggtgacagagtgagaccccatctcaaaaaaaaaaaaaaaaagagtgtaaacatttaatatttcagatatttgagtaataagttagtaagttatggtaaatgaacttcataagaaattgcaacaaatttttactgagcatttctagcatctgtttttaactttgttatactttttgatgcttttagtggattttccagagatctgtttggttttttgttagagtcctcaccttggtttcatctctgatattttctttttcttttttttttaatttaaaactcatatatttttaagcctttgttttaaaacatctcatgttggccaggtgtggtggctcatgcctgtaatcccaacactttgggaggccgagatgggtgaattacttgaggtcaggagtttgagaccagcttggccaacatggtgaaaccccatctctactaaaaatacaaaaattagccaggcgtggtggcaggtgcctgtaatcccagctactcaggaggctgaggcaggagaatcgcttgaacctgggaggcagaggttgtagtgagctgagatcatgccactgcgctctagcctgggcagtagagcgagactcagtctcaaaaaaataatctcgtgttaattttgctgctgcttttttttgtctctccataattaaaacttaacgtattgtagcaaatatctacttctgatactagtttttttaattgaatttatcaacatatgtagaaattagtattatttaacatcttgactagctgttctctaaaaataagtctaaatgctaggacatccttacttattatatatagaaaatgtgactttcaaatgtgggtcatcttaagtatgctctcattggagacaagacttgtgagtattatgcttcatgtgtgatggtgtagttttccagtatactttaagattgaaaatgttgctcaggagacaattttaaaggatgggttatttgcctatatcttaattttttataactctacaaattctcattcaccttggtgaggcatatgtagaaacagtttaaattcttattcaggcatatgtagatagaagtttgtgctatttataagttagttggtgtatgtatgcattattatagagtaataaagaatcattttattttttgcttctttcattatgctttatagtacttacatttatcattttgatatttagtgcaaagaaatgtgctgcatgcattgagcatttttctacaagtttttttccccctgatgtgctatttcacatatcacaggccttattttttgaacaattgagcaaaagaaacagatgaaacctcatacaaaaccctccaaaatatgaaaatgtggggtttatttgtgctaatgctcttcttttggaaacatttgtgttaaaggtaaggtcaatttattgatttaaaccacattgtatgtaaaaatgtattatccatgattaaactttctaagacattgttcttgatagaaaagattttctaacttgtggaataaaaagatttattttgcaagtgtcagaaatattaaaattaattattcccaagttttcttaaatattatgcaaaactttgatctacagctttgacataattttctaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtgagtttttatgcaggatatgcatatgtgtatttctgtgatattatgttaaatcaaaaattttctactgttgctatggataaagagaataaaaataattgttttccttcagatcttattaagtatctactatatgctagtcattattctaagtaggaaagtaggatagatcagtaaacaaaaaatcctactgccatggagtgtatatattctaacagggaaaaacagaccaaaaaaattaagtttttaatttagtgagttaattaagttaattaagtttttatggaggagccagcagaaggagactgaaaaggctaatacaataagcagttacagagttaattaaatggtttgttagaaggtgagtgatccagttgacccatgagcaatgcaggggttaggggcaccaaccctccctactcacgtgcaaacttaactaccacccaaaatacttaacttctaatagcctactgttgaccagaagccttactgataacataatatgtattatatactatattcttaacaataaagtaagctagaggaaatactgttaagaaaatcatggccgggcgcggtggctcacgcctgtaatctcagcactttgggaggcggaggcgggcagatcacaaggtcaggagatcgagaccatcctggctaacacggtgaaactccgtctctactaaaaatacaaaaaattagccgggcgtggtggcgggtgcctgtagtcccagctactcaggaggctgaggcaggagaatgacgtgaacccttgaggcagagcttgcagtgagtggagatcgtgccactgcactccagcctgggcgacagagcgagactccgtctcaaaaaaaaataaaaaatcataagagaaaatacatttactataccttaagtggatgtagatcatcataaagatcttcatcgtcattgtcttcacaccgacgaagaagaggaggggttggtcttgctgtctcgggtggcagagacagaagaggtgcaaggggaggcaggaaagatttattgacaaaaatcgtgtataagtggacctgtgtggttcaaacttgttgttattcatggatcagctgtagatgctaaaggcaaaataaatcaggttaacggggagtgggaggttgtaattgtacataggttgtgagaaggtgatgtttaaacagacagggtaagtgagttagccagggtatataggagaatggtattccagataaagggagtagccagtgtaaaggtcttaagttaggaacaagcttggtatattaaagaataagcaaggaagccagtgtggttgaggagagagcaacagaagatgaggtcgagtaagtaatattggtgccttgtaggctctaattaggaattgggcggctggaagtggtggttcaggcctgtaatcccagcacttctgggaggccgaggtgggcggatcacgaggtcaagagttcgagaccagcctgaccaacatagtgaaacgccatctctactaaaaatacaaaaattaactgggcatagtggtgcgtgcctgtaatcccagctacttgggaggctggggcaggagaatcgcttgaacccaggaggcagatgctgcagtgagccgagattacaccactgcattccagcctgggcgacagggtgagactcagtctcaaaaagaaaaaaagggaattgggcttttactgtgggtgaaatatggggctgttacaggaaaaggagatgctcagatttagatttctcttgtgttgtgagtatcccacaaggaggcaaagatagaagagttggagactttttcagtcatttaagcaaaagataatgatggttaggattgaagtagtagtagtagagatagtgagaaattaccagattataggtctgttttgaaggtagggctataaatgatacggttcaacaaagaagagggtagacagtggtgaaaaggccaaggaccagagagataggaggagccagcagaaggagattgaaaacgttattgaggccgggctaggtggctcccagcactttgggaggccaaggcgggtggatcacttgagactaggaatttgagaccagcctggccaacatggcaaaactccgtctctactaaaaacacaaaattagctgggcatagtggtgcacgcctgtaatcccagctacgcaggaggctgaggcaggagaattgcttgaacccaggaggtggaggttgcagtgagctgagatcaccccactgcactccaacctgagcgacagagcgagactctgtctcaaaaagaaaaaagaaaaagaaaaaaaagttaatgaaataatgaaataagcagttacagaggaaagagagagcaagagagctatgatcctcatagtttaaataagtaatttttcaaggttcttttatttttgtatatatgaagtagaaatttaataacttctgtagctttccagttactgtttaatgtacatattttgtttacgaatatgtttaaatgttgatggaaatttttgaaagggtttagaagaaaatgttgttagtatttttaaagcctgtattaaaactcagtttttgtattaagtgttttgaaaatctaagatcatggttttaaagaatccatatgatttcttatggcttatattttaatattcttatttgtttatgactacaaatatgtctatgactgatagtgtcctaccttaatctcattaacatgctttcacattggtatgtgcatatatatgatcattcttccattttcatccctgtggaggtggaataaaggatgatggaataaaatactattcagactatctaattgcttaattgatgagtatgtgtttcagagttgtagaatttaaattctgtgtaattttcattgtggtcagttgtaaaatttctaaatatttagatattcagagtgataggcaaccctaccagtcaaggggtgctcagtcaagatcaccaaaaaaaaaatcatgcaggatgttcccagctgacctgggctacagagaatgaacatgtgtgtgaccagtgagggcaaaaaggaaagaactcctccttccagggtagttcatttggaggttgtaattacagtcttgattcaagtagggactgggctcagcagctaagccatttctgtatcttccagcaatcaggaattaaccattgatttttgtctttgccgtggcattttactgggttttttattttttctttctttctttcttttaatttttaagctgctcagggtagacagagctacactcttggcccagattgagggagggggtacgaggctctgtaaagcaatttctatattttgtcttcgaattaaaagatatttcccggccgggtgcggtggctcacgcctgtaatcccagcactttgggaggccgaggcaggcggatcatgaggtcaggagatggagaccatcctggctaacacggtgaaaccctgtctctactaaaaatactaaaaattagccgggtgtggtggtgtacgcctgtagtcccagctactcgggaggctgaggcaggagaatggcgtgaaccagggaggtggaggttgcagtgagccgagatggcaccactgcactccagcctgggcgacagagcaagactccgtctcaaaaaaagaaaaaaaaaagatatttccctggctggatgtggtggctgacacctgtaatcccagcactttgggaggccgaggtgggtggatcatgaggtcaggagttcgagactagcctggccaacatagtgaaaccctgtctgtactaaaaatacaaaaattagccaggcatggtggtgcatgcctgtagtcccagctactcaggaggctgaggcaggagaatcagttgaaccctggaggtggaggttgcagtgagccaagattgcgccactgcactccagcttgggcaacagagtgagacttcatctcaaaaaaaaaaaaaaaaaaaaaagaatttcccttaagggatatcaattaagaaagtcttgttcaatacagagagctttctttcacactaattagtcattaactaatacactaagaaatctttgctttgtcacgcttatgaaatgcttggggacttagaaatctgtcttcagatttggagctctgtggcagcaggactttaataagaaataagaggagctgatgaaaatggaagactatttcaggtccatttgattctattttgggcaattaattcactctgtgaccatgaggaaaacatttatttattatgtaattttctaaataccagtttttttctttctgtctgcatttacaggtaatgtttgaaacttaccagttttccggtgtatatgtagccatccaggcagttctgactttgtacgctcaaggtaggttaagcttaactgttagaaaaaacacttcatcaaacatttattatgtatgttttatgtcagagaatttggtttctcaataagttataagccccagaaaactacattatttatataccacactttgaaatattttcagtttttaaaatttgtgaaataagattttatatacatttttatttgctaaatatgtatttaaggtaaaaaaaaaaggcttaaagacttattttttaaaaaataggatattctctcttttaagctatttaaattttttttgagacagattttcgcttttgttgcccaggccggagtgcaatagtgcaatcttggcttaccacaacctccacctcctgggttcaagtgattttcctgcctcagcctcccaagtatttgggattacaggcatgtgccaccacacctggctaattttgtatttttagtagagatggggtttctccatattggtcaggctggtctcaaactcctgacctcaggtagtccgcccgcctcagcctcctgaagtgctgggattacaggcatgagtcaccgtgcctggcatagctattttaattttttatgcatggaatttgtccccagaattggcttgagttaaaaaaaatacgcagagattcaaaaaggtagcataaaatcatgcctgtcaaatatatagtagattaaaaaggagaaggtaaacatttgggagtgcatttctaacttttgaggtgggtttaatggaggggactacttatatattctcttgatattgccattagcaactgcctccctctttattggaaataaaatattggccacgttgggagagctcttttttttttttatggtcttataaattcaacaggaacttactgagaatgtctgggcctgtcagatatgtgccaaggagtcttttaggcacttcaggggataatccagtgggaaaagagtgtggcactggaaatgggtcaagtgtgtttggagaaaggccagtatgtgtgtgacctgatggaagtggtagaaaataaggtgaggtgggtagggagggctctttgggaaataaaatgtaaattcttgcattagtcagtgttcctgggagtatttttgaattgatgatggtgtgaattcctccttttttttttcttttttgcaatggaaatcctcttctttttaaaagagtacaacattcaagggctgtatatgagttttatgaggcttattgcatcaaggaattatatccacttaaaaaggaggtagttttaggccgggtgtggtggctcacgcctgtaatcccagcactttgggaggccgaggtgggtggatcacgaggtcaggagatcgagaccatcctgactaacactgtgaaaccccgtctctactaaaaaaaaaatacaaaaaattagctgggcatggtggcatgtgcctgtaatcccagctacttgggaggctgaggcgggagaatcgcttgaacccaggaggcagaggttgcagtgagctgagattgtgccattgcactccagcctgggcgacagagtgagactctgtctcaaaaaaaatatgtaaataaaaataaataaaaaaagtttttttgaccaggtatggtggctcatggctgtaatcccagcactttgagaagccaaggtggtcaaattgctgtatctccagagtttgagaccagcctaggcaacatagtgagatccctatctctataaaaagtaaaattagctgggtgtggttgcacatgcctataatcccagccacttgagaggctgaggtgagatgatcacttgagcccaggaggttgaggaaacaggggaaacaaagcagcttctttgctgttcttttattatgaggtttaactgacattgccttttattataagttccagtgaataatcaaagtgatgctttggctagccatgtttaatttttcttagatttctagctgtctagtatcaataggcatttttccagaacacacagtatatgttatttgtagtatattcaaaactatctaagttgaaaaaaataaagaattgtacagagctttaagaacgtgttctgctgggtgtggtggctcacgcctgtaaccccagcagtttgagaggccaaggcagacagatcacttgaggccaggagttcgagaccagcttgggcaacatggcgaaactctgtctctacaaaaaaattacaaaaattagccaggcatggtggtgcatgcctgtagtcccagctgctcaggaggctaaggtgggaggtatgacttgaacccaggaaatgaagattgcagtgagcctagattgagccactgtactcctccagcctgggtgacagagccagaccctgtctcaaaaaaaaaaaggaaaaataagtcctgtttttcagtcctcagtctcagggtctgtttcttctcatctccttggacagcacataatagtagactaaaagtcttaaaagagaacactcgctttaatacttatgcattagaaacaaactgcaaaataactaaataataaattctggcttctagttggttacgtttctgttttggcttccctactgtatttggaactcgctggctttggttttcctgatttgactttttatttaaatccccctggcttttatgcaggtttattgactggtgtagtggtagactctggagatggtgtgactcacatttgcccagtatatgaaggcttttctctccctcatcttaccaggagactggatattgctgggagggatataactagatatcttatcaaggtaagtgaacggaaaatatcatggaaattaaattttgtaatttgtttaccaccttaacacagaattgaatctatcgttttaggattccagcaaatctgtaccactagagaaattatccaattacctcccttatttatataaaaattcatataagatttatacacatgaagaaaaaagaagatacattaaaaacaaggaaaaaagtgtacacacatgatctctgtatactaatgagagtacattatatcattacataattatatttgttattcctgaggagtgagtagacagatatttcaaggatagaagagacccctaatttgaaactttcttggacagctcaggcagccttttctgccataaaacctttctttgagcaggtatgttttaagccatgatcttggttgggttgtctgctcttgtcctttcctacaaaatacagtgatagcaaattaatgatatttgaggaaaacagcccaaatacgccagactttaatatttagtagttttcatggaatagatgcagtttttaatatttactattttagtttatttctgaatataactagttataattttctttaaaacattactggagaaagtacataaggtgtctacttgctaacatatatcatttttaatattaaaataaaatttagaaaattgtttataccacaattctataatcagtctatcctctccaggacagtggttctcaccaggggacagtgctgtcctctgggggatattagcaatttctggacacatttttggttgtctgagctgggcaggaatgctactgaacattctataatgaatagggctggctgcacaacaaacaatgtatagtctgtcagtggtgctgctattaagaaaccctgtctctgcattaaattgggttgcactgtctttaccttgacattgggttccttcagtctcatttaaagtaatcctcctcatgaggggagattaaattaatgagaattataatactctcattttaggccaaaattcaaagcgtaactaacagaatttctggggttgtctttagaacacagactcaaatattagaggattttttttttatttgtaaagtctagtaattttttttctctcagtgggtttttaaaaaaatagtagtattttctagcatttaagaaatgtaacaatggagattatacctttgagtatcccaataattcccttatcattcgttaaacaaatgctattgtccttctaatatgtgccagacacagtactagaagctaaagataaaacttttaaagacttgggggcatttcataaatatggcattaattgtgtgagcaaactgcaggctacaggagtccagtactaaaataatatttattcattaatatacttttgattgtttatcaaaactatcaaaacattagtactcatgcagtgcttttcaaaaactgacttttctagtcattttactgacttacttatgaattgttaattcttttaccctctctgaaactgaaatataaatccttttatggcggataaaatcctgcttctgaaatagtaggagctgaggatccactgcccattctgtttgttattgatgtgacatatttaatgagcattactagcttttgcagagtagaactcattcagatgtattatgaacttattgctattgttttgtaccagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacagtaagtgtttccagtgtataatatatatgtgttttaaagtggacagccatgattattggtgtcagcttaaggaggttttcttagaatcagtatttttgtcttgggttgttgtaatatgtatatgtgtgacttttaatgtctctttctacattaagtttctatttaattattttagggcaccatataatgcaaattaaggcaagaatcataaattactctctatactaggatataattagatgcgagatgttattttgagattctagtatttggcatagcatttctcaatgtatgttttacagaactttatttccctgagatgctaataagcatttcacaaaaattaaaaaggattacattgtcagatgagtttgagaaagagttgatttcacttcactgtagaactcagagcctttggtatgctaatatgggcacaattaatatagtatgcgtgtttttcagacttatgctctaggacttttcagaatttcatgggattagtgatctaagaaacatactttggaaatggtcattctagagcattgctttactaattcagtaggtggcagcctttcctgacttaatattctttaatgaggtgttaaatgttaacttgaaattgtaactaatgagatttagtacctggttatagtttataacaccagaggagttgatcctacttgaatttttaatgaattaccatcttaagcctattaaattcgtctgagtataaagtacttccaggtctcatctttgatctagttattactaaaatgaaacagtaataggcaatgaaggcaagtattttaaaaccatatgatgcatactagctctacatattcacaaatatatgcaaaatagtcatttttaaagtaattataaaaaatttgttgttggccgggcgcggtggctcacgcctgtaatcccagcactttgggaggccgaggcaggcggatcacctgaagtcaggagttggagaacagcctggccaacatggtgaaacccgtctttactgaaaatacaaaaaattagctgggcaaggtggtgggcacctgtagtcccagctattcaggaggctgaggcaggagaattgcttcaacccaggaggcagaggttgcagtgagctgagatcgtgccactgcactccagcctgggtgacagagcaagactccatgtcggtaaaaaaaaaaaaaaaaaaaagttaagatagtgatccaaatattcagtaaacccccatttaaaaattttttaaatttattttttattatactttaagttctgggatacatgtgcagaaaatgcaggtttgttacataggtacacatgtgccatggtggtttgctgcacccatcaacctgtcatctgcattagatatttctcctaatgctatacctccctccccttgccgccccccacccaacaggccccatgtgtgttgttcccctccctgtgcccatatgttctcattgtcagctcccacttatgaatgagaacatttggtgtttggttttctgttcctgtgttaatttgctgagaatgatggtttccagcttcacccatgcccctgtaaaggacatgaactcattcatttttttatggctgcatagtattccatggtgtatatgtgccacattttctttatccagtctaacgttgatgggcatttgggttggttccaagtctttgctattgtgaatagtgctgcagtaaacatatgtgtgcatgtgtctttatagtagcatgatttataatcctttgggtatatacccagtaatgggatcgctgggtcaaatggtatttctagttctagatccttgaggaatcaccacattgtcttccacaatggttgaactaatttacactcccaccaacagtgtaaaagcgttcctatttctccatatcctctccagcatctgttgtttcctgactttttaaggatcgccattctaactggcatgagattttgtggttttgatttgtatttctctaatgaccagcgatgatgagctttttttcttatgtttattggccacataaatgtcttcttttgaaaagtgtctgttcgtatcctttgcccactttttcatggggttatttgtctttttctggtaaatttgtttaagttccttgtagattctggttattaagcctttgtcagatggatagattgcaaaaattttttcccattctgtaggttgcctgttcactctgatgatagtttcttttgctatgcaagaagctctttagtttaattagaacccatttgtcaattttggcttttgttgcaattgcttttggtgttttagtcatgaagtctttgcccatgcctatgtcctgaatggtattggctaggttttcttctaggagtaaacccattttgtaacttaatcatctccagatttgctctggagattccttcctgaagtcttcttgacagtttctctagttgtctgattttccatctacctgactattttggaagaaagtggctggcacagggcaaaagataagcaaactaggaatgtaaaacatgttttatttcttccttctctcttttctcaaagaatttgaggtaggctacaaaaatatatacaaataggctgggtgtagtggctcacacctgtaatcccagcactttgggaggctgagatacgaggatcacttgaggccaggagttcatggccagcctgggcaatataatgagaccctgtctctacaaaaaaaatacaaaaatttgccaggcgtagtggcacgtgcctgtagtcctagctagttgagaggttgaggtgggaagattgcttgagcccaggagttcaaggctcaagttttgaggcagagagctaggattgcaccactgcactccagcctgggtgaaggagcgagaccctgtctcaaaaacaaaacaaaatccatatatatatttgatatatatatgcacacacacacatatacacaagtataaagtaataagctgatgaataagtgaggagggacatgggtggacaaatacagaacaggataagatttggtgcaaagaaatgggatgcctgcagttttaacagttcattaaggtgattagaaaacttgaccccatgctggccagcagccagagaatggagagaagccacactatcaggcttcaagtgcttaaggcaggaggttttgctaataagatctgctgtgtgaagtttttccagatattttgggtgatttcatgtgaacccacctgaaggtggaggtggtttttttaagggtataagttttggtaaccttttttttttctttctgttttgagacagggtttcctcactctgttgctcaggctgcagtgcagtggcatgatctcggctcacttcagtctcaatctcccagggttaggtgatcctcccacctcagcctcctaggtagctgggaccaaagctggaatctaaacaatcattgtaattggccaggcgcggtggctcttccccataatcccagcaatttgggaggccaagatgggaggatcatttgagcccaggagttcaagaccagtctgagtaacaaagcaagacccccgtctctacaaaaaataaaattagccagccatagtagtgtgcatctgtagtgccagctacttgggaggctgaggtgggagaatcccttgaatctgggagattgaggctgcagtgagccatgatcacaccactgccctctagcctggacaacagatgaagaccctatctcaaaaaaaatatatatgtattgtagggccaggcatggtggctcatgcctgtaatcccagcacttttgggaggccaagccaggcagatcacttgaggccaggagctcgagaccagcccagccaacatgcagaaactctgtctctactaaaaatacaaaaattagccaggcgtggtggcacatgcctgtaatctcagctacttggggggctgaggtatgagaatcatttgaacccagtaggcagaggttgcactgagccacgatcaagccactacactccagcctgggcaacagagcgagactctgtctcaaaaaaaaattaaattataaatgtactgttagacttgttaatgtaaaattaattctggtatctcatggaaatgtgtcaaatgctagcatacatgggcgtgcttattacttaggacaatccagtgaattgtgaggtgttatgagaggaagtttctacttaacacttctcatttaattaaatatgaacatgatgtgtgactgacaagatttttttgtacaaagtcataatatgatacctgatttgtttaaatcttatttgcttaaattgaaattatatttatcagttacttaaaatgtattaggacctagtaggatacaacagaattgcctaataaaaatagtctagaccagtgttctgtaaacttttttgatcataagacattttttggattaaatgatttgatagaagtggtacacatgttataaagtattttggcaaaataatagtttcacagagtaattatttgatgaaataaaattatttaaaatgtttaatgtggctaggcgcagtggttcatgcttgtaatcccaacactttgggaggttgaggcgagcagatcacctgaggccaggagttcaagaccgcctggtcaacatgatgaaaccccgtctttactaaaaatacaaaaatatgctggcgtggtggcacatgcctgtaatccgagctactcaggaggctgaggcaggagaattgcttgaacctaggagacagaggttgcagtgagccgagatcgtgccattgcactccagcctgggcgacaagagaaactctgtctcaatcaatcagtcaatcagtgttttaacatgtctgttctacatagcagaaatatccataaaatcacaaatatgttaaaattataaaactgtagtaacacataccagcaataatcaaaatacaatggttggtcagtgatgcttgtttctgctttgctgcaaacatcatgcactcatgcatcagtgatttctccaagaaattcctgatatttgggggcgtggcataccttttttttttttttttttgagatggagtctcgctctattgcccctgctggagtgcagtggcgtgatcttggctcactgcaagctctgcctcccgggttcacgccattctcctgcctcagcctccccgagtagctgggactataggcgcccgccaccacacccggctaattttttgtatttttagtagagacagggtttcattgtgttagtcaggatggtctcaatctcctgaccttgtgatccgcccagctcagcctcccaaagtgctgggattacagacgtgagccaccacgcccggcctggcataacatttttaaaagcaaaacagaatgtgataagagcagttacctaaatctatttaatttacctttttttccccaaatatattttaggaaaaattgttgttggtaatgattttggttacagaacagatgtatttataagtactagtgttccggagaacactgggaaattttaatcttttgctgattagtacctgattattcttggtttctagctcccagatggacgtatcatcaaagttgggggagagagatttgaagcaccagaagctttatttcagcctcacttgatcaatgttgaaggagttggtgttgctgaattgctttttaacacaattcaggcagctgacattgataccaggtacattagaaatggtgatttcaaagttatttatcagaaaaatcataaaaatagttttaaagttatttatcagaaatagatggaattaaatagaatgactaagtttataaacttacttgaaataatttcagacttacggaaaggttgcaagaaaaatgcagaaaacttatctgtatcctttatctggatttaccattttactaattctaatgttcttcatgtttgctttttcattctgttttttctgaaccgtttgagggtagattaaatgcatcaattctttactagttggtgtttcctaaggataaagatactctcttacatagtcatgctgatttcagatcctttggagatacacccagtagtggaattgctggatcatatggtagttctatttttaactttccgaggaacctccatactgttttctgtaatagctgtactaattcacactcccaccagcagtgtacaagggtttccttttctccacatcctcgccagtattcgttacctttcctctttttgataatagccattccaacagatgtgaagtgatatctcattgtggtttaatttgcatttatttccctgatgattagggatgcttagcattttttccatttgtatgtcttttgagaaatgtctattcaggtcctttgcccatttattaattgggttatttgctttcttgctattgagtcatttgagatttgagttccttacatattttggatattaaccacttatcagatgtctgatttgcaaatatattctcgcattctataggttatatcttcactttgttgattaattcctttgctgtgcagaaacttcttttgttgttgtttgttttttgagacggaatgtcactctctcacccaggctgaagtgtagtggtgcaatcttggctcactgcaacctctgcctcccgttttcaagcgattctcctgcctcagcctcccaagtagctgagattacaggcatgtaccaccatgcccagaatttttttttttttttttgtattttttagtagagatggggttttgccgtattgaccaggctggtctcgaactcctggcctcaagtgatccaccccacctcagcctaccaaagtgctgagagaaacttcttagtttgatgtaaatgcatgtatttttgttagatattgccaaatttccctctctggcaattgtatcgtttatccttttccaccaatctgatgagtgagaaattatttcagtgtaattttactttttatttctgtcattaagagtgaagtcaaaccaggggtggtggcttctggctgtaatcgcagcactttggaggctgaggtgggaggtttgcttaagcctaggagtttaagaccagcctgggcaacatatggagatcctgtctttacataaatttttttcaaaaagattagccaggtatggtggtggtgtactcctgtagtcctagctactcagaaggctgaagtgggaggattgcttgagcttgagaggtagaggctgcagtgagccatgattgtgtcactgcactccagcctgggtgacagagtgagaccctgtctctccccaccgccacaaaagaaagttcctaaaaaaaaaacatatatatatatataaaacatatttttatatgtttaagggacttgtttgtttgtttgagatagagtcttgctctgtcgccaggctggagtgcagtggtgcagtctcggctcactgcaacctgggtggagtgattctcctgcctcagcctcccaagtagctggaattgcagacgtgagccaccacgcccagccttaagggacattttaaatttttttttttggcaaattgttaatggctttttgtagattttggagttttgggttttttttttttttcagttttgaaaagttttcttttagctttctgatatctttcacagatactctgtttgccatttgtctattgctcttagtgttttggccatgcaaaagtttgtttttatttagtcatataaaaagatttatagtcttattacatctagagcttgagtcatagttagaaatcccttctctacactcaggttatagaggaattcacccagaagcattttgtacagcaagcatttatttgtgtaaccctgagttaaatagccacctaattaattttgatgggatggctttggagccaggatagtaatagaaattaataaaaatagcaattgactcataacaagctataaacctggtagaagatgatcagaaatcgaatctagccttcataattatggtaaattctcatgatagggattagggagatgattttgttctttgatgttcattcacagcaaaattgtatttaaaagtacatgccagctgggcgcggtggctcacgcctgtaatcccagcactttgggaggctgaggccggtgaatcacgaggccggcgaatcacgaggtcaggagttcaagaccagtctggccaaaatggtgaaaccccgtctctactaaaaatacaaaaaattagctgggtgtggtgacgggtgcctgtaatcccagctactcgggaggctgaggcaggagaatggcgtgaacctgggaggcggaggttgcagtgagccgagatcgcaccactgctctccagcctgggtgacagagtgagactctgtattaaaaaataaaaaaagaaaagtacatgcctgttgctgattagagcttcgacgtacctaaagtgcggagtcagattcagtaccttctccacagagtttgcattgcaaagtggaacaactcaaattttgttttgtgtgttctgcatgttgaaaatgtacatgtaaatgcttgtgagtacttatcacatgaatctgtatttcaactgcttagtttatgcgacattcactgggcttgctatggcaattaaatacaaaagcaatgctttgttagagttgcagtagctttagccattgagaacctggaagccaggttgaaaaaggccaaaatgggtgcaaatcagctcccaaactttactgtgagaattattcctcagaccctcgctcagattctgttacttttactacatatgcagtctttttagattggattttctgatctcatagatatcagaatagagggtactgctgtcagtagatagcagggtactgtatcagaaaagagggtactgctataagaagcatacacatcagtctagccaaaaataacagcagacagcctctaagcaaaggaacaaaaaagaaaactacaaaagataaatgaaaaattaaaaagcaggaattctggattaaagtagaatagggctaattatagtaaacaaccacatcttagtggctttagggaagcatgtgataaaatagtttgtaatgtaaatcttggtcattattagaagtctcagttatattcacaaaaaagtgtattatatacttttagaagtattttattttcatcaaaattatgaaaagattttatatgtaaagaggggtcgttacttcacagtagtaataacagcaaatattcagccctgtgatttacatgtggaattttatttaattctcccagcaaccccgaggctgacataagtaacagtaaccctgagataccattttcctaacctaaaactccaaatgaataaccattgtgcctttctagatctgaattctacaaacacattgtgctttctggagggtctactatgtatcctggcctgccatcacggttggaacgagaacttaaacagctttacttagaacgagttttgaagggtgatgtggaaaaactttctgtaagtattagtaaatcaactattactaacattcttttaaaaggctatacagtagtttgtgaatcttgacaaccaccagagggagcaagacgtcttccaaaacaaattcctactgcagtcaagtgcatcctggaaatgatagcaagaaggaaatagttcaagataagctctggtcacctctatagagttggtggatggaggcagtgaggtcagggccaaaagttctggttcatctgtaacaaccagcacggactctgaggcacctgtatatgcatgagaagaacctgctgtactatagggaaataaatgccccacttgagttttgttctttttttaaacttattttttggatatgcaatcagccttcagcacttctcttgggctatctcatatttctgactttatttgttgcatatgttgtcttctcagtcagattgaaaaacatcatgtctcaaaattttttgcattccggtgactgtcataactcttgaaacagactttaattggttgttgttggtatgtacagtagaaagaaatttttaaactagaaatagttgatgtttctttggcataggtttttgtgttttttccaccagactctggactatgtgaagtatacagtatgtgctgtatacttaaccaagagttatctaatcctgagttaatctctgagctttgtctcactgactttgatcaactgttttagataatgagattatgtattacagagtactgtatgttacatctttcatatatgactcattgttgaaattaaattgagtatgggctcacatacattaaacagattaacagactggaaaggagccatactgtctaagtacttcacttatttttctgattttattgagttttacatataatttataattaatctcaggtgatcatttattcagcaaacatttcttgaactcctgggtgccagacataggtctaggtgccggggacaaacaaaacaatgaaaacagaatccctgcttttagtctaaataatgtattagtggtaataagtgatatgaagaaaagtaaggtgaagagctggaaaatgttagtggttggggaggtagtgtgctccttcataaactgtgatcaggaaaggccttttggatgaagtgacttttgatcagagacctaagttgagcgtgagaggagtgagccttgtgactgtctgggggaagaatcttccaggcaggaaaaatgcaaaagccccaggttggtgggagtgtgccagtgtggctggagcagagtgagcaagggaggggggcaggtgggatatgaggtcagaagggtagcaggagggcaggtcttgttcagccatggtaaagggtttggcttgactcctggtgaaatggaaagtcttgggtgtgggggcggtttaagcagagaaatgataggatctgatgtatatttttaaaggatcattaagtctggtgtggtgaatagactcttgggggaagagggaacaaaggtgggcatagagagaccagttaggaggcactgagaggaggggagggatggtagagttttagaatagaggaggaggttgaaatggttgttttggagaatggaagcgagaatagagaaatgtaataggattgccatgcagcaggaagggctcagttgaggttagtgatacattatagcaagatgttttgtttctttcctatcttgttcagctgcttgacagcaggtgcaatttgtctgtaggaatctgtagatgagttcagcaaggagggagtggtagatggaatgatctgatagaatgagtttcagtggggctatggagttttagggatgagcgagatagaagcagcaatgaagagcaataactcatattaccaaacctccagggttaaggtagtgtgtgagagagaaacagtaaagcagttgaggtatttacagaagcagtgtcttcaggggctagctaagtttcccttagagtagaggtggtcatctatagcccttatgccaaaactggtttgtttgttttttttaagttttattggaacacagccaagcccatttgtttacataatgttacctgttgtcacatattgtctgtgggcaccttctagctacatgtggggttgggtacttgtcacgcctacaaagcctcaagtatctggcccttcacaaaaaaagtttgctgacccctatgtaagagcaagaaagtaaaaggaacaattaaaacagtctcagaattggtaaataaactgatgtttttctttatcttggattgttagaacccttacagttcatttatgtgacataaatatacaaatgatttagaatgacatagttacattgggtcttttttgcagatcgtgatactgtaaatgaaaaacttgctatgtcattttaaggtttctctttcaggtgttgaccaaccataaagataaggatgtgtccttcctagacacttaatagtagctacagagtataaaacttttcccaattgcctttaattttggttactgtgttcattttctcataacatcctgatgatttgttttgaccatatttggccttgtttattttaagaacatttcatttgattttgagacaatagaaagtaagctttgcttaaaagaaaagaacttcagttttactctattgccctggactagaatcataacagtatgagaccttgaagaagtcatgcaagtcctcttttttttttttttttttttttttttttgagattgagtctctgggctcactgcaagctccacctcccaggtttacgccattctcctgcctcagcctcccgagtagctgggactacaggcacccactaccatgcccggctaatttttttgtatttttagtagagacggggtttcactgtgttagccaggatggtctcgatctcctgacctcgtgatccgcccgccttggcctcccaaagtgctgggattacacttgagccaccacacccagccatgcaagtcctcttatccagactttgcttgacagcaaagtgactttcccaagtggtcatctgccattggatgggaaatttgctctaattatgtcttggatgtttggtctctcagtagggtgttaagtcatgtaatttactgatcaaattaggacactcaagaatggaaagggtggtattaataatgatgggacaccacgtgtaaatcaggactgttccaagcatgctgggatggatgtgtggtctcctaaacatgagctttgggcaaattactaaatgtttctgtacctcaggtaccaaatcctaccgttctacttatattacaggactgttgcaagtttgagggagagcatatatttaaaaagccattttcataaagcagaaagcactgtgcacatgtaccatttcattatcctttctttctcctttagaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccatcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctgtaggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcaaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgtttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcattttaaaacttttttttaactaataatggctttgaaagaagaggcttaatttgggggtggtaactaaaatcaaaagaaatgattgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggacatgcctcagaaccatgaatagcccgtactagatcttgggaacatggatcttagagtcactttggaataagttcttatataaatacccccagccttttgagaacggggcttgttaaaggacgcgtatgtagggcccgtacctactggcagttgggttcagggaaatgggattgacttggccttcaggctcctttggtcataattttaaaatatgggagtagaaaacaacaaagaatggaatggactcttaaaacaatgaaagagcatttatcgtttgtcccttgaatgtagaatttgtttttgatttcataattctgctggtaaatgtgacagttaaaatggtgcattatgtatatatattataatttagaaataccattttataattttactattccagggtgacataatgcatttaaatttgggatttgggtggagtattatgtttaactggagttgtcaagtatgagtccctcaggaaaaaaaaaaaattctgttttaaaaagcaatctgattcttagctcttgaaactattgctacttaaatttccaataattaaaaatttaaaatttttaaattagaattgccaatacttctacatttgagaagggtttttttagaaatacatttagtaaagtccccaagacattagtcttacatttaaacttttttctttaaaacatggttttggtggttaacttttacacagttctgagtactgttaatatctggaaagtatcttgagatatcagtggaaagctaaacagtctaaattaacatgaaatacttcattttgattgagaaaataaaatcagattttttcaaagtcaatttgaattttgtcatttctttctaatagttatttcttgtttcattttcttgttaatgcaagatgaattgacagtttatgctagttgttaggtcaagttcatgtcagtgttctattattgacaaaacaactcattatttctggtatgattttataaatacataagaaaatagaatagcgatttatagctacatcagaggctgttttcttccaacaaactgttttgtctcccaaaagattaaggtggctttcacagaattagaaatgctaaagagacctgtatgtaacatgccccctttcaaggacatattagctcatctgcagacttttaggcatattatttttaacaaataaaagaaggatgaaaatacatttaactgaccttttcttgttttatactagccttgaggatgagggctggagagtagagagagtatttttgcctttccttcttcgtggacttgtatgtgcaaacctcattgcccgcttcagggccggagtcccagacagcgaacgtaagggttgtctctggtgttttatctagtttcttctgagttgcggaagaagaatatgataacagctatctccatatgtaatggaggaagaaaataccaggcactgcatagtgcctttgatggaatgaatgtctctcagtgcacttcatttttttcctccacccacaaactttgaccattatacaattgagtgagtttattaactgtattaattttagaaccatcaaagagggtagccaactaaagtgaaccagaaactcgaggattaatctaaactcgattttttctttcttttgagacggagtttcactcttgttgcccagctggagtgcaatggagcgatcttggctcaccgcagcctccacctcccgggttcaagcgattctcctgcctca

SEQ ID NO: 12527 - DNA, 12180 bp, Human
  misc_feature (1)...(12180): n = A,T,C or G
cagctacttggaaggctgaggcaggaggatagcttgagcctgggaggtggaggttgcagtgagctgatatcaggcaactgcactccagcttgggcaacaaggtgagaccctgtctcaaaaaaacaaaacaaaacaaaatatatatatatatatatatatatatatatatatatagagagagagagagagagagagagagagagagagagagagagagagtcatgctttgatgtatttatgcattaaaatgccaaggataactttctttaaatcaaaaagcactaaattttgttatgctgtcagcccaccctcatgtagacatagcttagtttttacatagataagacccctctataagaagagtttaatataaagagggtgtgttccccctcttgctttctgaggatggcctactctgtaactgagtagctttcaataaacaatcgcttctcactgcactctgcaacttgccttgaatttcttctgggcaagatccaataaccctcccttggggtctggatcgggaccccttttccagcaacaatattgtttcttgaactcggtggttatgcaagtgtgtccacattttaatcattcattgaaatgtacatgtacacttgtgatttctgcacacccgcttcaattttacaaattttatgctcacaacccattgggagaggtatatatacagggaaataactatggatccgtttggtaaacaaatgtagaactcaactatcttgcactcttgaagcagctgactccagtgccgcagggggctacctgcatgccaattccacacccaataatcttgggcaggttaccaaagtgtgaagaccctgactgaaaaatgggagtaataatacaactacctgatattgttgcaaggatttaatataacttatgtaaagtgggcagaagtgctccgcaggcacagagcaggtgctcaataaatgccaggaccaaaataccacgaaactgtaatttttataaggaaaaggatcttttcttcagtgctcaacgaggaaatattatggggccgtgcgcaatagctgacgcctgtaatcccaacgctttggaaagactaagcgggaggatcgcttaagctcaggagttcgaggctagcccggggaacatagcgagatcccttctctacaaaaaaaattttttttaattagctagcgttgcgcggtggccgtatggtggccaatgaggtttatccgaagcgcgattattgctaattgaaaacttttcgcaataccccaccgtgacgacttgcaatatagtcgacatcggcaatttttaacagtctctacggagactatttcagtaaaaataaataaatatggtgcgcgcctgtagtcccccctactggctggcgcgggaggatcgcttgagcccaagatttccagcctgagcgacagagcaagacaccttacctagaaaaaaagaaaaaataaatattttgggtgaaatatccagggccggcctccttggagagggcgctctcacgaaggagcgtggcccgaggtgctgggacgcgggaaagacgtctttctggaccggtgctgggacgcgggaaagacgtcttcctggaccggtgaatttccagctccacagactccggccgcgcgcacaccagcccagctccactttctgccgcccgcgtcccctttaagacggagccatgacatcatcccagacactgcgcagcctaccttggcaacgccgcgaccacttttttccggacgacctcaattggctggccagctccggagccccgccccttcgcgcagcagccccgggcacctgctgtcaatcgggccaggtgggagcgatgattggccgccggccggccctccagaaagcccgcggctcgcgtaggctgcaggctcggggagggagggcagcgcgccgcgtcggagccgcgccgtcccgtcctccgcccgccgcccatcggtgcctctgcagcacgctgctgggaggccggcgcgcgcatctggagtcctacgacatcatcgccagcacctgtggtatgacacgtgaggcccgcagcagggggaggcggcgctgctcggggagcacggacggcgagggagagaccacgcagcctcggcgttctcgctcatggtgacgtcgcccgcgggcgatggttggnnnnnnnnnnnnnnnnnnnnaatgtagtgcatcggctctcgttgtgatctgtcttctctccgtcttctcttctctccggccatccggtgcttcttgcagtctcgctgttcgctccagcgtgcgctctgccatgagtcctactacttcatgtccaaccagcctgtggtcatcgacaacgtgaggccgtcagccagctgtcgatgtcggcgactgccctgggtagcatcgtgcggcgcagtgagagacctctcgccgcctcggcgcgtcctctgcttactgcgtgtccgtcgctccgccgggcacgcatgcctgcaccggggcgcgcgccctcttgccttgtaaggccggccactggcgagccccctcgcccgcgtcgcagagcctcttccccgacccctccccgagtcgggcggggaagttcaggagagcttgagtgacagccgggcggccgggcgggacgcgccccggactcttctcagttgagagtgcggttcctgggcaggtttccacaccagttcctttccgcgtccttcggccctggctctggctgcctggcggaggtggggtagcatttgtcatttgcacactgctggctttatctttggggctgcaccccgaggcaacaaatgcaggatgctctgtcacccacatgtccaccaccatctggtttgccttttggctactttgactttctccttaaatgcttcctgtgctgagcaaacattccacagccagcagagcaatggagagttcatggccactcttcccagtatcagcaagcaatttggggtgatcgtttggaagcctcagaggaaagatgtcatcaggcttcctgtggctttgtccttcagcagtggggctcggcttgctttcacctgccttaggaagatttctggcttccgagctctgatatggggagaagataagggctgggatctttgagtctgcccctagctgggtatgtgcgtccggtgtgcgggccttggagtttttggtaatgactcacttgtgctctttctgggatctgtctccctcccacatgaccccgtggggtccctgaatgactgttttagagtacccatgtgggttccctgagtcacagcaggggatgtttaataaggaggttagcactgagcttggggacgtgctgtcacaccagcaggacgctgcaggaaggagcaggctacttcctttcttgacgtgcaaataactcgtataggctaatcaacaggcttataagttaaaagggctaccgctcggccccttggggattccatcccctcctctgtaacttggagatgtttgtttctgctgcagactcagagggttgcgatgaagagtggtgggactgagttgagaagcttatcccttcgctgggtgggaggtttctaattgccccgttctttgggggatccttaagtccagcttccaggtgggggcagcgataggaccaagttctcctagtagtctctgggaagccacttgagggaagctgccggtcatcccatgcacccattggtcttctccagcaggccctgtaggtcgtccatgttccatgccttctgggttcttgggggagaaggaagctgttgaaaaaaaaaaaaaaagacccacacagaggggtttcttctagcttttgggagtagcatgtgctatggaatcctgctggagccaaccattagttgtgcagaggaaggtgcccttcgtggtttctctatctctatattattgacattctgggctagctccttgttggtagtgcaggctcgcctgtgcatcgtaggatgttgagcagcatccttggcctctgcccactagatgccaatagcatcccccactgcatgtcccctctccccagctgccagacattgccaaatgttgccagagcagggggatacaaaattgcccccaatcttgaaccataggtgtacttgtaaatgatcctggcagggtccctggcttcctccttggcctgccttgacggggcagccagctctctccattgcgggggactggcttcatctggtggtgcatgtgggcagctcaactttgtttttccttgcagggttcgggggtgattaaagctggctttgcaggagaccagattcccaaatactgtttcccaaactagtaagtgtggctcaggcagcagccttagtccttttgtttaccttctgtaagaacattggccttctgtcacagggctctttgaagacaatttgtgccctgacctgtatggaaaacaccaaatttgtgaggttgacactcttgagagagcactgaaagaacaagacaagcgttctagggttcccctttgtcttgggagtctctcgttttggtcttgttgagccagcaaggaggaaaagcaaccagcatttccctggggatggggtgtggtagcagcagcaagaataaagggagacatctccgaggggagccctaaactcggagcaggaagagtgaggaattagatgcacagccaccctttcctccctggaagtgttttctgccgggcttgttttcagactctagaaaatgtcttgtttcagttaagaggggatcctttgccctgtatggtactggtgggggcgggaataagaattgcaaacccagagagcctggggtgccccttgcacccaccacgagcccattgggaaagttgcccttaggagcacctcttcacaaatcctggaggctttggaatgagtggcctaaaggcagcgggcagcaggggatcctaggccccgagtggcaggctagcccgagcccggcctggtctgggacagagctagcatggtgcgccctgtcgagcttcagcattcctttctgactgcatgggtataattagaggttcctttgcctttagtggtagctcatcagatcctatagtttccaagaactgaatctctgatccagaagcgctggcagtggggtagggcgcttgactgagtgagagcagggtgcacaagggagccccgacccagcttcctggggttgtcctccctcagtctgtggatggtgacggcagccctgccccaccgaagtcaggagcgtgggctgagtcactgtggctgcaggaagccgaccctctgcaagggctgggccatggagggctgggttctggcgctcagacatgcagctgtctctgctgaccgtgccttctgaccctgagcttctcgtcctgcctaggccccctctctagccccgaaccccataggccccagttccaacctgtgccccccagccacatcctggtgtttggaggccaggtaccctctgggcgactatggttggatttcggtttttctggacacaagctctgccatgctccctgcccaccttgctgacgttatccgtcctaacagtgtcgggcggccgaagcacatgcgggtgatggctggagccctggagggggacctcttcatcggaccaaaagcagaggtaacaccgaggagcctgcctttccctgggggtggggtcctcagttgcaggaacatggcatgtgttcttgggcctctgctggtgacctcccgggtacctcctccaggctccagctgggaagtgctgtgcaggggcacctccccctgagatggggcagcagttcctcttctagggagcatgggtagagctcatcgtgtcctgtcttttagaagctatttggaagctacagaaccaagaactgatcaaaaagtgatataagagtcagaatcacacacacttcacgtctgctctaatgagggccatggggccgcctctcacagtgaagccggagtgtcccaccaaggggctgcatggcctgatcagaccctcaggagagcatgtgtgggtgtggggagagcagcaagctgagcttggccaagggcagtttaggcgcctgaggagcattgtgtcgggtgccggggcgtggggcatgcgtggttctgggcccagaaaggggaggcctgagctggaggtgcagagggtgggggtctcgcagatggggtccgtaggagccgaggtggtgagaggagctaagtggtgctaggtgagaaggggcatggctggggggacatcgaagggcaggtggaggcagcatgtcagtgcaaacaggggactggtgaggaccggccaaagggctggggggagaggcgtaggtcagggggcacaggtggcccaggaggggccgtgttgggcggctgcaaggtgccggcgctggccagaggggagctggcagagtgtgaggagaatgtgggggatgtgccggcagtgagaatggggaagaagagagcctgcagattgcggggcacactgccaccctctctgatccccccagctgaagctagctgggctctaagagcctaagaagctggtgggcaggtgagcccatgctgagttcaggacccgccacagaccctgggacacccagtgagcaggggtggttctggtcagggcaggtgagggtcagcttccaggagggcggaaagcagccgctgagcaagggccgggtgccacacctcccttcccaccccaccaggagcaccgggggctgctgaccatccgctaccccatggagcacggcgtggtgcgagactggaacgacatggaacgcatctggcagtacgtctactccaaggatcagctgcagaccttctcggaggaggtgtggcggctgcccctcctgcatgctctgcattctcctggccatgcccctctcctctgcgtccctcctcgccgggctcccacatttcccttctacatttctagagggcctgctgcctttccgtgtgtgtctgggtgcgcatacgtacccagtggctgctaggcagaatcttccaaagagagccggatctccggaagagtaactgccagcagataaagggatggggccctcaggaggggtaggaggctgagctgcctgtgcgccagcgggtgtggttctctggaaagagccttttagggccttgcaagttgcctcctctgatgcctacaactgtcccgtccctcgcagcatcctgtgctcctcacggaggccccgctcaacccgagtaagaaccgggagaaggcggcagaggtgttctttgagaccttcaacgtgccggccctgttcatctccatgcaggctgtgctcagtctgtgagtgctccctaagcctggcctccctgagtcctgtcctccctgtgccgtcctgcttgccatgaccagggtctgacttccctggaaaaacagccccttgatgactgttcctctagggagtccctcgtgtcctctcttcagactagataatgcagatgtgccagggttcctcccctgggtgaggaggtccccgtgcctcagtggctgaggtgaggggatgctgacctggtgacaggtacgcaacaggacgcacgacaggagtggttctagactcaggggacggggtcactcatgctgtgcccatctatgagggctttgccatgcctcactccatcatgcgggtggacattgccggccgcgacgtctcccgctacctccgactcctgctgcgcaaggaaggggttgacttccatacctcggctgagtttgaggttgtccggacaatcaaagaggtgacaaggggcgagagggtgtggacacgacctggggtgaggaaagggtggcaccaaggcacaggtgtcccaggtgcagccttctgagggctgtgtccctgtccccgcagcgagcgtgctacctgtccatcaacccacagaaggatgaggctctggagacggagaaggtgcagtacacgttgccagacggcagcacgcttgatgtaagtggccgggcctggcactggagtggcagccgatgcccagcctgggggaaggggtagcccgcttctccaggaagcctgtctgcctcaatcttgtacactaaaggtggggcctgcacgattccgggcccccgagctgctgttccagccggaccttgtgggggatgagagtgaggggctccatgaggtggtggccttcgccatacacaagtccgacatggacctgcgccggacgctgttcgccaacatcgtgctctcaggtggctcaacgcttttcaaaggtactgtggcttgagagttggtggtggtgagacgaggcccagggcagctggaccctcagagagtatacccctacccagagccatattctgttggctttttggtggtgctcaatgaacattttttttaacagaccaaaatttaaaattaaattttgtttactctgtgaatagaggagaagtttacacaagctctaaagtgtattgtgagagtcgagcaaggagcatgtgcggcttcatctcacgctgcctctgtgaggacgcagggcccgcaggcagccatggggctggatcatttctcagccttgcccttcatcctgggaagagctgctgatagaggaccagcagtagctgggggccctgaaggctgggtgcgggagctagcagcgaggaggccgggtgcagaccccaggctcagccagctttgtgttcacaggcttcggagaccgattactcagtgaagtgaagaagcttgccccaaaggatatcaaaatcaaggtgaggttacagaaactccccctggggcactagggcgctggcagccttggcatggggaggaaggttgaatgctgcccccagacccgctcaccagctcacgtccacctagtcctgttcttcccaaggctgctgctgccactccccagcttatgcctttgctgtcaggcttcaggacctggggaaggtgaccccaaggctgggaggatggcttctgggtggggatccacagttaacgtggccacttcctccctctagatctcagccccgcaggaacggctgtactccacatggattgggtgaggcggggctcaagggagggctctgggaggagaccactttaccctggatgctcctcccattgttggcctaggccacgtggaggtgggtggatttccctcccaaattagggaaatgcaactctgagcacccaggaaggtggttggctccctgacaggtccacagcaatactatccctccatccccacagcggctccatcctggcctcgctggacacttttaagaagatgtgggtgtccaaaaaggagtatgaagaggatggctcccgtgctattcatcgcaaaactttctagtgcccaaggagggcggggcatgttgggagaaggggagggaggggagacagagcctttaaccctttttggtcttggctcgtatactaggcttagggtcccctgcatgccctgaacccctgggtgggtggcacagcagtgcccccctgcagccttcccctctacacaggacatgcacacacaagtaacattgagctgcatggacaggagccttgagctggcgtgtgggaattgagcgccatgtcaggctgttgtgggtatccccctggcagggccagctaggcctgtggttccctgctccgactctcagggctgcctccctgagctccagggccagaatgcctggatgcctgggtagccagtttggggagtgggctgcaaggggcagccagcagctcccactggtgtgtcactgcatccattgccacctcctgttcgtgacctgacagggtgacacagcccctttcacactctgtcctcctatcttcctgggtagatgccctggtgtagggctgagtactgaatggtcttccatccccagcaagggggtgcagcccagggtcaggcccttcagagccagggcagaggacgcacggtggctagagccgctgcactatccttttcagagcacttcatccacttgctcctccctctaccctcggcaccctgggtgggaaagggttgatgctcatcatttattgaggggaagccacttaataaggagtcagacctaaaagggggtgggggacattttcttacctcacccaagaaagaggtcgtcacttttgctgtggccagggccccacctccctctctcagatatgtacaataatttaacacggttgcctgaaaaaaacttttgtaaatcattatagtaataattatggacaaggcccagtgtgtggctctgttttcttgtggctctctgtgctatcgtttgttcttccatccctggggactttcagagaaaggaccagagagaatgcagcaaggcactggctctagcttagcggcatgaaggtttcagtggttggcccgccaacgtggcacaaaaagcctcaggaggctgggctctcaccctgtagcataattccctcgcctgttacctcccctgctgcagtccaccaggggaagtagaaccaggctaccttctttgcccccggaccctggacaggcctatttgagcacctctgctcaccccattcagccagggctaaggctggtggacaccagcaatgatgcaagctcacgccttcagacaagtcaggatggggaaggcagggagaggcagagaggctgtgagcttagccaggccctagaggaataggcagaagagcagtgaggaattagggtttggagaatgtctgctctttacttccttaagtgtttgagaacctacagtgtttccaggatggtgccgtgtgtttggggccaatggtcaacaagttatatccttgccctaacaaatacacacgtcaagggagtaagacagatgagccattttagtacagagttgtgggggccgaggcgttagtcatctggcccgacaggtggggcaggccgacttgcaaggatccagaggttatccagggatggggaaggcattctatgcagatgtgagagcccaaagaagcacctgggaccagtgggtctggagaggaaggcagggacccaatgcccagtcagcagggaaaggtcagtggtctgtggtcattgtgtgagatgaacaaaaaaggtgggttgagctggcacatggaggattgttagctgtgtcctgggagatgggtggccagccatagaaagatggtgaccagagcagtgtgttgtaggcagttggggtttgtggggggtgagggcagccccaggactgaggagatgaggtaggagtgaggagagtactgaggcctgtctgccaaggcgttttgtgaggctttgtggtcacaaggcagttatgcttgcactggccctcaaagggaaagcagaatttgcacggagaactccatattagggcaccctccagaccagttcttcccacagtgctctgttcatggcaccactggctccctgcctcccaggttagagccttatccatcgacgctttcctcttccctgtctctcccactctgtcagtcaccaggttgtgtggttcttctgtagtacctttcccactggtccgttcttttccagcacagccactgccaccatagctatgaccacagctccattccctggccacccaatctatttgctcgtggatctaaagcccagataagattggttctgacacctcctactccaaagtgtcaagtggttctccactgcctcgtgacatgaaacaattgatgtgatgctggtaaaaccacctacgtgagccacatgttgtgtttgactcaggccccttgagatctgttccttccctgttttaggtttacccctcacgtcctttgcctgctagccttcaggcatgctgttctctccatgggaatgaccttcgcttgtgcctgtgaaaatcttgtcctttaaggcaaagcaccatcctctgtaccccctcttctggcaggtttaagtgctcagactctgccagcttcttactgttggaaaaagctacagatgaggaaggtagtacagctggaatgaagcctgtgttggattggagttggaggtagtatgaagtcatggttttaatatacatacagatagataccaaaataaacacatctgtgtgtgagagccagcatcagaacatacacatgcatttcctagccctgtctgttgggaaggtctggaagcaatgacactacaatagcaatgagcacatacagtgtccagatcttggtttctaaataccattctgggaaaaagttctttattctgtacttgtaaatagtttaat

SEQ ID NO: 12528 - DNA, 76810 bp, Human
  misc_feature (1)...(76810): n = A,T,C or G
agggcgcactctagggtcagctaggcttccttggtcatttcagtagctgaggacatttgaggaaaatgacacaactctgccaagagtgaccatatgtttctacgcgtgattccctccctttatgacatcttgctgtggttctttgagctctctttctggcatgaaaactgtttcactgccttgggatttccaaccagatagagagtccctatcattcacacaagaatgaaggaacacacaagcagaatggagggagcagacataccagatgatacacaaaggagccaggaccaaaggcaaggaaactgaccgatacctgagactccttccttcccactgccttaaagtaaactcatttatcctgtacccaactgcacacttaaaaggctcactgaaaaccagcaagacctcctggaggctgccatggaaaaaaactgatttggagaaactctgtgaatgcactgttttggcattcacaaggaaagttagctaatggtgttttgtatattcttgtgagaaatgttaatggatttacttgcaaaaagcgatttattccttttccctgtcttctccctttcacatttacccacaaaagcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcggtatgtatgcaaggggcaggagaaaaatcttccctgggatatttctgaaaataagatgataattcaacagcccatccgcttcataaccttagaggccccctcaagtcgtggcaggctttcctgccagacatcatagagtctgaaaaaatcagtaccatctgaattcctttgattgtgactcctgtgcttctcccatctctcttcttccatgcccccgccccataccatcccaccactcactcaagttaccatactgtgggcacacatcacacacacacacacacacacactctctctctctctctctctctctctctgtctctctcattctaccctcatacccctgataatcctcatacccctgataatcattaggcttcaacaactctttttaaaatcttcctcaaaaaaaaaaaggggggggggtgcgggggcggggagaggatatgtcctctcagagtttgaattcattctggggtaagctttgaatggctctgggaaatcccaaaatagattctactgccctagcccagaacatacctaaatccttgaagtggtcctggcccagaagtcactgtgattctagagataagctgtgctgacccaaaacctttcaactggggcaactaagcagagtcaaagggagagagatttcagttgatcatcaggtacagaaagagtacaggttcatcctttcctcactgcaatccatatgtgatcccaaagaatattagttctatgcaagagaacttgtcaacatgtcagatgccaacagaccctcactggctaatgtgctttcctgagaaatgaaacccttattccacttagcccctacccctaccaacagatacagtcttcacctccgtgctaaaaatagtgaccacctagttgctgggtccatttattaaaatgaccagtattctcctggtgaggggatggaggcccagagggctgacttgaacaaggtcgacacagctgattacagtcaaagctggggctaggactacatgcctctctcagtcactcagcaccaatttgttgagctcagttgtgtctggaaggagacctgcaaatcaggttacaaaggttattttacattttcattcataatattgacagcccttctgttttcacgcagctgtttggtcactcagccaggaagctcccagcttccatttggaaataacttctccaagcattaactctccattctctgcacccctcagtaccccagacccaaattgaaaagctctgcctcaggagttcccatttggcagtgcctccccgtcacagggaaggacagcagtcagagctgagccactgaaaaaagccatttatcacacaggaaatctgagctctgcaggggtcaaactggcaggctgcttggtcaggcctgcaggatgtctgcttgatgccaatgctcacatcagtggaggcagaagtgaaaaatcagtgcagaacgaggaatcccagccagtgtccccaggggttgaacagtgttctatttgcaagtgaaaacatcagtttcaaccttcatttcttttgagtggcttggtcccttcatagaagactatctcagggtttttttgtttttcctgtacagtgctaaacagttttaccaaacacaagttttctctccaacatgaggttggagggaaatttatctgtgctgtgaattgaaaggcatttgatatcttctgtttattacaaaactttaggggtagtgaggatgttactgggataattgttttaaaaaaacaagtggatttaaagttatatttatagtgggaggggggtattaaatgtattcactggaatatattaattgaatgaatatattcaaaatatatgcaatgagttgtggctactttcttttagaaccagtaagatgtttgctttatatatctctcttaaggagcgattttggtcctactcataggttttccacccatcagcagccatatagcacagtaaaatggggctcagttaatttgcagctattttatttgggttgtgacttctcatctatatatttactacttaggcagaactaaggtgtactgtagtaataaccccccacccacccacctcctgtacaatctcagtggcttaattaagcaaaagtttatttttcactcacactgcatgtctaacatgggtcagcagaggctgatcagagttccccaggaacccagatgatggaggcttcatcttgccaggaatttccaagatctctgcagcagtaggaaggcaacatggcagaccactcactggctcttacatctttgcctccaaagttacatcgcttccactcaacattctgctggctgaaccatgtcatatggtcacaccttctttcaaagggaagagttgagaagggaagagttggaaataattggggaaaagcaccaaagacttccataggaaagttgaagagaaacagactgtgatttgagcagagggattctttgtgacagggacacaatagctacaaacatcacttagactagatcttcaggggacatttccagttttacacatgttgtttcattgccaactgtagtcaatgctattgtcaacttgggaaaccatgatcagcaaacatatagctaaccaaatttttaagtactccatttgcctctgctccagttggtgagtagaaggaaatacaaacaggcttgtattagcataaggttcataactactccattagcgcaaccttacatatatgtaacactttaaaaagttaaagctttcacacattatcttctttgatcttcataacaattctatgtcctagatagggcagattttatgatcacatttttaaggtaagaaaacagctggggagagagagatttgtttttgtcaggggaattaccttttattcccttaaccttagcagcaatactgatctttattctgtactgtattctttagaatttagaatagtcagtaacaatatctactgaaatacagcatttggattaactaatgtgtctacacatccacttattcctaataactttcgatgtagagaaatcatgctgtgggtagaataaggaagatttccctcccatcatgcttgttggcaagtggccaagatgcagaagagcaccaggagctcctctgttccatggcagttcccagccatcaactgagcagactggacttgtcccttaaatcttctggaataccagagtacagtactgataggttttttttgttgttgttgtttcttttcctgcagttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcaggtgaataactggtttaagacatttggcttgggctataaggtaaactttctatccccttttcctccagcttagtctattaattagagctgttttttccctcctgaaccatggcgagggggtggagaggtttgtgtgccttcaaccagatctagatatggtgacttgtctcttcttccatacaaggacagtgtggaggggagggggccatacaggccatatcaggggtcaggatccagttttagatctgtttagacctttaacatttttcaaaagatgcttaccagcctacattattttcccgagtctggcccacatggcaaaggaaagggcaattctaagatttactggagctggaccatcctggattgtcttaggtctttaagcccatgcagtgctgaatggctgcatttaatgtttgaggggcattttataagaggaaaacaagtactatgaacccatatttgaagttccccagagattctagcttctctgtcccagttactgtcctatataggcactggcattgcatgggaaaataagacaaagtccttaccctcaaaaataaaagtctggtaaatttggaataaataaaagattacacttaataatatctttctccaactctggatggtctagaccagtgtttctcaaagtcaacagctctgactttggatcacctgctctgatattaactaaaggtatattaaaagtacagatctccaagcctaaccccagatccaggcaatcagaatgtctgggttaggtccagaaaccattgtgttaaacaaatacttgaggtgattctaagaaagcactgatctagaaggtggtccacagatcagcaacaacaaaaggagagagatgtaatgcctcccagatgtggaatccaccagtctgaataaagcagaaggggagacatggacaggaaattgcaatgcctcgtaactagtctttaaccagcgttaagggagactcacggcacagagacaagaggcagcctctaagctccccatataactgacatgtacagtgactctgctgtcatctgtcttctgtgtcacagaagctccaccaactacagaacttcaatacactgatggctgtgataggtgggctgtgtcacagctcaatctcgaggctcaaggagacaagttcgcatgtcccacatgaaatcaataaggtcagtgctactgtcttctctggggcccttagcagcattctcaagatgtgtgccaacattttctccttggtgggcagcccagagagcatttccaaccacaccatcccttgtcaaccaggctaagtggcagggaggcaaaccttaaggaaatccataggatggagaagtcacattttttagagtaactgtgattttgtctggcctcagacagtgtcactgcaaacattcctgctggaccagttgaaacaatgtgtgcctcttcccatgttcataggccatggaatattcagttaccatctttgacactgattccctcgctccagctccttgctctaaaatgtgttctcaaaaggaattgtggttcggttgaccataggtcagtttgcacattgagtgtagttatatagtgatatattaaaaacttagctatccagaacccttgaagaatgacattccggatagttgaattttaccagataattggatatgagttcttcagataccattttgtaatacataatgttttattaatgaatatttttcttaaatgtcctgtacattttcctacattattagattttacagaatatacttttatcttttatgacatagggctgttttgcttgtttctcttttttatagaaacagggtcttcctctgtcatcaaggctggagcacaggctggcacgatcatagctcactgcagtctcaaactcctgggctcaagcaatcctcccacctcagcctaccaagtagctaggaccatgggtgcacaccattatgcccagctattttttaaaatttttgtagagataagggtctccctatgttgtccagactggtctccaactcttggcctcaagcgatcctcccatctcggcctcctaaagtattggaattacaggcatgagccactgagtccagctggagctgttgttataaatataaaccactgtaatataccgaggatataaatgtatggcatgggttagataatgactgctctttgagcactttcatgtaagaggaccttactatactcaagccccgatccttccaaactagcatggagaggaactctctttttagggagagatacctaagctcattaccccatctgtttttcccaggtgttcagctcccttttggggagtcttttattatctctgttatcacaatgctgggcctctggggaggccccccacttcccagtggtctgatcaaaagggcatcatctttagtcacctcttcattccttaacggttctgctgaaaccaggtggaacagttgaaaagattgcccacatctcagaggtgacagagagaaatagtcacagagattaagaagccttcatgtcatttagcttataagagagagcttgctcctcttcagcttggggtccccccacagcagtgcttcctgtcggtagctacttgaccctcagggtggtctgcatagtgaattagtaagtccagggttgaagcaaaagtccccaagttgttgatttcaccttcggaggggaataaaaatatctttatcatttttgctgttacactcttgtcttgtgagccccttccatgcctagggctcacctgcaccattggtagaggtttatgaagaagaagctctcttgccatctcccagtgatttgaaggggtctgactccaagaactccaagttcttcattgtggagaaatggtacttcgtaggccacaattttattaagtttgggcacagtgtctaaaagggttacagtagtcccccttatctgaggttttgtctcctgtagtttcagttatctgaggtcaactgcagtccaaaaaaaatttaatggaaaatcccagaaataattcataaattttattatttatttattgattgagacagtctcactctgtcacccaggctggagtgcagtggctcagtctcagctcactggaatctccgcctcccaggttcaagtaatcctcctgcctcaggctcccaagtagctgggactacaggcgtgtgccaccacgccgggttaattttgtatttttagtagagacggggtttcaccatgttagccaggctggtcttgaactttggacctcaggtgatccgtccacctcggtctcccaaagtgctgggattacaggcatgaaccaccacgcctggccaattcataagttttaaaatgcatgctgtgctgagtagcatgatgaaatcttaagccatcccattccattctttctgggactccttcatatcagtcactaagtagccgtcttggtcatcagattgactgtcatggtattgcagtgcttgtgttcaagtaactctcactttgtttaataatggcctcacagtgcaagagtaatgatgttggcaatttggatatgccaaagagcagccctaaagtgtttcctctaagttctttacttaataaggaaggaaaaaaatcatatgctgaggttgctaagatctaagtaagaaggaatttcatctatgaaattgtgaaaaagaaaagaagttcattctagtttctcttttgtacttcatactgcaaaaagttatggccacagtgcatgatgggaatggcattacatttgtgggtgggaaacatgaacagaaatgtgttccacttgacagcaatcgggtttgttactatgcacagtttcaggcatcaattaggcatcttggactgtatccccctaaggataagagaggactccttatgttgtatgataacatgattggcagacagtcacttcatgtctttgcttctgagaaagctggttatcactcatggggaatggattctgtgaactgcttgctgacttgaatgacaagtgattgaaaagaaaactagatctggctgctccctttctgtgctggtgagcagccgttcccacttccaggtttgaagcagggtgtaacctctaatgtcctctctcctgtcctttgctcagaattgatctagtctattcagtctttttagttcaaggttttagtctgtgaatggaatgtcacttgctttctagtcataggcccattctgagaatcttgaaaggcccatcaagcacctcatagagaataacacacaatagactactgaagctccactcttaaaatacatgctcttccccatgccagcaacatagtcagcatttcctgacatcacatttcaactgttaatcaatgcagtgtctctggaagcattcagaagacaccaaggaagggaatcacatggcttggggacaggagttagagggatagtgttcactatatattcttgtacctttttaatttttgtatcaggtccttgtttttgaaaagaaggaaattttaacataaaaatgataaaaccccgatttataatgtttaagttatataacagattcaagcatatcttgtgtttataaatatattctgtgatatttgacatagctgaggttttaactggggagtcataatctgtaccttttacatgaattaccccctgctcaacaaattctggatggggtgagatcatggcacaggatgcaaacatgcaaggtcctcattacagacaatgcacactgcctagcgggtacctgtgattggtctgttctgctttgtaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacggtgaggctcacactggaggacaattactaagcactttctgtgtgccaggtgccattctataccccttaccaaatattagctgttagtcctcataaaggctctatgaagcagatcctattactatctccaacatatagctagggatactaaagcacaaagatataccttgccaggagaccacacattattaagtagcagagccttgattcagacccaggtggtgggactctagagactgtgcccttcagacttctaggactgtttcactacctctacaaaagcagtcctaagctctctgggaggagctgatggcaaatcaggatacaagtcttggtaacagatggagagaatgaatgtgctctcataaaaagggcaggcagtaatttaaaaaacaaacaaaaaacacccagggttattatttggttcctggcttagatctttgctcttggagatattcaagtgaagatgaacacttgtcaatggtgtgggagaccaggatttgcattttgcatatggggtgagatcagatgatgaactcccttccagacctgcaattccgtagtttaccagctgtgtgactatggacatataaccgtccaagattcctctcctcaaacgaattagnnnnnnnnnnnnnnnnnnnnccagttctaaagttacacagtttttaacctgctgtttttggagagtagaataatgatcataacctctttctgcctcacagcagcattttgatagaaccctgggcttcacatcagctggtgtgtgatcctagccctttcacttattagccaggtgaccttggcaggtctgtgtctcagacatcatttgtaaaaacatggagtgaatcttaacattctttggattataaatcttgtgatgaaagctgtgaaccttcttcccagaaaaatgtacataagccatttatttttaaatatgcatgtaatttcaagttctgaaatccttgaagcctatccatagactcaaggttaagaataagattattcctaaggacttctctcctaaaattttatagttctaagatacatgaaactcactatttttttttttttttttttttttggagacaaggtctggctctatgacctagactggagtgcagtagtgcaatctcagctcactgcaacctctatcttccaggtccaagccatcctcccacctcagcctcctgagtagctgggaccacgggcacacgccaccacgcccggttaacttttgtattttttgtagagacagggttttgctatgttgcccaggctggtctcaaactcctgagctcaagcaatcaacctgccctggcctcccaaaatgctgggaatacaggcatgagccaccatgcacccagactcattaactcttaatagcaattaatatgtcttaccatttaaactggattttattgctggactcaaatttaatagtctcagactatacacaccatcctttcagatcatctgtctgctttgagagagaacaagtgatgtattagtcatctgtccagacaaggcctttggcctaagctctatatagaggcttagatttaaatcatagttaaaaagagggcatcctgagatatgtccaaaattaaaaacatttcaatgagaattaatgcttgccctattgcaatagtaggtgttatacctgttttgtgacttttgaaaacaaactgtttagaacctaaaagagtaaactactggcaaggaaaatccaagaaagaaccatcagctgtgggagaggcaaacagcatcttagcaatgaaccctgttctgctttgatctgcagttatccctggatctttactacactgaggatgaaatctatgagctttcctatgcccgggaaccaaggaaccacagagctccagtgagtttttcatattaagactccacatgtaacaggtgctttacaagcttctcctcgagttcattcatcctcaggaacagactttcagttcagtttaatacatgtactgtttttcttagtgctcaaccttatgctaggaacagagaaagcttttcaacatatgtctgaggaatagttcctgtccattaaaaagctgtgatatagttgaagggataagcctaatgtgtgaccagtgaataactagtgaacagtaaataactatatcatcagaatgccaggtgtggtggaatcagtcagtggtttacaaagtagagaaggaagatactattgtgcaccagagtgacatcccccccgcattaagaagagtccccacataaatttcttttctatgattcattgatgataatgagagtaatatgcgtactaatcagaagctaaatttctgaagatttccaggttggtagatagaaaagccccattttcctgtaatgttctgggtgaaaagaacagtctgctgagtcttttgacctcctatgctgagaagtcctcaaaatagtacacagtcctggcactgcctgcagtaggaacttcacaggttatctgccctaccctcccacaggcaagtaaaatcacttcagtctcctgggacgtttccaaaccccaaaacaagtgatactcaagggaagagagttgcccacacttaagaaatccagctcatctattggggtggctaaattgcactcctccacacagaaagatcaagttctagctttctattgtaatgaaagattccactgaaaatatttggtagattccattttcaggttagaggcatttcaatggaaagggtacattctgttttttcagagagattttaatttgggctgagtttcaaatacagtcatgcaccacataatgacattttggtcagtgatagacctcatataccacagtggtcccttaagattataatggagcagaaaaattactactgcctagtgacagaacaattgtaacattgtagcacaacacattactcactatgtctgtgattatactggtgtaaacaaacctactgagctgtaaaaagtctaggttatacacttacgtacagtacataatacttgatagtaagtattaccggtttatgcacttactatacaatactttttatcattattttagagtgcattccttctacttagaaaaattaactgtaaaacagcctcaggcaagtcctccagaaggtgacagctccatgcatgttattgcccctaaagaccttccaataggacaagatgtggagtggaagacagtgatattgatgatcttgactctatatagacataggccaatgagtgtaattgtaccttagtttataacaaagatttaaaaaattaaacatttttaaaatagaaaaaagtttatagaatatggctataaaggaaataactggtacagctataagctatacaatgtgtgctttaagctaagtgtcataacaaaagagtaaaagttaaaaaaattaaaagcttttacagtaaaataaggtaatttatcattgaagaaaaaatttaagaaacttagtgtagtctaagtgtacagtatttataaagtatataggagtatacagtaatgttaggcctccacattcactcaccactcacgacttgccacagtaatttctaatcttgaaagctctattcatggttaagtgccctatacaggtgtaacattaaaaaaaaatttctataccatatttttaccttttctatgtttagatatgttaagatacacaaataccatcattacaattgcctacagtactgagtataataacctgctgttataggtatgtagcctaggagcagtaggctataccaaatagcctaggtgtgtagcaggctataccatctaggtttgtgtaagtacacactgtggtgctcatacaatgacaaaatcacctcatgacacatttctcagaacatatgcccagtcattaagtgatgcatgactgtatttagaaaagagcttgtccaggcttccgatgatttttcttgtgccttcctgccttttagctaagcttttccttattcacatttctactgcaaaatgtgactggagaatagagaggaaacataaatgatccactttactctttgttgatagctctgacaaagggtttaatggagagggaattgcaactcaggcagattgagaatttcaaattatctgtagctgcagataatgtatgtgaagagcactctggaaaccgtaagcacaatgccttgttagccaaaattattagtagagatttcaattgcctgtgggttctctgctccttgccactgaacataattgaagattgtccataaatgtaaccgtcaggtagtgggaaaagaaagagctataggttataatattgcattgtagtcatgaggatttctctaaatatttcattttagccactaacaccttcaaagccaccagtagtagtggactgggcttctggagtgtctcccaaacctgatccaaaaaccattagcaaacacgtccagaggatggtggatgtaagtacagctgtgttcagcacacaaaaactaggcattgcctggctcagttttgtatgtggggtaaagggagaggaaagcacaatggtggaaatgtaaaggcacgaaacttgaaccacttacttctcttactgtggctttagaacaattcaaaagttacattttgacaacacacactggactcatatgaaggcagttgtgcctcctcttcaagacctagcaaaagagcatatgcttaaaggttgtcagttgatttaggagtacagaagtattgggatgcatttgagtatagtaaggggtaatcaggtaaacctaaaactgaaaacctttgtactgcttaattcaattctctgtgctaattgctgaggaaggggtatatattctcatacttatgcatgtatcctcgtggacaactcacatgtaacaatggaaaactaagagcgtaacggtgagaaacaagaggattaacagtggggacagagcacttccaactgggctgtttgtagaagcttctcaaagaaggtacaactggagctgagtgatgaaaaaaagggtagagtgaaaggagaacatccctctgcgcagtgaactaggagtagccagcgtgatagtataattgacgtgctaatgattcaaagtacatggccaccccccacatgctgctaccagcaaaggcctgagatgtgacctgccacatctttgccacagctaaaggagcaggtttccctgttcctctcgttcaggttgttaaaaggcttttatccaactgccccagctctttgtcatttgactaaagggagagaagaccggtttctctttagtaatcaccaaaaaaactcctttttcacagtctgtcttcaagaactatgatcacgaccaggatggatacatttctcaggaagaatttgaaaagattgctgcgagttttccattttccttctgtgtgatggacaaagacaggtgagggtttgtacttaggaatatgtggttatgagcccattggtgagaataggtttataggtatgtcactagaagaatttgaaaactcagatatgttgctgctgtgatcacttaaagaacagaccatgaaatatgcattcttttaaaaatattctgggcctgggcacagtggctcacgcctgtaatcccaacactttgggaggccgaggtgggcagatcacctgagctcaggagttcgagaccaacctggccaacatggtgaaaccctgtctctactaaaaatacaaaaattagccaggtgtggtggtgggcacctgtaatcccagctactcgggaggctgaggcaggagagttgtttgaacccaggaggcggaggttgcagtgagccgagatcatgccactgcactccagcctgggccacaagagcaaaaacctgtctcaaaaaaaaaaaaaacaaaaactgaattgaacattccataaatctgccactttataaatagtcaactataaataagaaaaagtttagtcttccttcttgctttgtcattacagattttgggaaacaactaatacttattcatactttgcatttttacttttctcaaggttaaataaattctatcttggttctctataggaaactaatcatatggttagtgggttccagttaggtactgtctaaagtcagaaactgtagcataagacatttccctccctatacacatgtacatgttacattgtttctttttcaagtcttatagatagtggtcaagttagttagggaaacctagtttggccaaagaacacctctgtggaaatgagtaatgctgccttacctacttaccacatgtcatcttgtatccttgttaagagtagggcccatggaagtaatcatgaggtagcacataccatattaccactgaggataaaaagaaaggtgagtttctaaggctagaagcccccccttgctacctgcctccatgccccttatactcacatccttgccttggtcatctgccggcagggaaggcctcatcagcagggatgagatcacagcctacttcatgagagccagctcaatctattccaagctgggcctgggctttcctcacaacttccaagagaccacctacctgaagcccactttttgtgacaactgtgctggatttgtaagttgttcttagggtgctccagggctgaatttggggaagagtgtgggatactttaagacaggcacagacctcacaatccttatgaacccatcccagcttggagcccagacagacacctagaataacctagagctcaagcgtgtggtttttacctgcactcatcatctctcgcttcttcctgttttttcttttctattgcaatgaggccttagataaatggtaccagaaatgctgaattaggatatacttttaaagtataatattcatgtgctgtttcaagtgttataacaaagacatatgagataccttctgtctttaggagataaccttggctatgcccctcttccgttccactcctgaccaatcgtttccccctaaactcgggtcctgatgcaaggctctatatccttctcagtttggagtcctgaggaacctgtttgcccgatgattcatccatttctcgagaatgtctgggtcataaggctgctagtgagagccaggtgtggtggctcatgcctgtaatcccagcactttgggaggccaaggcaggcagatcacttgaggccccgagttcgagaccagcccacctaacatggtgaaaacccgtctctactaaaaatacaaaaaaatttagccaggtgtggtggaacatgcctggtagtcccagctacttgggaaactgagacaggagaattgcttgaacccaggaggtggaggttgcagtgagccgagatcgcaccactgcactccagcctgggcaactgggcaagactgtctcaaaaaaaacaaaaaaaaaaaaacctgcttcttgagaaactttgatcagcataaactcttctcatggatttaaggtcagaagggacaagacatgagagataaatgaggtttccttcccacttgagctagagagtaaaatgaaggaaaataaaggaatgtcaccttgtagcctcacaccagatggatgaatgacatgtggtgcattctgtctcttgtttcatagctctggggagtgatcaaacaaggatatcgatgtaaaggtaagactcaatattgttgacatattcctggtgtatcagtccattctcacgctgctatagagaactgcctgagactgggtaatttataaaggcaagaggtttaattgactcacagttccacagggctggtgaggcctaaggaaactcacaatcatggcagaaggggaagcaaacacatccttcttcacatgctggcaggaaggagaagtgctgagcaaaagggggaaaagcccttatgaagccaacagatctcatgagcagtcactcactatcatgagaacaacatgagggtaaccgcccccaggattcatttacctcccattgggtccctcccatgacacatggggattatgggcactacaaggtgaggtttggatggggacacagagctaaaccatatcagctggtcttagagtcccacctctaaaacattttttacccatagtagttgtccatttagtccacaacttctcagcagagttcagagtctcatccccaaagtggtttccctcggacacccccggtgaatgaccgccacaccgaagagagaaatgcctggttgcacagataggcattttctctgtataaaatcctctttctgtcgtggctggcctagaacagggatagcaggtaggagatggtgctctcatatagtcatggaagggtgggtccccagtgaaaaagatagaatctcttctgcaacagaagataaatgattactaaaggcccttgtcagctttcctttatcactcaggacataactgtccttccttgtgactaggagaattcaggagtgaaagagaggaaaccttttactgcaagaaagaaaataagacctaacagctgagtgtttccggagggtctccctagagtaggcagaatgtatgggataccaggacaccatctcttccctccaagatatcaggatactgcttctgatgctgagattcactgataagggctacatcaagagtgtgagctctgggcttcaccaagtgagaagaatgctagcttcattaggaatgttaagtgtcttagctccagaagatagaacagacatgtgtgacaagaaagcactgcatgaatttggttgtgagacacactggggaagagagaaaagtgaaagacttcttgacccaggatgtcttgtccacagactgcgggatgaactgtcacaaacaatgcaaagatctggttgtgtttgagtgtaagaagcgagccaagaacccagtagctcccacagagaacaacacttgctgtggggccagtgtccaacctttgctcattgggagccaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttagcagcaggaagcagacttagccacagacagagttctactagctgagtgactgtctatgatagccccaatttttctccaggagaggaaccccaagccattaatttaagaccaggtcctagtctgaggaaccctgaggggccaggtagcaggtaattgtcaaaattctagaaacagaaggctaaatgtagaaaggaagggcggggggcaaactcccactcaagtggagcttgcagattaaaattccaaatcatacaaggaaaatcctaggactgagacaaaacattcaacattcaagaaataaactagcaaattcacttacattaaaatgcaaacaacagtacaataaggaaatgactttgagtatgtttgagatgccccagatctaaagtgcaaagaagcagaatagactgtctctgtcttcatggagtagttctagttagggggaagataatatacaaatatagagcagtttagaaacaatgcaagagtatatgctaagagccaaataggttgcagtgacagcaaatgacaggaggacatagcagagagatcgctgtactggggctgttgggactttatggagaaggtggaatttcagctaagtcttgaaggaagggtagaattaagttatgggaggaggacagagcacattccagataggatgtacagtaggagcaaaaggccaagggcagaacagctttagtactattgggatagtgggaaaaaaaaaaaggtgttaaggcgatttaggtaagagatgaagtagaaaaatgagacagtctagagagtcttaaatgacaggtgcctgtctgtatgataaaatgaggagctatttaaaaaagggtaacatgaagggcttgttggggacggttggggcacaaggcttcatagtgctatactaggccctgatctctgggctggctggttagccagcatgtcaaaacactgatcaccttgactaactaaagaacatataggtcttcagcaaaaatccagtgcttattaggttagtgccagtttaatataagaagctgtgtgacttctaagtagaaccaaaaagggaaataagaaatgagtttatttatataaagcacttaaaatcgggcttaacacgtatgtaccatatgttaatatcattactcttttgaaataagctccctaaagtggtaaggccactatcgttacaacagatgcctagagaaaaagtccatatagtatacattctgcatttaaagcacttctaatgttcagtggtaaatatccacatgcatttattgatcaattagatcaaagcttaagtgcttcacttccatgtaagaaatgcacattcctttttatcacatcagccaagtaaaaattttctgtcttcctaaatctttccccttactatctatctaaacacaggctgacttcaaacttttggggtgttttgttcttagggggaaaaaatcctcttagggtcttttctaagaaagaatatgctaatcaactaagaatttgatgttcaacttttaatagaaatcacaaacaccattgtgaaaaataggcctgtaccctgtatttcattcatgcactctgtattttcagagttacacataaccttagggcaccacaattctgtcacataaaatgcagattttcaagtggaaaagacagcagagaacagcctgaatctgaggcctcaaaaaggaatccctgaaggggcagttgttagagatttctcctctccaggccatctctccccttttccaaaccctgccccacagtggtaagataagtacttgtcaggaagtagaccaataggtaggataaacatacatgtatcatgggcaacaaaatgaaaattactatattattataaagttgctaaaagtcaaggtctatttataatggcaaaaatgactattggatatcatccattcttagttatttctatctcattattatcggggatggtttctgcttatcaaatcaaaatttccagtgatttcttttagcccattactatctttctcaatctcatcaactttcactttcttgaaacttgtacctctcctaatttctgttaacactgtcatctctcaggactcttcctgcaattttaagggctttctgttgctttttgttcttactgctttcttccttttgctcctcaaagtgtatagtgcctgaatttctgtcccaagctccctgtatgtctaggaattcaacctaaataatggaggggattatattcataatttgacaatctaggttggtaaaaagaatgtataactgtattacagaaaagttggaaaatggagatataaaaaataatcacccataatactcctccaaaaaaaaaatgtaattattttagggtgaccataacaatttaaatatttgagcacttaaataactatgtaattacaattttgagctttattggataaatattaaatgttaatttaaattatgttctctttggcaagaattaaactaagatctttgtaagatttctagttttacaactggttgattctggtcaaatactaattagaaaacttttttgttgttttttaaagccatcttgactatactaatccaatgtcttcaaagtcagactatccaatgttttaatcactgctgagtctttccaaaaagtaaactgagatgatcttcagtttatcttaaagcctatctatcgcccacctcaaatacatctgctcttactttacttttccaggaaattactccttatggctaacattactaggctggatcctgggtagtgggtcttagttaaagaaaaccagagtaacttacctttttcctctcagtatcaaacaggggcaatacattttaaggtacatttccacaaagctaaaacttctttctcatggttaagctgtgcccactgtacaaacgggttcccagagagtacttacctgctagagggtgtctgtatcaggactgagacatgaatgtggagagctcccaaattccagggtccaaaaaagtatttatggagcatttctgtctagatattgttcttgttctctttattttatgaaactctgtggcactgaggcaggggcttcaacttacctccaaaaacagaaaccctctaagcaacctttgtgcaaacagaagatgctctttctcagggtggatgtagcttgacaccagtggccatgtcttggccaaagcccctggatttagccctcaccccctaaactgggtgcctgaaaatgggtcctctttgaacatatggaactccagtaacaataagaaaggtctcattgaaactaatgtctcagtcttgagtctctgctttcctgagctagagtactagcatgtcctgtatcttcctacagcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataaagactccctcataaaatcaaaggaggagctccgtcacctcagactgcctacctaccaagaactggaacaggtaccttccttttcattttcctttttttcagactatcttagagaagtggggccaaaccaggaaagagcatgtggactgaagattcagatcaggctgattacaagcagtctaaaacaaaaaaggaggaggggagaaacagggagggagaaacagggaggaagagagggagggaaggaagaaaggatgattgattccagctttctcacaacccactgggggccttggttcacattacacaagtagcacaggctatacagggctccctatcaccacacaggtggtggcatttcagagtgctggtgccagtgcccaaagccctgtttagtaggctcacagagaaaaaccacagtatctactggttagctttactgtgctgataccactccttttctagatggaactaaaatgaacttgcctaaatcctccttccctagaggtctctttaacatgttcatcagggttatggtttaggatcatcatggttacctaagcatcttcctaagagaagttagtgatcttagtcctatagcaacaacaacaagagaaaggtgagtgtattgtggctcaccatagaaaacgcctccctcctaaatataaacgaagagaatcttttctaacacatcagggaatatgctgatcttttacacatattagaatagtgaaagcaacagtagcaggcaaacacacagtggaatataatatagagcaatataatctataaaatgttaacaatcatgacaagaggagctgcttttcaatgttaggctcacaatgtcctaattatcaggtacctaacagagacaatggaaaagacaaaataaagtttaccaaggaaaggagaccaagagtttggaaacatggtgccaaggtttgagagaagggaataatgacattaaaaacaggaaaatagggctgggcgtggtggctcatgcccccagcactttgggaggcagaggtgggtggatcacttgaggtcaggagttcgagagcagcctggccaacgtggtgaaaccccgtctctactaaaaatacaaaaattagctgggcatgatggcaggtgcctgtaatcccagctactcaggaggctgaggcaggagaatcacttgaacccgggaggtggaggttgcagtgagctgagaccaagccacggcactctagcctaggcaacagactccatcttaaaaaaaaaaaaaaaaaaaaaaggcccggcgtggtggctcacgcctgttatcctagcactttgggaggccaaggtgggcggatcacgaggtcacgagatcaagaccatcctggctaacacggtgaaaccccatctctactaaaaatataaaaaattagccaggcgtggtaatgggcgcctgtagtcccagctacttgggaggctgaggcaggaggatggcatgaacctgggaggcggagcttgcagtgagccgaaatggcaccactgcactccagcctgggcgactgagtgagactccaactcaaaaaaaaaaaaagcgggtggggaggagtaggagacgggaacagcagaaggaaaaagagccaacagccaactgtcaagatactcaattctgaaggttcaatcattactatacttctttttgtttcgagtacagtacacaactcacagggctggctcaagaggttacctataattggtaagaacctacaaatggtaagaaactactgtcccatggcatagtagtttcttaattatagataactaagccattttagagacagggaagcaaggatacgttaatatcaacactactattcactttattacaggaggaggaatgcctttctggcttttcccaaaaacatcaaggtttgcactgtgtttttggagacctgtcagtgcaaacacaaaaccaatatccagctagtagaattccttatataattctacattctacagactgaaaaactgtccacgagggcttcaggattccctgcattgtcctcaatgctctaccttccctgtcagacccccagaaactgaattagagaaacatctgaagaaacaagttagataacgtatgtggaactcttgatttggtgcttggtacaaagaacataatattaagagaaacatacgaaaaaagaacaacagattttctggatgaatggtactctcttgctcagagttattgttaagatgtgctgtaaaaaccaagtcaatgagaaggtggcaaaacgtgggttagacaaaccccttcctctttagggatagaaactgccaaatgcaacttctaaaaatgatgaaagaaacctcgaaaaatgaactcggtagaatagaaagaactttggtcttggaggcaaagatttgtgttttcagtcccagacatttcttacaccagctgttaaactctacagcctatttggtccttgtgaaatacagggctgggattccatgttctgaaaggtttgcctcaaatcttgacattttacatgccgatgaaaaggaaaaatgtggttggcaacaatgctttaagaagtggctcgcagaaagattagaattcctactcagcaacatcagagccagtaaaccctctcaccattttgaccaccgcctctctttactttttaggcttgtcagatagacctaaggtccagaattcactgtgtgtattttagaggaacaattatgtgtcccactttcccattaagtataatccttacaatgactagtctatgtgtaattcaacagtcctatccataataactagtcaaattaaatcagtatttacaatatataacgtatattaataagaataaatattatgtattattttaagtataatgtaccactgaaccagcatgggacaaaagaataagcaaataaaagcttttatgtttagatataccaaggctcaactctgcagttttatactatatggcaacatttgcctttataagattgaggtatacaacctattttcagggtgtttgtgtaggttaaggcagtccattatgtcacacagcgcaggcacatagcaagtgctcactattatatggcagctgagacagctatgtagataattcagattgagaaacaaccccagtgtatcccaaattacccagacactggctatatataatattctcttggagtaatcagtataggataacatannnnnnnnnnnnnnnnnnnnnnnnnnnnnnnnnnnnnnnnnnnnnnnnnnnnnnnnnnnnnnnnnnnnnnttggctctataatgataccactacaaattagaccactaaatctcaacttaggggtggggtgaaattcttaacatcatcaaaaagttaaatttgttttcaataatttgtgggggggaaacttagataaaattaactaacaccttgcattacagaattctcagtcatgctttcatggctcagacctgaccagagactgtttctgccaagttgagatctcccgcgagaaaacatccaaaagttttgtcattatctacctattgctcggaaatggtttattctgcctgctaaccactcacaaactttgatatgataacaaagactaactgctgcttacaaatgctcgtttgatatttaacttgctattttctattcagggcaaaataactatcttgaaaatggttgttaattctcagccacagtgaataggaaatgccaatcaaaagtagctctcaatttgtaattcatttgctattcattgctgctttattaacatacctcattctcctttccctttaggaaataaatactctgaaagcagataatgatgccctaaagatccaactgaaatatgcacagaagaaaatagaatccctccagcttgaaaaaagcaatcatgtcttagctcaaatggagcagggtgactgttcttagcccagaaactaagtagcacaatctgtagatgagtatagtgatctcatttcctaaactgtaatgcacagacctgaggaactttacactgaccagctttaaaacagtactttaaaaggaaaagcctgttactgtttatttacctaaaagattcctaatgtgcagcactgttttctctttcagttagttgactcaaagggggaaaactaaagaatgcaaaacttttgctattcataccactgatgttcatcaaaagtatgcgatctaaaacatgactatcatttcctgacaatggggcatctcggtggcctgcctggctgattcttccttaaaactaaaatctctggaaaatggatttgcttcttaccctgtgttttctgcaaactgacttactttgttccagccaaagcttgctaataatagaaaactacccatattccaaaagtagatttcctctgtatcccagcatactttgtgaacctggctccttcttcactacctcagatctaatcaattagtccatgtaccctccttcctcactacagtcataacacatgagcatatctacctagaagccaatttctactgatgtagccacaactttttagaggcctattaaacatgacgttatccaattgcaggtcaacttatagttgtagccttacaacttacaggcatcagaaaataagtaatcaaattaggtacctggaaacatagctattaccatctcatattactgtctaattaaaataaacataacgcaaacatgtttgtccttatatattctacagtggatagaattaggaattgatggcttaaaaaaaaaaagtctatgaagagtctgtttaactcttcatgttccatctttctcttctgaagtaaactattttgaaagttctctttttgaaatgaatttgtgcttaactgtcttcactattaatactatttagaaataagctaattggatcagtggcttaaataatagctgactgtgtgtacatatgtatataatatgtatatacaatatcaggcatgcatgtggcttggaattttgtttcctccataaaatgtggaagtgaattaaacaagttttagtcatttatacaaagtcacaaatataaagttcagtttgtcacaagattaaattgctcacaaggtaaaattgtattgtttggcaaaatcacaagtaacaatcctgtgagttttctattatgaaggttaataataaatgggctcatttagttgcctgggcacctattcacaaattcatttgtcagcctctttttagttctcttaaaaaaaaaaaaatcatatgatcattttcctttttgggggtacttagcttccatgcctataaagtctggtaccagactgacttgaaattcataaacaagttgtccaattgccaagaatatgttaacaattaaaagttccaaactaaagccagtagcaccaagtcttcataagaatacaaagtatacatacagtattgcttacctggaggattcagatcatttaggaattctctttgatgaaagatcagttcccatttgagttcctccttgcactgagttttagtgatatagaactagcttgtagttagtgtttcattacattataaagaatagttttacacacgtatttaccgttttccaaatttaaactcagaaatacccaaagcaggcctgcttaagcccactacctggcatataaacttatagtaacactttgttactttctttttaataggacaagcatgagttaggacaaactctaaaaattcatattcttcactattcttgttttcctttgattgatatagaccaaagatggtgtactctaattttttaaaacagtaatggaacacaatttttttcattcttcctcctctccattcgaagtaaagatccccagttagtttttatataaataatctatagggattcaaaaggtgtcacagtccacttaattagtcaaattagcaatggctaaacagtatcaagtactgcagaatttatcactgaaatggataagaggaaatagtttagtcacaggtttttacagtccagcaagggccaaagaggtatagtatacaagttaatagtatttgtgttgagcaacatggggctagtgggatcacagaaatctggaaaaaaaaaaaaaaggctttggcttatcaagcctagtgtaaatttctgcatctcacacgactttagtttggccaggtatttatctgccaaaacaaggacaaatcttgttgtattaacagcagggtcacttctcattttctttgctgacttacctttttactgaccgttgtgaatttctgtctcaaaatgtataatatagaaatgcaagaaaaaaacaaatgtacagattgtaaagttttttgatacctaatgtaagttttctttgtgtaatatttatatgataaaagacattaggatccctacaacacaaatgtcttgtgtttcttctgcttcgtgaccccgtaaacactttacctgaatttttcctatattccacagctaagaccactgccctattctattaatcaaattgagttttcctggaaggaaaggcaaagcagctattcagtttaaaattttctacatctttttacaacacgaagaagtaacactacagaaatattcaatctctttccatcttattcataacttacagtggtccccaaatattaagtctataaatacttaacattaaaggagacagacttgaggttgtcccttctctgtggcttttaattccacagtttcatctaagcaaactagcatgtaaagaagaaatcctttgaagctatggataaaattggtaacgacagctcaatccaggttacagacctactcagggcaatttatttgtggtcatgattatttagaatgatcagacatagccacaattttcccttaatccccagctaatttttgtttaaccacaccaatgaagaaagaggaaaaatttcagtcactcaaattcctctgtggaatgcattctggaacgtttagatgggggtgtatttatcatttgggcaattcataatacttcatacaaagtaataaagtcacactgacagcctgatcctgaaggcaagattaaactgcctgctcacctcccccaattttcatccccacatttctctaacctgtgctccttccaaggtatagatagtatcactgctcaggacatttttctggtcacaaattttttttaggttgtcatgcctcctcttgtcacagatacaggtaataagatgttttttatttaaaatgttttcctttttctgtttaatgaggcaaggtttccctgatctgcaaaacaaaagtaagttcaaagaaaacccttgtttcccttttgatgtgtgcttatgagtaatagtgtggtgattatgttatagacagaatacatgctctttatacggtcgagaggaaagatgactactttaggcagaaactcccagtaagatcatgtctatatttgctattaggtaccaggctggacaaaaagagaagaaaaaaggggaaggacaatgaggtaattaaaaaatgaaattgagaaccaggcaaaaaagaatgaaaaggaggtatcaaaaaaagtgttggattttaggaagcagtggagtgccattcatcatactccatgtcgtattgcactcaatttataaaacattttcacactatggcctttcccattaaggccccaaatttccttcctgctattccagatactgctcagcaaactgttctacaaaagaaatttttactgaacaaagattatcaggaaaatcccaccttacaggaaagagtaaaatattaagagtctacctgattcagcttttcattcaattaaggtttataggaatgtgtacataggagtggtttcagctccaacacgattccaggagcaagtgctaaactttgataggaaataagtgattgtagtgaataacccaagcagcactcctataaaggtacaaagaaatcttatggaaaatctaatgaaactgataaactattgtttctgccatatttaccataaacctttagtggtaaaaaagttgaaagtagttgtaaatctccttcatcagcaactaatgctaccaaaaaagaagtgaggcagaaatgtaaaggttttaaagaagatttttaaacaactcttgaaatattttactcaagtagtttttttcttaaaagtttttaaaaattatttttcagagttcatagctactgataaaggtattttcttaattatggaaagcctttttttcagctatcacaaatgaaattacatcttttcattaaatataaacacacaaaaaataaatttacaaataaccaaaaaattttatattttcctaccttgaacacatttcttcaaagggttagcttgaaaaatacatgtctaagattacagaatattcaatagttacttttagggttttaacattattttagattttaccacagagtttaccaaaaaaataacaacaaaaaaacctgctaaacatcaaataccacttgtccactgggaacaattcagctttctatcagttgagttggttagatcacattaagttgttatgtataggtattgaccagaagcctacaatgagatacagattttacactaagattgaaaaaatttatggtaccagctctttttctcttaactttctacactaagagaaaaatacattacttggcctacatcttaaagcattcaaaataggccctctgtaagtttttaacaaattgtatttgtatttaggtctttaagaaacaacctgagatgatggtaagtgtctcattcctcatttgacaaatgaggacaaatcactccttgagaactaaggtcatttcaatccatagcacccctgacctagtgccatgattcaaattcacaactcttgatagctaagactttgactgctccaactagcaaatcacatatagccattccctaactttgtgtttcccaaatctagctgtgaatcagaattaccacaggatgccttagccctacccttgatctactgaagcagaaaattactgccttaattctgtgtgatacaggtcagcctgccttttaatatttggatatctaaagtgagagcataaatgatgaagagaccagtttataggactatttctcacaccgtcatgtaaagttggtatgtgtctttgctccattaaagtatttctgacctcaatcttaaactttgctttgtcaaacaaaatcatgctgatttcaaatccaattagaaaataagtatgtacagtaaaaagtaaacttgggcttcaattaatgaaactttaacagaaacatggctagagaggaatctcctcctataagagaaaaaaatgattcacaacaactgcctactaaatacaactggaagtgcctttccctattttgtaaaatcgaatgaaaaacccacaaaacacatccacagcaatacaggtgaggcaagggtctatattcctttctattacaggtggggtcttttatatgtctcaaacctgaacaaaatacaggtaacaatctaaattcaatcatgacaataaaatactttccattttccaagtctgatggtaataaatatttacattttaaaaaataatttttgttcttttttttgttttttaaaaagacacaacatgctcaagggtacacagaatatggaaaaagtcatcacttcatttgagagatcaactggtaataaaaaacaatgttcttacatattaaccaattcaagagtggtatcaccagggagtctaacatggtgtttacttcaaagatgatattcaagtatgttatttggaacactatttctaatgtatctataaagaagcaagcactgctatctaatttttatagtttttagtatcttctatattccacctcctccaccaccaccaccaccaccaccaccacctcctccatatggatctccatagcctcttccaccatagccccctcttccaccataaccccctcttccaccataatctcccctgccttggaaacctcctctaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccaaccaccccttccaccgccgccttcttgtctcttttgccaagggggcatttctggaggtggtggttcaatttcattcggccggcctcccctgtcaggcacccttcccatcagcacctgtgtgaagaaacattttcttttagttcctaatatttcaaaaaagtttacataaaagtttcaagtgatgttgtttctaataaacagaagccaatatttaaggacatgaaagtaccagacatggcagaacaaattaatattaaaaatattaagtgtggaaggataaggagaaatctgttaaaggatacaaaatcacggctagacagaagtaataaattctagtgttctataccattgtatgatgactgtagttaatatatagtttcaaatagctacaaggaggatattgaatgtttccaacacaaagagatgataaatgtttgagagggatatgccaatcaccccgtctgatcactatacattgtatgtatcaaaacatcactatgtacctcatacatatgtacaattatggtgtttcaatttaaaaaataatttttttacttcctgtttaccaagtctgaagaaaaaagaaaaaaatgaatggttttaaaaaggaaatatgaaaaaatataaaatgtgtgatacatgacaaattccttagtgtatatatatatattttttttttttttttttttttttttgagatggagtcttgctctgttgcccaggctggagtgcagtggcatgatctcagctcactgcaagctctgcctcctgggttcacgccattctcctgcctcagccccccgagtagttgggactacaggcacccgccaccacgcccagctaattttttgtatttttagtggagacagggtttcaacgtgttagccaggatggtcttgatctcctgacctcgtgatccgcctgcctcggcctcccagagtgctgggattacaggcatgagccaccacacccagcctagaatatattatttttaaacaatctgagagagtatttctgaaacttaaaggcttaatttttttctcacttaaatttgtttagcaaattctgtaacaaatgtagtacccatttcactaagaagttcttttaggaaaacattttttatatatataacgacataccttacattcattaacttaatatccatttatacaataacaactctggactttccattgccattgatttggtaattgattatccaataaaagattatattcctaagcacatttcatttcaaaaatgtatgaagtacatataacatgggaccttaatgaggtcagagattgatataaaaactataattccaggtatcactgcaaagagagagaaggattctcaatgaactgcttcttttaagaaacttaagctcacttactttcagtgatgatactagtaccatattattaaaaggaaaacacagttaatataattcctttactatgctttataatcctttcaaaaataaactagggaagagtttaagtatccaaccttctataaaaagtagcagctttatatgccatgagcagaggaaagatagcaataagaagggtgtcatctgctcaccacagacaaggggaagccaatagcttcctgctactgcctttcaggaaagaaagtaaaaaagcaactgcctcaaccaaaatgaccaattaattatacacttccattgatcctccaatcaaaaccaagtttaggatttatgtcacaaatgaaatataaaaagtgcaatatcctcaaagtgagacaaggttctaagtatgcaacattcttttaaagatggcaatgatgtcctaactaccaaatccaaaaaacagcctttcttggttattattctcactggtctctctaccaaacatggtatgttggtgggcatatggagatgccagaactgatcataagactaccctcaaataatgagaccataaattataaactcagaagagatggccaatgttacttacagaaatagaactcttgatccagcaagactaaattatcacccaatgcaagatgttaggtaatatatttaaagagagaacactttcagaacataggattgagccacagtggaagcacagaggcaaacactggtgatgcctaacttagcaatagttagcaaaatgactttaaaaacaaccatccctctgaaaaggtattttatctcaagttacactgagtgagaagcgatgctttaaaattatccaaatcccttatttctgattttttgctcttttgtaataaagtttgccatggagtgctctacctaaatgaagaggacatgccagttaagctgacataaacatactaaattactttattgttattgctgttgtaaagtgaaaaattcagactccttgagcttgtttaaatagactactgtcagagaaatggatgtatactccaaatcaggaaacagaagctcaaagaagttcagtagcttgctcagggtcatttctgtaagtaaatgacagagccaggatgggaacccagattggtctgactctaaagcacaaactcttcttccctttacaccaaggatataacgaatctgtcagtacttgaaacaattccgaaagattcttactgacaaaaaatgattactttttagaaagatggaacataattcttgctaaagctttgacaaaaacaattcataattcctctaattcagaaaatactttgatttatgaatacacaaattcaagtgaacatacacacatacacaaaaataacataactaagcctagactgaacccccctgccactcttttttctaaacatttaccaggacatgaaagaaaaatagactaaaatctgtaaaaacattaagtaagatatcatcaattcattttccactgtactgaaagaaacaccaaccttattaatggcacatgcggtcttctcccggctggtgccactacttgtcctaatgatcttggatagatcttcacgagcagcaagtagatgtgccattgtaatcgttgtcttgggtgacaaagcataacgcttaggctgataaattcttgctatatcatctgtttttacctaaatgacaagagttaaggaaaaaaggaacaaaagtacattttaatgaaagagcaaaaacaatcataatctttagaaataaagaaaaggagataatgcataagcaaggagttagaaaagagcaaaaacacccaaatatctgagaatttatgaataatttagaacaaataaaatagaccaacaggtgttaaaaatatgtaactaccagcaacaactcgctaaaaaataataacaaaaaaatttctatacatattaacaaaaaatacctaaaaaatagttttaccaaaaccacatacaggacatttaaaagggaaacatcagtaaatcttgcaaaaacaaaaggaaaacttgtataaatggtaagaaataccaagtttctgtatgggaacattaagtattattgtcagttttcccccaaattaacttataatcctatataaatagtttttgagagaatgaaaaaaaaatctaaagttaaatccagaaactcaatatgtaagaataactaaaagcattttgaaatataatcctaccaaatactaatatgctataatacaaaattatcatcatcttatcagttaacatttaatgagaacttattaaatgtgccaggatgctgttcacttagtaaggcattatttctttaatcctcaaaatatccttttagagtggttggtttttattatccccttttgcagatggaaaaaaaaaatgaggcatagaaagcttaagttagtttccccaaaatatagagagaatcctagctctgcccacttagcaacaaaggtctacctgacccccaagcacaggtctagtatagataacagtttgctatcctacctccatctaattaactagaacttgggagaaaaaaacatagattgatgaaatagtatattgagactcagagcctcataaatctatgaatgcaataaatgataaaggagacatcacagatcaacgagaaaaggaaaggattatcttttaaatggtgctggaatgacctggtggctatctgtaataataacaataatacagcacaccatataacaaagggaattccaaagagaacaaaaagttaactgtttgaggtttaattttcaatttaaaaacaactacattataaaaattaaaatttctgtactttaaaagatataaaacaacatctaatgacaactggggaaaatattttcaacaaataattcaaccagcaaacttcctttctatataaaaacctcaaacacaaaaagaaaacagaattctacaggaaaaaaaaatgacaagacataaatagaagttaaaaagaggaaattcaaatgactaataagcttatgaaaacagttcaactttgtcaataataagaacagacaaaacaagttagtctttttaacatcaagttagcaataaagaggctaaagtgacacaacatttcatttaccttactggaaggagtttaaattcatataaacttaagtggaaaacaatttggccatgggaagcgagagcattaagagacaaaacctttgacacagtaaatttcctttaaggaatccaccataaaattttactctgaaatttatatataaaaattaaacacagaaacatgcctggtattgttaatatagaaaaaaatgtataaaataagagaagtaaactattgaatcactaaatgataaaatataatgcagccataagaaggatactgaaagaaatttagtactgttacatgctatgacatgaataaaccttggaaacattatgctaaatcaaagccagatgcagaagccacatattgtatgattccatttatatgaaatgtccagataggcaaatccatggaaatgtaaagtatattatagtaatggttgccagggcatggaggtagggagtattgggaatgactgctgagaggtagctatgtcattttgggatgatggaagtgttatggaattacatatagggttacacaacacagtgaacagactaaaaaccactgaattgtacactttaaaatggtatattttggccaggcacagtggctcattcctgtaatctcagcactctgggaggctgaagtgggaggattacttgaggccaggagtttgagaccagcctgggcaacatggcaaaaccctgtctctataaaaaataaaacaaaatttttaattagccaggtgtggtggcacacgtctgtagtcccagctgcctgagcgaaggccacagtgggaggatcacttgaccctccagtgagttgcagtgagctatgatgatggcactgcactccagcctgggcaacaacaagactacaactcaaaaataaaaataaaatggtaaattttatgttaattatatctcaaaaaaattaagagttaattttaaaaagggtactaaaatagagtttttagagatattggaaaatggttacaatatatttagtgaaaaagcaagctataaaattacattcacaatattatctcaatactagtaaaacagtgaagaaaagaaactacataacctttctaataaatgactataatctgtttgaagggcaactctggagtatgcatcaacagccttaaaatcatttcccttaatcaaatagttcacttttaggaatacatcatggacatgaacaaaaatttagctgtcaaggattttattacagggtcaaagaggcaaaattagagaaaacctcagtgtctatgaatacagtatatatatgcatataataaaatactgtgcaaagatttaaactgctgtagaacaaagttgatgacagtcactcaacaatatcagacgtatttttctatcacgaaaatagggagaaaatgataaagatataataaattcaacaagaaaacttagtatacaaatgcatataatcatataatcaattgaaaaagaccaaatgaaaggccaaaactgatccatgcatagtctaaggaaaatatatttttaaaaaccttcccaaataagaaaaaaacaaaaacacaaactccttgtcctaaaacatgaagaaaaaagaccaacatgagaagataaaatatcaagatatttcctaaaggaatatttgctcaaagctcccatttaagtccagttcaggggtcaaacatgcccatgaatctatgtcactgaatgttgaaagaatatatcaaaactcacttattttggatttctctgtaatcttaatgccaacattgaaaatatcaaagtacgttaagacaattttaatgcaaatacccttcacaatttgcctaatattcctacgttcctttttctcattaaaattctgttaggttaaactggagacccaacatagataaaacctctatttaagtttccagagctcagtaatgctggtgcttcccacacatctgaactctattccatttcttgaggtaagcaatcatgtcatctgcttcgttggtaacttacagctcttaacagcactcgagcttcttgcacaaagcagttactccaatgaaatacacagacatccctggagtttatcctggcacacatgcagaagtgaatcaggctttaaccacccaagaagctgattagatattacacacacaaatcttctatacctaatcatacggagtactgagatattcatcctgaaccaggtacatagtacctgacatatacaaagtgctgaatgtttattaaagaaaatgcatgaatgatggtcttcaatccctgttctaatcactcttcacttttctgtatctgtcaggtgtttggaaagggactctatgtaaaacacacgagggaggatttctaggtaaatgaatcatactgaagacactaaattataaaaggtacatatatcctatgacaagaagaatgaaagagagacagataaaaagggaaccaacatttcaaaacactcaaagtctatttgtaaaataggccatccctccaacccctggtgacatgctgctactcctttcctggacaaagaaaaacacagtatataggaaaaaaaaatgaggtttatcttcctgagaaaatgagcagctacaaagactacacgttggcattaagaattgccacagcacatcggccagctccaaaacctgacattaaccatccctaataacgactgtagttcccaataggctttatagtgctttactcttttctttttgttttaagagactgtgactcgctatgttgatcacgctggttttgaactcctggcctcaagtaatcctcccagctcaacctcccaaagtgttgagattataggtgtgagcacagcacctgccccccaaccccaactgcctttatcattagagacagagtcttgctctgtcgcccaagctgtagtgcagtggcatgattatagctcactgcagcctcaaactcctgggctcaagcaatccacccgccccagcctcctgagtagctgggactataggcacacaataccatggccagccagtgctttactcttaaatatggacaaccaaaaactaccatgcagctgaagaagccaccgacatgggagagaccaagaaaaacaaataaacaaaaaattatgctagaggaaacagataattgaaagcaaaaaaaaaaaaaagcaaagtttctatctttaatcaagatgatagcataccaaaatatatttttaaaaaatcaagaatcaaaaagaatttatggaaatttaaaaaataattgcagaaacaaaaattcaacaccaagtataaaatagttaaaaacatttctgagaaactgaattaaaaaaggagagagaaaatgaggggaaaaaataaaacaacttaagcgagtctatctagaatgtttaatatctgactaaaccatttcagaaagagaatacagaaaaaagggaaaaagtaataaaggaaaatataaaagctaaaacagtctacatattgaaaggtccatctagtagggcacaatgaatgaaaaaaaattcagaccaacacatattgtgcaatttcagaactccaaggataaagagcccaaaagcttacagagaaacataacaggtcacacaaaaacacagagaatggagtcagttttcttaatggcagcactaaatacttgaaaacaatgaagcaatgccttcaatattcttagagaaatacattttcaacctagaattttatattcaaatgtgaaagcagactaaacattttcaaaatgcaaagagattgacaaaaatcacctcctatgcactccttgtttggaaattacttgtggatttcctacagcagaacaaggggtaaataaagagtgagccatgggatctagaaggtagtagagcagccaaggatagccatgcaaacagcaaaactgcagtaagtggatgcaagtttctgagagaaaaagtatacagaaaatggagaactcattagaagacctaattttttaaagtatagttttttaaaaaaaagcattttatcannnnnnnnnnnnnnnnnnnnnnnnnnnnnnnnnnnnnnnnnnnnnnnnnnnnnnnnnnnnnnnnnnnnntcatttagaagcccctttgtaagttgactagccctccaaagaggtccacatcctatttcctagaacctgtgaatgctaccttacagatgcaggtatgattaagttaaacatcttgagatggagaggttattctgtattatctgtgtgggcctaatataatcacaagggttctcataagggagagacaggagtgtcagagacagaaggcgatgtgacaatggaagcagagagagagagaaaggctggaagattctaccgggctactggctctgaagagaggagatgaagccaacagctaaactatgcaggtggcatttagaagctaggaaatgcaaggaaacagattctcccctaaaggatccaggaagaatgcaaccctgccaataccttcactttaggactgctaatctccaaattttaagagaataaatctgtattacttaagctactaaatttgtggtaaactttcacagcagccataggaaactaatatatcacatggaaagagatgtcatgtgaaagacaagaaggtaacagaagcaccacacttatgagaagctaatgcctgatgatctgaggtggaacagtttcatgccaaaaccatcgccctgccccccaaccctccatggaaaaactgttttccatgaaaccagtccctggtgccaaaaaggttgggaactgctggcataagtgaccccaactgatccagcatggggcagaagaactgcccagttaattcaaaaaatgtaaaaataataatacctgaaattccactttcagtcaagatacagtaatcggcaccagattaactctcccacctgaaacaactaaaaaactggataacccatgtgatgtgaaccaatgatggtcagacactggacatcaaggaacacaggacaatgatccctaaatgaggagaagccctataattatctcagcttactgcctggagagtttccaggcaatgatgcagggtagggagagcgggggtgaggagtgatcccagactaagcatgggtacagattaaaggcataaaatgggaatgatgggagacagctctttagaaagctatctgaagagattcaaatttggaaatgccctcacctcccaaccccctcttcaactgaaacacattctatattcatccagccttaagatacttttaaggcctgttggcatcagtactacctgcaactattcttatatcctgctttcttcttacactgctcactgtatctatctcattatctcatatgatgccccttcttttatgcatatcctggcataaatcacaatatctatgagtttaaaataaatgtcaaaaatgtggggagaaattaagttatatgcaacagggatttatacaagaccaggatcatcttgtaagcaccagtagttggcctgggcatgtagttgagatggtgatgaagtacaaatgtggcatggttacataacagacaagcaagccagaagagctgttataggctaccacctacaggacacatatgggaaaacagccttacctttgctctatcagaccatccaaaggactgtacagtcacatctaatcgtttcattaacattcgtcggcggcactcatattcacaggaaagagcatcattgattctttccagttgttcctaaaaaatttggaaacaaaaataataaactttagattctttcattctgcaaagaaaagaaatctgaaaattgtgctaagtacttcctactgagtcaaaagatgtacttactgaccattttctgttcccatgagactttatggtaaattatttaaatactaaagcataattgaaagaacatttatgatatccagaagacattaaacatacaaattaaactccacccgttggtagagtatactttatctataatcaaatttgttaatttaagtaaaacatttacctgctaagcagtctggaccaacaaggaaagaaaataccaataactcatcttgctggctttgagcctctgttcttttcaaatcacaactgtgctagcacattgagcactatcaatatcctcagccaggtatttttaaaaattaataatttaactaaagaaatgttaggacatattactccagaatatcaatcaattttaattctacaaaataatatatgcatgctacatattgcaaaatagatgttcatttataaaattaagtcatattcactaatgtaattacataaaactaataacaaaaagggggatttaccgcctgttctgaatttaaatccattttcagcagtggttttcccacatgatttttctggacctttgagagaatatctttcacctaaaagtaaatataaaagattgtgaaaaatgtatattcctaatttaaaacaatcttatgcttgtttaaagtatcgctctgaacactacagaataaaatattaaagtgacataattaaaatataccatcatataccagaataccactacaatacagagtatctttttcaaaaaagcacattatattcattcaagctatagagcacattctttcccagcgtaagaacgaacatacacagacagctaaagaagtacctaggttctactatgagaatctgtgtcttagtgaaataactttggagttcctacttaagatagcactttcttactttctagtaaattttcaaaagggatactaaaacctttaaccagcacattgatttttctcaaataaatgctatgtacacattccagttgtaagtactcttgtttcattgttcagcaagacaacataagggagcaagccatctctctcaattacagtcatcacatacatattttcattacttttgcaaagcccctaatttaaattacttgaaacatttttattttgataaacaagatattaggcatttacttttcctttagcaatatcagggtcattcaataatttatcctcctaactaaaggattaatttaccttcctgactggagaatccatcattagctaaataaaatatttacaaaaccaaatgaaatacagttttttttacaaggtaaccaaaggaaacaaccaagggcagttcagattttaaggagcatgaagcttatttaatgttgggggcactctttaaggaaagaattcaaaattagcttggaagctggggttgtaatgtggagtaactgtaaatgggcacagttgaggtttcttctgagggtgatggaaaagctctaaattcaagagtttggtgatggttgtttaactctgtaaatatactaaaattcactgaactatatatatatacttaaaatgggcaaactttatggcatgattacatttcataaatggtgttttaaaaaaattagcttagaaagaacctgtgcaaataagagaccccaaaacttcagctttagtagcttcacagcaaatctacatctacaatgatacaatttctctactgatacaatttgtacatattttaaagaaattattaatttattttcttaaaatggaccatttctgtagattctccaactgttgtaaatatatccaattttaggttttttcatacattataaaaagtatgagttgtaactcctcactccagaggaattctcaatgtatacttgtagtttgttacgtgtaatcacattcagctccattcctaggattccaacattacgtaatagttttaataaatctgaaaatcacttgttatagagtaagttaagggcacaggctctggaggttgactacctgggtttaaacctcaggtctaccaccatttagaaatttgcttgtttaacttattagatctttcagtacctcagtttcctcacatggttgtctaggtaatacaacacaggggtgatgtattacccataaccacgggtgatgcgagaactgagttattacatgtaaacatttataaccacctcacatgggtgatgtgagaattaagtgagttattacatgtaaacatttagaacagtgaatgctatatatttgctattataccatcactatgtatctgttataattataccactataaatacacatttgaacaacttgaagttagaaaataatactttccttccccaatggtaacaaagtgtcttctggacacatcacatgcagaagaaagaaaacatgaaaatgtttacttttggttaaaaactgaatagagtaggaagaccttttaagtaaatatttagccaagatggccatagtaacaactaccttataattagcatgccagtatttgaaccgaggcattacagactacttcaagtagggcaaagaggtaattgagaatgttaatactaaataaaaaccataaaacggaatagcctctttgaattataatgagctcagaaatctgtctcaatctgaaatagtcccagaaaatttagccaaccccagatcagtcttcatccagaggaaaacagaaaaaaattctgaagagtaacttgttaactctataagaatgtttttgagctgattttcacagacttactctctggtttgcaagttctaccaaaaaaaatttttttaatattctgtttttatcttaatgatactataattctcttacattaagacaaaccttatttttcagttcataaattatcaacgcaaaagagatctttactgaacaaggatttaatttaaggcactgtgtctaaaaatggagttatgtacttattcttgaagattaggcaagaattttattttcctttaaaatgaatcctgtattcttcccctagaggactgcatatttaacaaatgaaacccaggaactaggccagaatttggtctgtgagagtagcatcctctctaatatatggcttgacagggaacaagagttgcttagtaactgaaaaaaaaaaaaatgccaaagtacataaggtacatagtttgtagttgtttttaactacccccatcagggtactaattaatacattcttccattcattatataatgcacttactcttactaaacatttatccaccaaaaactgcatgctcactgccaaagaaaccactctgcaattctattaacatccattttttaaaaagtttagtttcctttcactttgtaggataactctacttctacttctttctttctttcttatactacattaaaaccctggttaagaaagtgatccttaaatttgctaagtgatttctatcatggtaaactctggcaaagctgaaggccagtaactcattaagatttgattcctgaatatcagctactgacagattaggtcacatgcctgttaagtctgaatccaaaactgggtttatatgaagataaactcttgaaataaaatgtatacctcataattatagggaatagtttcatttttaatatagcacttacatgttaccattcagttgaattttggggaaaataaaacaaagataatacctttgattccacttggtttagcatatgcggaatgtcagaagttgttgacttgggtataccaagtgtatcaaacatagcttgaacttcctgataaacttcactatttttatctaattgagaatttttatgtttcttgttctgtaatatctgtgaagcttgaagttctgtacttaaaaatactacaataaagagaaaataaataatgttaatacatgtataagaatctcttgaaatatttcactgaaattattcacttaaaacaagtatcaattaataccaataatgccaacttacaaagacccaaagaacaacagttgtagaacactgtacacttataaacgaagtgattccctagtccatagcaagtgttacgtttttttaaatgaaatgagaaaaaacaactaactaaagctatataaaatagacaccctattaaatgcatttacactgtaaatgccactttaaatggttgattcttttcacaccggaggagccctagcagctcctactggagttaagcaggcaaagatacaggcccccagaaaacagcagcgtaactttcatctactttacctagagaggtttaacctaagacttagtttgaaacagatgaatgggtacaaaaaaaaaaagggcactacaagcaaaaaactaaaatgaatttatttaatactaccaggaaaaagagaaatggtttattttattctcttcgatttcacactagctggtttcagttcaattttaattaacatattaaatgatctagattgctatttcagtaagtacatgtctaccaaggacctgttctgagccaggaacggtgtgaacaatggggatgccaagtcaaggaagatatgatgcctaccctcaaagagtataaaatccagtagttgagacccaccaccaaatcaacaatttaagaacagacaagaatgtgtaagactctgataaattattctctgtcttatatgtacagagcacacaggtcaggggagaacatatagctctaactgatatataagcacatagagcaatttgagtcaggataaatcaccccaaactgtttacaagtccctttactttcaccgtttcatctaatcctttcaatagccatatttaagaaaattactcaaaaatcttaaatgattatagtcttgttttaaacagactcttcactacggtaggtaagacttcactacttcactacggtaggtttttggctgggagtggtggctcacacctataatcccagcactttgggaagctgaagcaggcagattacccgaggtcagaagcttaagaccagcttggccaacatggtgaaaccccgactctactaaaagtacaaaaattagccaggcatggcagcatgcgcctgtagtcccagctactagggaggctgaggcaggagaattgcttgaacccagaggcgaaggttgcactgaatcgagatcgtgccattgcactccagcctgggtgacagatcaagattccatctcaaaaaatacataaataaatactttgtttttatttgtttagttaaaattagacacaaacgccacaatttaatatagcagttttaacttcagctgagcaaaaatacatctgaaaaacaatttaaaagtacaggtgccagggtcccatcctctgagattctgaacagtagatctacaagtaggagttgggcatctgtgtgtggtttgttttagacccagtatgattgccaaggtcaggcaagattgagggtcactggtttaaagacttttccatgcagtctacacatgacagtttaaagagtcaagtaccaaaatattaagatcaattattaaactttaagaccaatattaaactttccttatgaggactatactaaggtccttctgacttaaaaacttcattaagaccagctatggtggctcaggcctgtaatcccagtattttgggaggctaaggtaggaggacagcttgggcccaggagtttaagacctacctgggcaacacagacccatctttacaaaatattttttaaaaatttgctaggcatggtggtgtacgcctgtagtcccagttatgcaggctgagatgagaggatcgcttgagctccagagtttgaggggctacaatcgcaccatcacactccagcctgggcaacacagtgagaccccatctcataataaaaacttgattaaacttgattaaaacagattgccagtttttcaaaaatttatattttagacagaaccttggctgaagtctacttttgctctatggaaacatgctttctccatgtaatagtacaaacaagggtttagcatttacgatgctaatccatgcagatagtaagcagtagagggaaaattaagccttcttccttttgcagatccttagattcccccttcccagaggcaatcaccattaatttcttgggtatccttttaggcatgtgtgtgtgtatgtattcaagatacctagtagccatctgtgtgcgtttgttccttttatacaaacaagaacatgctatacatgtcctgtatatttattttgtatttaccaacatatcttagagatcattccacatcagcacatttgatttatctgcattcttcctattacctatctagtgacatcactgcattaatgtaccacttctatttatctatatttatggacactcaggtttctggtctttttattactacaatgtcataatgaacatggttttcatttatctttgtacacttggggaaatagatatatattcatagacaaacaattgccaagtcaaaagaattgccaagtccaaaagccaagtgaattttaatgtgacattgaaaatgtgtcctcctaagaggctgtacaagttattctcccaccacagtctaatgtctgtagtatacgaaaaggcttactcccccaaacttctattatgattttttgagtgaaaaatggtatcctgtcataagtgatattgtgcatcttgtcatgcttagaagcagttaaaaaaaaattttctgtagaatgcgtgttcatgtcttatgtattttacacattttcccagtggatttttatctttttcctgttgatttataaaagctctttacatagtacaggatttggcccttttaattttatacatgttgcaaacactttcaaaaagaacatgaagaagcttattatatcaatatgattaaaacagtcaaactgaagaaagactagatgctggtaagactgtgaactagtataacctttctggagcaaaatatggcaatatacatctagaccggagactattttaaatgttcctaatctttgtctaagtaagcaaaaatataaacaaggaaatcattttaaaatagaaaaaaatccaaatacctccaaatttgaaatctattacacataatgttatgtcaatagcagagccaatttagtttttcaaaaaacaagtgatagggaaataaagagaaaaacgacacatcaaatgaagaggaggaggagaaggatctgaaacaggatcttaatcttatttaagagtgagtgcgagtgtgagagtgttgtgtgtatgtacacagaaaacagagacacaatattctctctagggagtgagattataaatgcttttcttctttatgttttatgtattttctaagatttctatgataagcatgtaatttttgcacatataaaatttaccattttaatcatttttaagtatacagttctatgacgtcaccatccatcttcagaactttttcgtcttcctcactgaaactctgtacccattaaacactaactcctcatcaccgccctcctgaacatgttatttttataatcagaaaaaaactatatatttctgttaaatttcttttttattcctacttgtaccagaaacctgtatcactacaattgctaagcttcttagcagctaaggagaaagggaaccatgatggattacataattctcattgactgatattaaggatatgcaagttcctctagccggtgtttcctaggttcctttctgtcccaatatacctaagagttactggggatctcccaataacagtggttcattaaatcagtgactcacaccaaatgggaggaagatggagaatggtgtattgggatggagagagagggcatataatttttatccccactcaacacacacaaggtaatttcaatgccaatacttttgtcaccactaaacacacacacacacacacacacacaaatttcatctctaatgaaacaaactttattaaaacactagcgcctacgaggaatatgtcacgtgtaatctttttataaatggcatgatctgaaatagaaatcttcaataatagaaggtattagaaaaattctttcaaatagtcattgtttgtagaactttaaaaacattataaaattagcctaaagtaaaaaaatgatgaaaggaacccaacacaaacatggacctactatttatggtaattgtttgaatacagtatgacctatattccaaatccctccctgatgaaactggccacatttaaagtgtcctaaaggcacaaattttatatttttttaaaaaaaacaaaacaagcaaccctcatatatccctagtatccagagcagttcttggtgttagagtaagtgatcaacaaattatcatccagtgcctagtttcagagagtttttagattaaataggactttggagatcatcaatgttagccatatagtcacgaacaataacagatagaatgagataaaggaaaaattactaaagtactatataaatcacaaacacaggacattctatattggccaaataaatcacaagtgttagaaggcatactggtaaaatttatactatattatataaacatttctgagatagctttgtattttaagtaaaatattaaaacccttttaatatacaaaatgtctaatgcttcattaataaatcttgacttgaaaataataaaaaccatgtcaaacacatgcatttaaatgttcaagataacttacatagaagtttcaaacagtcctccttcttttttaaacgatctttaatatctcctgatatgagtacagaatatggacatgccatttcttttaaaaagccacttatctcaagctggaagctctctagatcatctcttcctttaaaaaagaaaaatcataaaacatttactgagcatttaccatataatccaatactataaaatctactcgtttatttccattttacattcaattctaaattttcacattaaatccttaaatgtgtgatcacgaagcttacgttaacaactgaaatagtaaaagcattattatggctataattattaattcacttcagagcaaatgatccatttctactatatttctatatattcagaaaataaatgcaaccatctaattaaccctcactgcttatctttatttcataatgtaattatgtaggcagtcgtgttatatgtttagaattcaaattagtttactttgcatcaagtgaactgttagatctggctgggtgcggtagcccacacctgcagtttcaactacttgggagggtggggtgagagggttgcttgagcccaggagttcaagtccagtctgtgcaacataacaagaccccatctcttaagaaaaaaaggatacttttcaaagaaaaagctacttttgtgaatgcacaatttttaatttttctttttattatactattaatatccgaaattctaccaaagacccacaggactccagttactaagatggtaatgaactaaagaagctttatgagctagtacagaagtttttaatagaagtattcctatgtgaatccatatcctgagctacaagcttcagaacacaaattaggaattatatatatataatattttaagccttaattcaacatgagcaccattcaaaaattaaacttttaaataatcaaattcagaccctactttttctaaaaaacaatactaaggtttagacagcagatatcagagccgtcaggaagagaaaaaaatagcagataaatagtaattgcttatagttttatagcaaatttaaatatcaattctggattaatataaaatttaatccaaaaatgtttactaccacatactgaaattctttggaatatgtgatttttctttgtacagtgggcacattattgataaaactataaaccgtaagttatcagtttactattaaacagaaaagtaaatacaacataatggcaataccagcagacgtgatactttcttccaagttgcataatgattttatttgagagcctaaccaaatacagagctctgaaaattcaggtgaagataatccaccctctgccgcctttgtaagggcttgctcttctaacaatggtcctttatacctagaaaggaagaaatacaagttaaaaactaaataagccaatcaaacaaaaaaacctccaacactctgtgtcaaggtctgctgcttgtttttgtaaataaaatgttattggaacacagccattaaatgtattaatctacaaattggctacggctgtttccacactacaatggaagagctaagtatttgtaaccgaaaatgatgactacatggccttctaaagaaatggtttgctgattcctgctctatataattaacatttggcttttttcctatgttttaacattttacagtaaaattatctaccaattttcagataaataccacaggtatcacaaagtcaaatacagcataaagtctaatagccttatattaattacaataaaaatatggtgaaaaaagcacagacacaaattacaaatttaaaaaagctaaagttgaaaagaatctattagatcattttaatctaaacctattttatttattttactttactattttattttattttattttattttattttattttattttatttttgaggcagggtctcactctgtcaccctggcaggagtatagtgacacaatcttggctcactgcaacctccacctcctgggttcaagggattctcatgcctcagccaccagagtagctaggattacaggtgcctgccaccacacccagctaatgtttgtatttttagtagaaagggggtttagccatgttggccaggctggtctcctgagctcaagcaatccacccacctcggcctcccaaagtactgggattacaggtgtgagccaccgtgcctggcctcatttatttataattttacacttctaaacatttctgcaaattgtatttcacaagaatcttaaattttcaaaacactttatatactatcttaactgaattagatgatcagttttctacttttatggttctttttgcaactgaacttttgttaacattataaagtcacagataatatacttgatgtgttttaatccatcacagttattcttttgatactcaaattcttctgtctctggtttatagtagcccattcaggtaggccagtcgagccctttgtcttgtcctccgtactctctgaatactttccttgctttctacaacaacatcttcctgccttagacttggaatcaggcatttctccaaggagccccgattcttctaatggtatttagagtacataatctgctaccaaaggttggtcactgtttctatgcctttttcagagaaactatatcagtttcatattgctatttccaactggaatttagaattgtaggggttttacttattttgttttacgtttttatttatcttctcttacaatgacaattcttgttttaataacatttacaaattcctaatatatattaaaataggtataaattacttatggcttcagaataggaaatccagcattactactaacaataaaattacagtttaatttttttatatttacgacgtattcctgtaaggatatacagaaaaacaattcccatgtgattaaaccacctactcaatatatcaatagacatttgttttgttcagctttaatttgtagggatttgtttctttttatttcatttttgtcttataattatgtaaaacattaatgcagtttcaaagtctaacttaaaaaacaaaatgcatcagaaaaatctagtttgcaattttaatcttgtatcctctactctgttctctccctcccctacaggtgaccatatttattagtttggggttgtccttccatcatgtttttcagtataaatatatgcatttttgtctccttttccagataaaaggtagcctactatgtactgttctagtccttgctttaaacacatacatgctcacacacacatacatttacatagagtagagatcaatatttagacatagtattcaaccatttttacagttatatactacctcactgtctggatgcaccatattttatttaatcggcatctactaaaggacacttggattgtttccagtgttttgttaatatagtttggcaaatttttgtcagtttttatctaggatagattcctagaggtgagactgttgggtcaaagggtaaatagatacataactttgccagatactattaaattctcctgtagaggggttgtaccatcaaggtatccgagtacccattccctcataattcatcaaagttgtcaaacttttggatttttgaccatctggtaactcagtatagttttatctacatttctcttacaagcaagacgtagggtatctttgcatatgtttaaaggccacttgcatttctttttctttgaattctctggttatatcagatgaagggtaagtacaagtattttcaaatcctcattttgtaggtaaagaaactaagacttcatgacattaggaaacctgcctttatgtagcaggccaggcacagtgctaggcatatatatatatatatatttcatttaatctttacagcaatgctttaagttagcattatcctaattctgtagaatcagaaaatggcactaggatttaaatccacgtttaacccaaatgctccatcattaacataggtcttgttagacctctgtctacaactataaggaaactaaggaaataatctggtccagttgatacagccaagtaaaggcagagctgagactagaatattatttctgcaccccccagctcaaggctggttcttctatgactcagccttcctctatgtcttacaatgcctctcaatgagatttcatagtaaacatcttatatcctcttatttgctttcatttctgcaataaagcaatactcataaactcttgaagaaatttaattcatattgatgtaagtttttttaactgaaatgtcaataataaaaaccaacaagaactgatcaaatcacaaaaaattctgaatttggaaaaaaaaatccaatctttaatgccttagctcatcagatgaagtaaaaataaaaagaggaacaaataaatgcatttaacatacctgaccatctagtaacaatcaaaatcgcaatagtggctaacatttagaaagtgctaactgtatgttgggtcagtgctaaacaatttatataaattgtctcatttagttgccacaataccctataaggtagatactattattagcttcattttacagatgaggaagctcaggatgataaaggtaaataattcatccgggatggccataatcatagctaacaactgtcccggaactgagccacacaacctacctccatagccccacactcttagcctgtattgttctgtcaccatccagaaatgtatctaattgtcttaggcaatagaagtgtctaagtatattctgctagataaccgaataagaatatgaaagcacttttctggctagaacagtacttcttaaacttttatgtgcatatgaatctcctgagggtcttgttaaaataaagattctaattcagtagagctggaatgatgtctgggattctgcatttctactccccaggtgatgatgacgctgctagtccacagacctctcttaagcagcatagtacttatttttttactttcatttaaaaaaaaaaactctcaatatttatcatcactccttctcctcttgcagtacatgagaaattacagcaggcatttaagagtctatttatgctacatttagcaactgtttagtgtttaccacatttatttcatactggctttgatttccaatgccattctgcgtttacagagaataaccatgctcctagtttgttctatatattcttagttattcatcaaagtgctactgttattccaaacactgggaacatctcccctaggcctaggccctccctcaaagcctcataccctggaagcatagttgctggtcagacactacttcaagctgggtgatccaaatcttcagtccattagggctgctggcaactctcctcaacaatacaaccagggcctaatttactttctattttcatcagccaagagataaaacagaagaccctttcttttcccatcatttacccaacctattgtctttgcccctcatccaactctctacctctctctgcttcctaaaaatgtccactatctttcatctacaacacagtggatattttgctatactgtccatttcttctcagaaagattattcctctcttgttttcactctggattctccattttggacccaaactgagaagcccagagctgctgctaggagactggagccagcgtacccaagggagcccatctccgggcgcccacccttggtacaggccacctcgcttcgcagcccagggaggaaaggagagggggtatgtaaacagctgtgggagtcgggagtctcaggagttgcagcaagcccaaacccaggccccccagcccagcccagaccatgggctcactggttcttccacccaaccagcccgcacctgtggaattagatggagcacagttccatcatcacccaggcacaggggaagatgccctggtgctcaccaagcaaggcctggtctccaagccctccttaagaagcctcgtggatataacatcttcaaggcccttgtctgctattttcgcatccagcatggccagtcaagctcttccactgagctcatccatataaggaggaagccaacaccactgctaagtcggatctgctccagtgtctccagtaccagttttatcggatcccagggacgtgtctgccccaaggtgacagaggaagatcaaaggaggatctgtgtggtcactgacctggatgaagcccttgtgcatctttaagcccagcaacaatgctagcttcacagtgcctacagagattgaggagaccactcaagcaggtttctgtcctcaaaagagctcacgtggaaagagacgaatgagagaactctttgaatgtgttcccttcactgccaacctggccaagtatgccaaccctgtgacggatctgctggccggtgtggggtgttccgggctcacctattccatgagtcctgtggttccaccagggctgctaagtcaggaacctcagccgcctggggaggaacctgaggaaaaccctcatcctggacaacttgtctgcttcttacatcttccacccagagaatgcagtgcctgtgcagtcctggtttgatgacatggcagatactgagttgctgaacctgttcccagtctttgagaagcagagcagaggacgtctataccagccttgggtaggggcaggcctcttagccttccctgcttccaagcagtggtcatcccagtaagggtctttcctatgctgtgcctttaggatcacctgacggacagagtgaaagctggagggcctcaccacatgggcctggaaatagtgagaagtgattgtaaggagctttaggacagcttagatgccaagtaggcaaatgccagaccaacaatacccagaactacctgctcccgagttgttgggttcccgagatgtgtgtgtgagtgtgtgttctgccatgaactgtggccccagcatatagcgtttcagtgggggagaagctgaaagactcttggtctttcaagtcgtctcctctcctgtcaccctaaaagccactgaactctacagggatgaagactattgaagactccattgccaaaccatgacctttcctcagtgttataaagcctatgccaaggaaaaaggaagggtatgcctttgggtgctccaggtacacacctttccaaaatctttctccagccagctgctgcagacaaaaataagacatttctgggaagatgaggacttgtttccaggccagtaccccagtggccatcaggtcttgtggcccaaaagctacgcttgcctctagctaagtgcctggcatgggccctttctgtgtctccccaaggttgggtactgagctcccttcttcaccatctagccatagtctcgaacctatggggaaggaggttttctccccaccctggaagagaacagattactgatttctgttcttttgactctgaaaattctctttcttaaaaaaaaaaaaaaaaagtaagattgttattcctaccatctctagctttaattatttttattttcacaaatgccttaaggtcagatagtaggagttttggcctcctttcttaccaaaatagcatcattatcactgctctcccattatcttataaatatctcctatttccttgaggcacaggccactcagatttgccacccattcacttgtggttttcatctattacctcttggacactccccaacatcccctttgctcagttttcctctccacctctattcttgccattacactgagtttctttaatgtctgtatgtataccctatctcacaccctgagctctcaattccaacctgcacatgtcactcagccccccttgcacccttgccattacttacaaccactgcacctccaaaatcacttatccaaacatgtggctccctgaccacaacctcttatttatccttccacttgcttcttcgaccactcacctataactattctttgatatcatcattacctccattcattgattcctctgcattctccatatttaccaactctctcctatcttcacattcttctgtatccaatttagattctaaggtgtatcatttcattttggtgctcaataaataccaactgaagaaattaatctgttggggcgtggtggctcacacctgtaatcccaacactttgagaagccaaggcaggagatcatttgaggccaggagttcaagactagcccgggtatcataacaagaccctgtatctaaaaaattttttaaaataaagagaaatgaatccttgaattttaatatccaatcaatcactaagttcagtaatgtagttcttcccatatccactgccactaagcaaccatcatttctttcacagactattaactaaattctccaatctattttccatcttgctgacagatgtaactttcaaactagacatctaaccactccctttttatttaaaattattcgatcacatcccattgctgttatgatcaagaataaaatccacaacacagactaaaaggggctgcatgccctgattttcacctaactcttgaatccaatttcccaccactctgcccctcacactctgccttccaaccacattagcctccttccagttcttctaatacagcaagctccttcacatttcaaagtcttcacattttcttctcactgtaaggatatctttgtccccctttttcatccatccaaccttaactacttaatttctattcacccttcttatttcaactcaaatgtcacttcctcaggaatctatcactaacccctaagacttcttagatcctcctgttacatcaccctgttcttttcctttgacacatttattatagtttataattgtttttgtgatcatgtctgtttctccactagattataaactccacaagggtaggaaccaagtctattttgctcaccactgactcctcagaacgaggtccaatatacagtgtgttcaataaatatttaaaggaaacttctctccatagtagtgtttctcaactgagtctgtgaatctttttaaaaatatgcaggtctgtactgtacctctgaagattatgattcggtcagtctatggtatatactagactggaacagtttttcacaagttccacacgactctgatgtacttccagtgttgagatctactattccacaaaatcagagactatcagaactgaaagagacttctaaaatcatctgctccagccctctcttttcacagatgagaaaactgactgactcctagcctatcctgttttcacctgtatcactaaattgtcctttcacatagatttttcccttcaaatgcctcccattaatttattttacatgacaaactgaagtacctttgctgatatcctcaataccttacaacagaaaatgcattattcactatctacatggatatttgaaaacacagtgttccattacaacacatattgtaaataactacttttttcacatcgtattatcataggagaattcaaacttcaaaatgttgccctcatagttattccaggaaaaactaattttggagtgtgtaaactgttttactttccatgttgaataatctgactaattttccttgataaaaatcaagattatagcaatgaattttctaaaacacttataatatgaacaataagttcaagaaatgaagaaagaagaaaagcactgccttttcctttttcataaaccatttatgagttcccaatattcttacctgaagtacttgggagctcaaactgtttggagcctaaataattctactaagtattttcagttcttgttttggttccttcttaaccaagttaagtgagaacttccaagggacttcacagaagtaaaaatgccccctaaataatcaatggcactgttctttcgtttgacaaatatgtattcacgatctactaagtgcaagactccgtaaccctgggtcactgcaaagtaggtattatcagggttcaactaaagaaacaattgatagaggggcaaatgcagttttagagaagataaagtggggtgtgggattggttcaagcttcataataacgctgcaaaggcacagcttcccctatcaagaaacagcagcacgtagcagggcaaacaaatgtgcagatggctccaagctctttatttaatgtgcactgtatgactcaactatctggtcctatgcttactgctgtggactcttctctaagcttttcttcattcatttactcattcattcaaccactatttactgtaaaagactccgttctagtgtgttgctgggaaaacatcggtgaataaaatatgcaaagcatcagtcttccaggagctgacttggggaggaggaggaataaaacgagggagaagcagagttcaagagacaaatgaatgggcaggacatgataatttgggatggggacaagagctgtgtggaaaaaaacaggatgaggttgagggggagattacgaaccaccacacttgttaagtattaacattactcccacctccaccctgagttctcacagcacttaccattctgcactgtaaataccagccggcagcagacttgcagcctgcgcgactatgtaagccaagagtaatctgaaaaactatccttttcccttgcctaggggaaatttacaaacgtaaatatgtgtaaattaatatacaagctaatatacacgttgacgaacggacgaaatggttgaaagaacgaactcgcaatgaactacaacactttctccggtcaaagtaaaagccattcgctccagagccccaagtaagccacaagttgtacattgtaggagacaacagtcctcaacagcagctcaggttccagcacctccctccgggcgccagaactacgtcaacacaaatatcacctgcgggcgcgagctagcccagaaaaccggtgctagaagggccgctccgcgccacccggcggattcctgcaacagagtttcgaggcaagaagtttcgaagagggggccacgaaccccagctctccggccctgctccaccccccaaatagatttctctcccgcctcccgcttaactccgtcggcgccggagggatcgaggcagggaaggaggcctacacatggccgcccaggcccacagaggcccaagggaagtaggctaagcagccaggccaaggagaggttgcgttttcagggaaaaggcgtctccaaaagcactcaccccagcgcctccagtgtgtccagcacgtctccctccatcgtcggttggggacccggctccggccctctcatggtcctttggcccagagctgttcggcgctctaagtagcccgccggaaactagcgtcaccgcgccaaggttccggtccgggtctggccggtaactgcctgagagcacagctgaagaagggcgcaaaggttcccagccccgaggcaataaacacttcatagtgcctaaaaccgctgcgtgtaacgataataattttttaaaagaatagtagaaataataaataatagtaataaagagttctctgtgttgggacttttctgtgtgttcaaataaattttagcaaatatcgtggtatcgggttgatctcaacctatccgattccagacctttttaataacagaaatctgaaataaaattataattatcttcagctaaaattagtaactaatatcacatgcctacacatataatttttaaatcaatatacacgacgatgcttcaacttgaaggaaaaaatgaagtaatttataacaaggtaatatttttctccttatgaaatgcggaagaccaatgaagtgatcagatgcttgcatctatctatgtagaatcccctcaactgcatattcagatgatgtgcttcattgctgacaaagcattagttgtataagcaacaaacataccgccagcaaagtaaggtagttgatgtggttttccaaaattgtggcgaattctctgtaaagttccaaacaaacaaaacataatataccctctgtgtactatccatgaagaattcaatctcttatctaaaggatttaaaaaatgtattttagggttcatatgtaaaaggtactaagagtataaggttagatcattattagcaggcatgtcacctacatgaatactctagcagaactgttggaaatcctgcatgaagtataactattgatcccttgtatggacctgtcccttccattgcagactacatagcattcgtagccccagtccaataaagaccagtaatgctctcgccttcctaattatggttacaaacaaaaagcatacccataaatgtgtaaaacactcaaaggtaagctgtagtagtccactctcatattgctataaagatatacctgagactgggtaatttataaagaaaaggggtttaattggctcatggttccacaggcagtacacgaagcatgatgctggcatctgctccactcctggggaggcctcaggaaatggacagttgtggcagaaggggaagggggagtgcagctatcacgtggccggagtaagaggaagagagagggtgcagggaggtgccacacactttttttttttttttcagtctcgcactgtcgcccaggctagagtgcagtggcatgatctcagctcactgcaaactccgcctcccgggttcacgcgattctcctgcctcagcctcccgagtagctgggattacaggcgcccaccaccacacccggctaatttttgtatttttagtagagacggggtttcaccaggttggtcaggctggtctcgaactcctgacctcgtgatctgccacacacttttaaaaaaccagatctcatgataaactcactcactatacagtgccaaggcaggaatggtgtcaaaccattcaagagaactctgccttcatgatccaatcacctccctccaggtccctcctccaacattggggattataatttaacatgagatttgggcacagacacagatcctaaccatatcataaactcaaccatacatttgtataatgactattattactgtatattttagtgttgtacaaggcttaagcgtaaaattacttgcagtttaatgtatctgaattcatctccaaataagggagaggagaatgtatattagtggttactgcctcttgtcagagttggggtgtcatagaaggtactagtcttagtactcttggcaaaaagtctctgtaaaaatcaaatagaaatgaggtaactgttctttattattattgatcttaagtgttctgctgctggttttcctaaaaaatctaaataaatgaataacaaaagttatgcacagaaaaagaactaaaaacaaacaaaaaagcatgactggcctagcatggtggctcgcatctgtaatcccagcactttgggaggctgaggtgggaggatcacttgagtccaggagtttgagaccagcctgggcagcaaagtgagaccatatctctacaacaaatttaaaaattagtcaggtatggtggtatgcacttgtagtcctagctattgaggaagctagggcaggacgatcaggattgcttgagcccaggaggccgaggctgcagtgagctgtaatcaagccactgcactccagcctgggcaacagagtgagaccctatctcaaaagaaaaaaaaaagcatgacagatatttgaaaaaactgaaaaggtctaacatagtaaatggaataattggactccaacaagacccttgaaaaaatgagacagaagcaagaagagactctgctaaaaatttcctgacaaaacactgatccaagagcactgttaatgtcaaccaggacgtatacaaagaaattcacaatttaggaaaatttttgtaaaaatgctgaaaacaaaagatagaaggaaaagcttaaaagcagctggagaaaaaaatcaaactttaacaataatataagctgacttctcaaaagaaacaatggaagcaagaaaatcatgaaacaacatctttcatatgctttaaataatgacaaatccagaattttacacagtggaaatatccttaagaaatgaaggcaaaataaagatgttttcagataaacaaaactcatgtaaattgtttccagcagacccatgtcaaaagaaatattaaagagggttcttcgggttaaaaaaatgatgccagatgaaaaaaaaatgatgccagatgaaatcccaatggtgcaaaaaataatgaagagtatcactggaaatggtaaatatgtaagtgaaactagatatatattgactattcaaaacagtaatagtaatgacttctgaaatgtaaaatatagagagaattcagggggtgaggtgctgacaaagagtttaaaaacaataatgttcttccattatccaggcagtggtaaaataatgaatttatggtagcaaatcaagattgcatattgccatcatttaggtaatcactaacagaattatgaaatagtatataactaacaactaagaaaagggagaaatggaataatgaaaaatacttactaaatctaaaagaaggcaaaaatggaagataaaatatcaaaccaaaacatggctgggtagcaatattaatattagaaaaaatagctattaacacagaagcattataatattacagagagataaatagggacatttcataatgataaaagggtcatgacgcagaaaaccataagaattctaaatgtttatttgcttaataaccagcctcagagtatataaatttaaaagccaacaacttaaaggagaaatagacaaagtcacaatcacattaactaatataacaagcagtcaaaaaaaatcagtaggcataaaatattccaagtcaataagacttggaaaacataatttataaatttgacctaattgatatagataaatctctacccctcccaaaacttcagaatatgcatttttcaagtgcacatgtaatttataaaacttaaccctatagtggatcctaaagtaagtctcaccaaattcaaaattgaaatcataaagagcatgttctctgactaaagtggatttaaaatacgaattaattcccgagtatgagattgtctaacaaaaaaaataaggaattaagaatttaaaaagaaaactaaaaaatcccttaactaattgatgggaattcaagcaatacacttctaaataaccaggcttcaaactagaaattataatggatattagagagttttgaactgagtgataataaaaacacaacatatcaacacatgcaggattcaacatatgtggattcattcttagaggaaaatatatagcattaggtgtgaatattagaaatgaaaaaagattaaaaattacttaagtatcaatcttaagaggctgaaaaacaaatgaaatccaaagaagcagagaaataaaaacaataaagagtagacaccaacgaaataggaagaaaatgcaatagagaaaattaagccaaaatctgagtctgcaaaggctaataaaattgacagatctttagcaaggctgatcaaggtgggggaaaagaacaaccaaccaatataagaaatgaaaaatatcagtactatttatcagacattaaatagttaaaagagaatgttatgaacaactttaaatttaaaaatttaaaggaagttgataaatttccttgcaaaatacaatttagcaaatatcagaaaaaattaaaatatgaatggttcagtatcctattaaagaaacttaatcactaattaaaattctgccacaaagaannnnnnnnnnnnnnnnnnnnaaaactccaagcctagattgctttcctgatgaattcctccacataagtagcaccattcttacacaaactttccaagagaccaggaaaacatggagcattttcaatgttttctgtgaagacaacctaatcttaaaacaaacaccaatgaggacattactaaaaagggaatctgtagactaatttccctcatgaatatagagctgcactttcaaagtcacctaagtaatgaccaagttgccatttcagttcaggccttttcaacatacagtgctggcaatgggatatccagatcttcacttcaacctcatgctatacacaaaaattaactcctgataatggtagatgtaaattaaaagagaaaacaataaagtttttaggagataacataaactgtcttcatgaacttgagataagcaaagatctctaaatatactggttagggcttttgtgtcctatttcagaaatcctttgtggccgggcatggtggctcacgcctataatcccagcactttgggaggccgaggagggcagatcatgaggtcaggagatcgagaccatcctggccaacatggtgaaaccccgtctctactaaaaatacaaaaattagccatgtgtggtggcgcacacctgtagtcccagctactcaggaggctgaggcaggagaattgcttgaaccgaaccctgagaaggaggttgcagagagctgaggttgtgccactgcactccagcctggcgagagagcgagactccctctcaaaagaaaaaaagaaaaaaaagaaaagaaatctttgcatattttacagaacatgatgatattctatattatgttggcaacttggtctttattaaattaagatctgaaaaagattccattaaaaaagccagaatgcaagctacacaaatgagagaaaatatttgtgatacatgtatttgacaagggactcctattcagattatgtaaagaaatccttcaaatcaattagacaaagacaattcacaactaactcaaagttgggagaagaaaagtggaaaaaagagttgaataaacatttcacagaagagaatattcaaaccaccaaaacctacacgagacagtgctcaatctcattggcattagagaaatgcaaatccaaataatcaagacatattactacatacacagaaagaaaggctaaaatcctccctcaaacaaacaaacaaacaaaaccttgacaatatcaaagattggcaagaatgttaacactggaactcttatacactgttttttaattaaataatttagtttttttatttcaatttttttggaatatcagtggtttttggttacatggataagttctttagtggtaaattctcagattttagtgcacacgtcacccaagcagtgtatactgtacccaatatgtagtcttttatgcctcaccaccctcccaaacatagtttcccccaccaccaccaaagtcccaccaccgtgagtccccaaagtccattacatcactcttaggcctttgtgtcctcatagcttagctccctcttaaaagtgagaacatacaatatttgattttccattcctgagttacttcatttagaataatggcctccggctccatccaagttgctacaaaagacattatttctttcctttttatggctgattagtatttcatggtgtatatataggatattttctttatccactcattggttgatgggcacttatgttggttctatatctttaaaattgcaaattgcactgctataaacttgcatgtgaatgtgtctttttgatataatgacttcttttcctttgggtagatacccagtagtgagattgttggatcaaatggtagttccacattttagttctttaaggaatctccatactgttttccacaatggctgtactaatttctgttcccatcaacagtgtaaaagtgttcccttttcaccacatctactccaacgtctattggtttttgacttttaaattatggccactcttgcaggaataaaatagtatctcattgtggttttaacttgcattctctgataattagtgatgttgagcattttttcaaatgtttgttggctgtttgtatatcttcttttgagaaatgtctattcatgtcctttgcccattttttgatgggattatttgttttttttcttgtttgagttctttgtagattctggatactagtcctttgtcagatgtatagtttgcaaatattttctcctactctgtgggttgtctgtttactctgctgattatttttttgccgggcagaagctttttagtttaattaggtactatttatttatttatgttgcatttgcttttggggtcttagttatgaattctgtgaatattctaaaacttctggcctttagtgtcacctgttttcaggagatactgactcctatggcaattcccagatttcattcggaggaattttaccctcaagacattagtaatagtgcagagcatcattaggaagacactgatttgtttgattagaggaataatggtccttgtacccagtaccaactgcataatgtatgggacccactgcaaaatgaaaaaatattaagaatttcaagacagcaacagcacagtattaaaccaagcatggagttatgctaagagcagggttctgcgcaactgcataggttgcatgtctttgaagttggctcttcttgtattcacctgctatggtttgaatgtttgtcctctccaaagctcatgttgaaatttaattgccattgtaatagtattaagaggatggccctttgagagttgattaggctgtgagggctttgccctcatgggtgggcttaatacctttaaaagtgggctttgaaaagtgagctctgtctttctttgctcttccactcttctgccacatgaggagcagtgtttttcccctctggaggatgcagcactcaaggcagaggcttgggccctcaacagacactaaacccactggcaacttgattttggacttcccagcctccagaactataagaaataaatttctgttctctacaaattatccagttttaactattctgttatagcagcacaaaatgtactaagataccacaaaaaggccaagagtttatgtatttttttgtaatttttattcatttatttagtagagacaaggttttgctatgttagcaaggctggtcttgaactccaggccacaagtgatccacccacctccacctcccaaagtgctgagattacaggcgtgagccaacatacctgactggacaagagtttatgaattccagtacagaatgactggaagctctaagggaaaaagtatactcttatacattaacctgaagaaactgcctcagtgatttcaatgcagaaaaatggtctgtctgtgttcaaacttatctccttaaccaaggaatctacatctaccttactagttgttgagaatgggtgggttctcccagactatcatatatgtgtaggaagtccaaggagggttcctactagatagacatcatacgaactggagaaaacaatctgtggcaatacattcttcctgatatcagttctttgggcccctaaacagcagaaacaagactcttggaaggtagaagtacaagactgaactcttaaccaatatataggtactatgcaaatgatttgaagtgggccctacacaaagagatagcacttcttgtgctaccattaagaattctaataaattattgagggatgcttataaaaatgcaatatataaaattcatttgaatatatgcgatccttgaaatagagttaagtctatgtggaaaaaaccttggaatttgaaataagattctgaaatgtgcaaaatagaactcaggatttgaggtggatctcccacttgaaccaaccagaagtctggaggtgggaagttctgcttgtgaaatgacactgcctgtaaggtgattatttcccagtggaagttgagccagacctttaacttggcagctggagcttggtataccaaatgtccttgtgagtgaatatagcaggtacctcattacacctaggactaagtattctgcttaaaatgttggtatcctcatcgtgaaaataaagtactgtttccttatccaagccgagaggaggcattactgataatccaggaggcaagagggtggttctctcagtggatgcactattatgtatggtagtcaggataaactaagtgctgtaacaaaccttcaaatctcatggggttaggataatgtaagtttttacctcacctatgccatagtacagtcaagtgtttggtgggagagtatggcatattgtatttttaaagatgatcatgacaatgccatcaatacgttatgttcttttacaatgtgactttactactcccccatcaagatatacagtttatattcccattgaataaaggaagggcctgtcactactttgatcaataaaatatgcaggaaatgatgttatgccactccaggcatagtcttaactgcttccaattcttgactcttggaatgcacatgtatggggctcttcctcttggaacccaaccaccagactaagagaatttcatgccacatggagaagccaagtgtaagccctccagttgacatcccagttgggtttccagcacatagccagcattatctgctatccatgtgagtggaccttcttggtcactcacccagttgagccatcagatgactgcagccatctgtactatccaacaagtgccctcaattgcaagagagatctcaagcaagagccactagctgagcccagtcaactcagagagtcataagatctaataaaagactgttgtatgagccactaacttttggtgtggtttattgtgcagcattagataatcagaacaatggcccttcatgtggcagtttaggaaactaacatcttttttgtgactcagctactttggacacatggcaaccaaagttagcatagaaaatggatatgtagaatgtggaggattatacaaagagttgtacagtatggtctagaagaaagcacattaattctgtccaccttgcacaaattaaaactaagtcatactaccctaacctaactgcagagatgctgggaaatagtctaggctgtgtgcctagaaggaaaaacaaacggttgatgaagacattgcattttctctaccaaaatacccccttaaaagatttttctccccagtaagaagccatacataactttgacatatacaaaatttaacttaaaatgggtcagtaaactaaatataatggttaacaaaaagaaaacttctagaagaaaacataggagaaaatctgttagtcttgggttaggcaaagatttctgaaacaagataccaaatacaaaatctgtaagataaaaaattgataaattacacttgatgaaaattaaaaacttttgctctccaaaagacaccattaagtgaatgaaaagcaagccacaagcctgagaaaatatttgcaactcatatctgataaaagacttgtatcaagaatccataaataaatcctaaaactcaaaaataagaaaacaaacaacccaactttaaaaaatgagcaaaagatttgaacagatacctcaccaaagaagatatgtggatgaaagataagtacatacaactatgttcaatttgtcataaatgcaaacttaaatcacaatgaaatatcaccatatacttataggggctgaattttttgttttgttttgttttgttttttgttatttttttgagacagggtctcactctgttgtacaggctggagtgcagtggcgccatctggctcactgcaacgtctgcctcccagattcaagcgattctcccacctcagccttccaggcagctgggattacaggcacgcaccagcatgcccagctaatttttgcaattttagtagagaaggggtttcaccatgttggccaggctggtttcgaactcctaacctcaagtgatctgcctgccttggcctcccagagtgcttgggattacaggtgtgagcaaccacacctggtcagtggctgaaattttaaaatctgaccatatcaagcgtgaggaagacatggagcaacctacactctcacataccactggtaggaatgtaaaatcatgcaatactttggaatacagtataatggcttcttaaaatgttgaacatatatctactatataactctacattccaataccatgtacccaagagaaaggcaagcgtacatccagacaaaatacttgtatgttaatgtttttagcattatgtttaccctaactataaataaaccaaatgaccatcaacatgtgtatgaaatgagtaaacatattctggtatttccatatagtagaatactactcagcaataaaagaaataaatcaatgatatacataacaatatggttaaatcccaaaataattgtaatgagtgaaaaatgcaagtcaaaaaagtgcacagaatgtacaattctatttatataaaattctggggggtctgattcaagatgtctgactagaagcagctagttcatgcctgtctcacaggaaagaaacaaagtagcaaataaatactgactcttcaactgcattgtattaatccattctcacactgctataaggatactacctgagactgggtaatttataaaggaaagaggtttaattgactcacagttctgcatggctggagaagcctcaggaaacttacaattacggtggaaggtgaaggagaagcaagtactttttcacaaagtggcaggaaagagtgcacaggggaaactaccacttttaaaccatcagatctcgtgagaacactctcactgtcatgagaacagcatgggggaaaccgcccccatgttccagtcacctcccaccaagtccctcccttaacatgtaggaattacaattcaagacgagatttgggtggggacacagggcccaactatatcatgcatcatcatctaagaaatcactctgggattcactaaggaagggaccagacccatggagggcagaaaggactgaagccaggcaactgcccacacaggactggcaggaacctggaggaagctccctagcctggggaaaggataagcgagtgagggtctccaggagatccacacttctgccatgggcccttacaatcctgggcacaagagactgtccttgactaccccaggcctctagaccaacacagagagcttcccggagtctgtgcagagatactaccccagctcacatggaacctcacaggcatttgatccctgggcagcccagtgccagctaccattaccccactaataaaggaaacaaggttcttttgcacacccctgggatagaagccaaagctgcaaaactgaggagtggccagactgcatattacattacccccaattccactgctccctgccagtcggggcttgctggcttgggccacctgcacagccaccctgcccctgccggaatactgcagtcagagctctgcattcctctgggtgcaaaactcccagatatagctaacaagccctttgtacggccattgtcgctgcctctgcccctgctacccccaggcaaagagaggccgaggagtctgggtacttctgtgtgtctccagcatgaacataacagctgagatatggaggaacagtgggcacactgcacaccctgcaactcttcatctctgctgctccctgccaaacggggcttgctacctgccagcccccagtacacacacacagcccctccctggactcactcagctgtcgcagctctgtgctcatctgagtgcataactcccagaggtagctgacaggcccttttcagtcatggctgccactcccttcccccctgctgcccccaggctaagagggaatgaggagctagggcactttcatgtgccacagctgagatacaaatgaacagcaagtagactgcactccccatgactccccacctcagctgcttcccatcaaatgaggctcactgtcttccagcccccagtgcagtcttcttgcccctgcctggacatctggctgtagctcagtccctctgcaagcccaattttctgaggccagccacaagcttctggcagttgccactaccacagcctctgccactaccactctcaggtcaacacaagagaaatattggcacccttgtgtgcccccaatagtgaactccaatgttacttatatagaagggaagtgtgagtgtgtcacacaccccacagctgccagtctccattgctccagctgaggggtccggccctccccagctgctctgtctccacctgaacatttcagctgcggcccagagctctcctgagaacacaatccccagagacctgtgatcttcccttgggctcccactgcctgggtgggagcctgccctcacctgagagttttgcaagtgacccggggaccagttcacccctccccatcacagccagcacctgaactctgggctaacccaacccttgtccagccccaccagaactcatacattcacacacactatccagtgggccatctaggggcctgggaactggggaactacctagcccatttcaacacagtgggcacctgatcagctcaccagggcatcagattggtttgacacaatcagccaataccaccacaaccaacaccctcctgcacgggcccaaaggtggagcccctacctctacacaaagcagcaacattaccacactggaaaacaagtgagccataaagctatctgtgacaggctgagtgagaagttaatgccctgaagcaacacccatggagagttgcagaaagggttttcccatggctctcaaccacactgtggtccagagatagactttagtgtgcatacaaacaggaagtcatgagcccaaagacggggttatgatagggaaacagatcatattcctgtccttctaggatgtggagccggtgcagccccctcaccacctgcagagacctcagcacatttcaccaggagctcctgccagccgccctcatcagggctggtccctgtgtttgccactggggaatttgtaggcaagccaggaggtccggctctgcccagctgtctccaccccttcccccaccacccctattgcagaacaggaagttcaggatatctggcactccactgtccagcctatcacctgaaacaacacagaacacctcacagtaaacaaagatcagctacatacccatctgctcgtgccacagctgactcttacccatcagcgccatctactggcctgtagatggaactgcatagctcaatataaaacctgccaacagaagtgcagagcgggtatagaaatcaaagcccaaagaccctatccaacatactctacagtcacactccctagagaggctggagaaagggaagaaaaacattctatctgaatgaaaatgatttcaaaaattagaagtggcagcctctccagatgacaaaaaacaagcataaaaattctggcaccatgagaaatctgaatgttgcaacagcatcaaaggatcacactagctctccagcaacgcctcctaaccaaaatggaaattcagaaatgacagataaagaatggattcaaaggaagcattaattcatattttataattcaattcaaagtatgaattgcaaggaagctcaacaagatccaagacaaggtcgaaaatcaacacaaagaaactacaaaagcaatctaggaaatgaaggcagagattttaaaaaacatctttaaaaaatcaatcagaaacttctggaattgaaaaattcacttgaggaatttcaaaatacaattgaaagccttctca

SEQ ID NO: 12529 - DNA, 13595 bp, Human
tcttccttgcccagtgaggtgaagtggttgactgtggagccactcctgctaactggaaggaactgggcgttgccaggcactaagccaggaacttgaactcagctgagaagtgggatctggataactcctgcccctcagagcaaggctggcaaccagctcatgggtgtttggctacctgggggagggatttctgctcctgacaacaggcagtttgttcagttcttcctgccctgattcttctcctgttgcttttcactgcatccctgagctctttggtaactctacctctcaccagtttttgcaatttgctgtagacttcaaaatcctggctctacctctccttcctctgtagctgtatttccctgcaaagttggaagccaaccaagatcaagtttccttaactctttttctttcagggtcctggagctgaactcttctgacctacataccagaaaggctgtatcttatccttcctcaccaacatctgaaaggttcccccagcagactgattttaggtccctttctgaactagaatctgacaaagacgccacacagttttcagaaactctcaccatgcaacagattttcactagcacacagctggtctgcatttggggccacctctgctttctgagttccaacacaatggatttttgtggttgtctacctgtttttgctccatgcccatgtcatctttctcctgttgctttctgttttctgcacttctgcattctcctctcttttggtagaattttctcttttcttccctctttatgatgttttatttttttctactcagcctgccgccttctcttgttcctgccaccctttctgctctggattcagctagaagattttatgagtgactgaagagtttctagactgctaatccagggataaacgcaatctgtcttttttcagggttagattcccagcccagcctacttcttaactgcatgtgtaatcttcatccccctcctaccgatgtttctgtgccgcttcattaatctgtaaagatgacccaccctctttccagacaaggaggcatcttttctcgtttagattcctcagctctttagacttctcagtcatttagctattcaaaaaatgacagatgaaatccgaggcacaacaaagttatcatgaaaaccttttccttgagagccccatgtctgattgttcatattagctgttatttggtggaaagaacgctagatttttaagaaaagttctggttttgccacatggtagctgtgcaaccttgggcaaatcatttaccttcctcgggttcttagcgtcctcactggtagaatgggaatgcttcacaagggcgttaatggagatgaaacaatcagcaggagagcactttgtagattgcactcggatggcagggtgaatgagcagggatggtgtcctcatttgtttttaaagtcttcaaaggtaaaggattgttaagcatggagatttgatttgttgtttctgccaggtctcctggaaagctacaaactagaagaagtgcaggaatccttgtggtaacaggggtatcagctttttgtccacagagggtcctaaggaattccgactcccgttttgaaattgtatcgaatccagtcccaagtgaatgtggccctggggtggtgctttgagaagtggaatcactgcaggacagtttcaacattcacttcccaggcaagcctaaagcctgttttaaaagggcgtgtgggggccaaacccataacagtctgggacatttcagactggcaccacctcctctggctgtttccgaggccatctagaggccagagcccagtcagattaactgaaagtaaagagaggactgcgggagtttgggacctttgtgcagacgtgctcatgctcgttcgtgtagagggcgggagagaggaaaggaaggagggcattgggagctgaggccccacctttcatttcagaaaagtgcacaggcagagcgggctgagtcacaggcacaggtgaggaactcaactcaaactcctctctctgggaaaacgcggtgcttgctcctcccggagtggccttggcagggtgttggagccctcggtctgccccgtccggtctctggggccaaggctgggtttccctcatgtatggcaagagctctactcgtgcggtgcttcttctccttggcatacagctcacaggtaagagccggcgggcttctctcagcgtttcctccttcactgctcactctataaagttagctaattgtcttagaagttgcaagacttttgtttgggagcctgagccacagatacagtttgttttactttgggttttactgaaaccaaagttggtggactgtttttggagaactgctctcggacaaacaggtttaggtgtgttcagctgccagtgattcaggcacagagagggctttctaatctcaggttacatgccatttttttgtgtgtggctgttctcaacctcccactgctggcaggacttggcatttggatttctgtgtgtgggtcttgtctgtgactctcagcaacaccaggaaagtggagattgttagagagagacctactgtgattttgaaagtgccccaacacacacattctaaatgtaaatatcaagtttaaaaaaatgccacgtggtacaaaggttctaggggtgcaggcaaacataagctgtctggagttgattaattcagtttctgcaatagactagtaacagtatgaaatccacctaaggacccatctggaaaacttacctgctaggagaccactttacatacaacacataatgcttaaccttaatacataatgtaatgtctaatcaatgttatgattcattttaattttttgtttatgctttcaattctatttgcggatgtttgtagtttgttataacagttttgaagtcagtaccacgaggcgaggctttaatgctgtggagaaagtaaaagcactgcgaaggcttgctgtgtggtagtttagttgtcacatggaatgggagggtccaggctgcatacaggtaggagtatgtagattctgggtgaagtaagtttgggagatggggcatctcagtttcactttactttaagtcctactcagatatttattttggaagtgtcagcagaagttctcacaatactacatcccctgttaacccttctttttcttctttttcattgcagctctttggcctatagcagctgtggaaatttatacctcccgggtgctggaggctgttaatgggacagatgctcggttaaaatgcactttctccagctttgcccctgtgggtgatgctctaacagtgacctggaattttcgtcctctagacgggggacctgagcagtttgtaagtagattatcatcattttccagggtactcttgtttagggaaataataagccagtccatttctcctttcccttccagtatttttcttagcagcaagcacaaggttaagctcggaaacaattcttgggacagagactgagaggccgttgaaggggaaagcaagtgacagagctgcagacaggacagttgggtttgctggtgtttcacttccgctcccaccatcttggcctccttgcctgggtgctgagtaagaagaccttttgccatttcccctctctaggtattctactaccacatagatcccttccaacccatgagtgggcggtttaaggaccgggtgtcttgggatgggaatcctgagcggtacgatgcctccatccttctctggaaactgcagttcgacgacaatgggacatacacctgccaggtgaagaacccacctgatgttgatggggtgataggggagatccggctcagcgtcgtgcacactggtaggttatgcagggaacagtggttttggaaaggatgagagcttgtagaaaagaaaggggcaatctttgttaaggctgagagagagggacaatcttttgtgatggatagagagagggactagcccttcagaactgggagcctcagagggagaccgaagagttctggggtaaaaagagaaaggctttgtttggctgtggaaagaaacagaaagtaaagcaaaggaactcagagaatccgttacaaaaatggcattgagattgtgaaagggagagggagcaattctttgatgaaaggcttacaacaggtctgttcactcactcatttattcgagatacttattgagtacctactctaatgctaggcaccgtcaaaagtgcatgacatacactatctcattgaatccccacaccactctaggaggcaggtactaatgatgggagctaacacttactgagtacttcccaaatgtcaggggctttacatgacacattttatttaatctttacatatctcatcagtttattgtgcatttaatgcctcccatcttgccaatgaggaaacgaggctcacagaggttaagtcatttgccctgagtcacgtagctgataaatggagtaacttaggactcaaacccaatcaactttgaatctaaaactgtgctctaaattggtgcattgtattgtctgcatccctataaaggacaatctggaaaaccatgccaagcaacaaagagcaaagtacacgaaacttatgaattgtagatctgggtttgagtcattgctaccatttaccagctatcaataagtcttattttcctcatctgtaaagtgagaataacacagtaaggatcacagtgaggataaaatgagataataaatgtgaatatgtcccaacctctgaattgtacttaacagctaccatacattgagtgtttattttgtacaggcacagcaaggaacaacttacatgaattattttattttttattaagaactcaagaaatgaatatcattatctctgtttatacatgaggaaactgaggctcaaagaagttaattacttcaaatcacacagctaagtatttcaacctagtgctctctggtgtgtgctcttaaccaacactactccaaacatataagcctgtgcagtggtacgatttcctttcattcatagtacagtttaaaaccatttctcaatgccccaccaatagagggctgtgtgaccttgcagaagtcatttgagtattgaaagaaataatgtaatggttttggacctcagtttcttcatctgcacaatgaagaggttaaacacacaaaaaatcagtggttcttaaatatatgtggataattattctttgagaatcaaataaaagccatggccctgcttcccataaaacagtggagacatacaaaatgagacttggattctgtgggcttgcagactaccttccatcctcttccccatcctccttcatggagtcaaggctgggaatcctgggctagacattctctaatgtcctttctggctctgagggcttatggaagtataatcagaaataaagctaaaggacaagaaaaccagggttcacagactctagtgtggcttaggggaccttccctctggtttcccttttccatcatttatccactagactgtagcttctgatttactttcctatcctctcagtggcatgagctccttgaaggtgatgtcttttttggctcagcatttctatcacagtgccaggaatgtagtaggcccttaataaatctgaataaataactgactgagtgaaagtggtgagaagtcagggagaaatgggttgggcactacgtttgatgaggttagcaaaaaccttaccccataagtagttcaacccacccagtggttttcaaagctgcatcagaatcacctggaggacctgttaagacacagattgctcagccgcacctctagtgtttctaattcagtaggtctggggtggggcctaagatttccatgttctcaagtgatattgttgctgttacttcgaagaccacactttgagaaccattaaagtatgtgtatggttttcctattgctagtaggattcacaaggtaatatattattttatgcataaaggtaggataaaggaagattccatctattgattaaatgcatccctattatgtcattagatttcattgtagtcctcttctttttagaatcctaatttaatctttttctccttacagtacgcttctctgagatccacttcctggctctggccattggctctgcctgtgcactgatgatcataatagtaattgtagtggtcctcttccagcattaccggaaaaagcgatgggccgaaagagctcataaagtggtggagataaaatcgtaaggctgggcagttctgggaaagttctaacactcttatggcgactcttggtattttgcagtgggctaaatagttgctgaacagatgtttttccctttaagtaaatcctatataaaagaattcacatttgcaggacagataaatcaggtatgaactagtaactttacaaaagctttcttaattttacaaaatatttccttatgggatttctttactatgtgggggggttgattttacaaaaatgtgctatgtaaagcttttctaaaaaatcccttatgtttaaagtgaagcatacatttgtaaaaaccactgggctaggcagtcagcagggccactatgagtcagggcttaggaaagtctgttgtgctgatagcaggtgttcattaaatgtattttaaaattgagataaaatttacccaccataaaatttacctttttcattttcacaaagttgtgcagcaatcatcactaattgcagaacgtttttaagctccctcccgtaaagaaaccccatatccctagctatcactccctattatcccctcctaccagcccccgacaactactcatctactttctgtctctatggatttgcttattctggacatttcatttaaatagaatcatacaatatgtggtcttttatgcccagcttctttcacttagcataatgctttcaaggctcatccttgttgatgtattagtatttctttcctttttatgactgcataatattccattgtatgaatataccacatattgtttgtccattcaattgatgggcatttaggttttttctgcttgttggctgttgtgactaatgctgctataaacattcatttacaagcttttgtgtagatcatatgtttttaattctcctaaaagtggaattgttgggtcttatggtaactctgtttagtttttggaggaattgccagactgtctttaaacagctggactattttgcattcctgtcagcaatatatgagggttctgatttctccccatcctcctcaacactcattgtcttttttttttttaatcataaccgtgtattaggccattcttgtgttgctatataaaaaaacccctaagactgggtaatttataaagagatttaattggctcacggttctgtggatgtacaagcatggcgccgatgttggttggctcctgaggaggcctcagggagcttttaccgatggcagaaggcacaatgggagcaggaattttgcatggtgagagcaggagaaagtgagagagttggggggaggtgctacatagttttatatgaccagattttgtgagaactcactcactattgaagacagcaccaagccatgagagatctgctcccatgacccaaacaccctccaccaggccccacctctagcaatgcagattacaattcaacatgagatttgggcggggacaaatacccaaactatatgaagccatctagtggatgtgaagtggtatctcattggggttttgatttgcatttttctaatgacttgatgttgagcatcttcccatgttcttattgtccatttgtatatcttatttggagatgcatacattcagagtttgcccattttaatatggggtacattatttcacttattcttgttgaactgtaagagttatttaagggatactagttccttatcagatatacaacttgcaatttttttcccattctgtgggttgtcttttcatgttcttcatagtgtcctttgaagaacaaaagttaaattttgatgaagtccagtttattttttctcttttgctgctagtgcttttgtgtctcatctaaaaaaccactgcctaatccccaagatcatgaagatttatggctatgttttcttctaagagttttatagtcttaatttttacatttagatctttgagttcgttttcgtatatggctgaggcagaagtccaaattcactcttttgcatgtggatatctagttgttccagcaccatttatctcatttccttaataaatatttaatgaaataaacagccttttttttttttgagacagactttcactctggttgcccaggctggagtgcaatggcatgatctcagctcactgcaacctccgcctcctgggttcaagcgattctcttgcctcagcttcccaagtagctgggattacaggcatgtaccaccatgcccagctaattttgtatttttagtagagatggggtttcaccatgttggtcaggctggtcttgaactcctgatctcaagtgatgtacctgccttggccttccaaagtgttgggattacagcgtgagccaccgcgcctggcgaaacagaactaattttaagaagcctaacaaacccaactctgaggttctagtttgaatagaaccaataaagatgacttaggtcaacacaaaactttttattttttttttgaataacaaatataaattagaggtgggatactaatggtaaaataaggtgtctgctttaaaactctggagttcccgaatcagaacccaaactgtattcccttacattctgaaaagtctctaagttcagaggtgtgaatattattaattagatggcaccagtttagctctgtgtaaacttcaatctactcccaagtgcatgtaattcttccaaaaatatgggggaaaaataccttacctgaagcttctgtgggatttacccacttgcttcttgtcttgttcacctgacatttggtttctgcttgttacagaaaagaagaggaaaggctcaaccaagagaaaaaggtctctgtttatttagaagacacagactaacaattttagatggtaaggttcacaaataggttgatttctttcttcagctttctgacatgtccagcccatctctaatgaggactcccagatcatcactttatggctgttaggtgtttcccatatgaaattagaggagctgggtcagggagacaaaagtcttctattagtcttatggatagctcctccttgagtgtattttgtgcaaaagattaagaagctggactctactgccattaaagctgagagaatcctaaggttatttgtggcttcggggttatatttattactactactactaataaatattcaacaagtaaataaatcttttttaaatcaaaagattagtatctgcttattctttttttttaattgtaaaccaattatggtattaagagagtgactcaatagacatatctggcagtttttacaggagagcttttgtactatttggaattgatttcaactcctctcatttagttattggcactaataactacatgaaatgaatccagttttagtagcgtataattttatttttccagttttcaggttcatcaggcttaaaaagtaggataatttatttttcttgtctttgtttttgagacagggtctcaacctgttgcccaggctagggtgtagtggtgcgatcttgggtcactgcaacttctccctcccaagctcaagtgatcctcctacctcagcctcccaagtagctgggaccacaggtgcgcgccactacacccagctaatttttgtactttttgtagagacggggtttccccatgttgcctaggctggtctcacctgagctcaagcgatccacctgcctcagcctcccaaagtgttgggattacaggcataagccactgcgccgggccaatttatttttcatatgctcagaatttctcccattctctgaaataggtccacacatttaatttctagatgttataaatccggacatgcaaacttaaattttacgctcataagaaagttcttgatattaatgactttatcctgtaaaactctggctctgttacacgggagaacattttttacagaccgttattagttgcaaagagggtcacatttttataggctaaagctccagtgaaagacctcaaggatttataaaatagaatatggagtaaaatgattgtattgtaaaaccagaaaaccaaaattaacattagggagtttttaccaaccaacggctattgtctttttaaagttaaggggattatctaacaacttggggtcatggaaaataaatatgggagatgttttagatcaaaagaaacttaagagatgaacacaatcaaagtgcaatgtgtgatccccaactggatgaataatagtgtgaacaagctagttgtaaaaacaagcttggaggggcaattgggaaagtcttgaatatgaaaatgttaaatatatggataatattagggaattattgttagtttgtattaggtatagtgatggtattgtagttataaagaaaatgtacctattttgaaaaattcttactggagtattaggggtaaatgtcagcaatttactttaaaagcataggaaaaaagcaaataaaacaaaaaaggcttcagaattaggtgatgggggagatgaggggagaaaagaaaagaaaagaatgaattaatgaatttaagggatgggtaaattccacatactctgttctctacttttctatatgtctgattttgtttgtaatgagagtgagaagtggggagaatatgggatgtatgtgtgtgaacaagttgtgggtcatccaagtgtccatgcaaggtacttagaggccatgatttaaggatactaactctgaaaattatgtaataaggattaggaaacttcttttaaaaattaaattgggggagaatatgaatactttccctcagaatattttccttctaataacatatatgtaattcataatgccaagtattcctattgtactcttctcaaatatattatccatttaaacttttgttttgtgttttaggaagctgagatgatttccaagaacaagaaccctagtatttcttgaagttaatggaaacttttctttggcttttccagttgtgacccgttttccaaccagttctgcagcatattagattctagacaagcaacacccctctggagccagcacagtgctcctccatatcaccagtcatacacagcctcattattaaggtcttatttaatttcagagtgtaaattttttcaagtgctcattaggttttataaacaagaagctacatttttgcccttaagacactacttacagtgttatgacttgtatacacatatattggtatcaaaggggataaaagccaatttgtctgttacatttcctttcacgtatttcttttagcagcacttctgctactaaagttaatgtgtttactctctttccttcccacattctcaattaaaaggtgagctaagcctcctcggtgtttctgattaacagtaaatcctaaattcaaactgttaaatgacatttttatttttatgtctctccttaactatgagacacatcttgttttactgaatttctttcaatattccaggtgatagatttttgttgttttgttaattaatccaagatttacaatagcacaacgctaaatcacacagtaactacaaaaggttacatagatatgaaaagattggcagaggccattgcaggatgaatcacttgtcacttttcttctgtgctgggaaaaataatcaacaatgtgggtctttcatgagcagtgacggatagtttagcttactatgtttcccccccaattcaatgatctataacaacagagcaaagtctatgctcatttgcagactggaatcattaagtaatttaataaaaaaattgtgaaacagcatattacaagtttgaaaattcagggctggtgaaaaaaatcaactctaaatgatgataattttgtacagttttatataaaactctgagaactagaagaaattattaactttttttcttttttaattctaattcacttgtttattttgggggaggaagactttggtatggagcaaagaaataccaaaactactttaaatggaataaaaccaactttattctttttttcccccatactggtagataaagcaaactttataagtgggctattgaaagaaaagttacaagcttaagatacagaagcatttgttcaaaggatagaaagcatctaaaagtttaggctcaagatcaatctttacagattgatattttcagtttttaatcgactggactgcagatgttttttcttttaacaaactggaattttcaaacagattatctgtatttaaatgtatagaccttgatatttttccaatactattttttaaaaaattgtatgatttacatatgaacctcagttctgaaattcattacatatctgtctcattctgccttttatactgtctaaaaaagcaaagttttaaagtgcaattttaaaactgtaaattacatctgaaggctatatatcctttaatcacattttatattttttcttcacaattctaacctttgaaaatattataactggatatttcttcaaacagatgtcctggatgatggtccataagaataatgaagaagtagttaaaaatgtatggacagtttttccggcaaaatttgtagcttatgtcttggctaaatagtcaaggggtaatatgggcctgttgtttagtgtctccttcctaaagagcacttttgtattgtaatttattttttattatgctttaaacactatgtaaataaacctttagtaataaagaattatcagttatataatttgtgtatatacatatctagaagttctacattgcagggaaaacagatggatatatatttaatctttaccaaaaagttttcttagtagagacaacctgcaagtcaataatggatacagttagtttctaatgggtaaacagaagtatacggatttccacagaattttcacactgttttggatagctgggaattgggcataacaacactacttagtttgagggctctttcaaagaaaagtatcaaagattctatttagtactttgcattacacttttaatagggaaaactactggctttcaagtctagtaaaggaatggaaattgaaaaatggaaacttattaattcttccccaaagcgaaagcatacttttattctcctcctgctttcattgacatgtggcaatttccagggaagaggcttactgattattaaagcagtgtacttattgtaccatctctttttcagaagtatgtgacgccatctcacttcaagtactgtgataacataactttcttacttttccaaccaaagacacagaaatcccagttcctcttttcctctaatacaggctgtaatgatttgatcatcattgccaccgccaaaagtaatttaataaacacccaattttggaggctgcaatacctacactaaaaaggacaccaaccaatgaggcttgtggcacatatcactacaagcacctaatatatatttatctatactgtatgatctcccaggtg

SEQ ID NO: 12530 - DNA, 109250 bp, Human
  misc_feature (1)...(109250): n = A,T,C or G
atggcatatgaaaaaatattcatttctttgttttgcctcttgaacagatgccagtgatattcaaaatcacattcatctttgtattactttacattttagctacacttgtacaggtagatcccccatttaccttttcaaaagctgcctggtacttcatgttggccaggttttgcatcatctggctccggctgccttgtatacttcaggctccagccagatttaaccctgagtgagttttgcatccaaatgccttattctttcctttggacatttctagtctgtttttacctagctgaagggcacccctcacttctctgtctgccagtatctttcccgtatttcaaggtcagagcagaaatttcctccccttctttgatgctcacctgccatcctaacatgggatccagcattcagcattcattgctctttctccagtgctcccactgaacacttcctatacctattcagccatcaccatccctgccttgtgaaatgttggtctccatgtcttatctcctcccctggattttaagcccattgatgatagtgacatttgctttttcatcattttatccttgagagtatcagatgcagagctttgcatagtcattacttgatattagttggattatatgcatatatgacttaatatttcccacagtgtcctggacagcgaaataaatgccacttgaacaaatgcacaaagacacacacacacagtttcatcagtctaaatatccatatttgtggcctgattacctttagcatagaaaatgccttgttgaaggggaacattggactcaagtgtacaccaatgaggacaaatgagaaagcttctactctcagtctgaaatgtcacctttctcatctgcatgtaaaattgggaggcttttgtccagtcatatgttagaaaagtaccaatctgttataaatcaggatgttccagtggccactgaagatacaactgaactcttaaggatagatactgctacaatgttagtgagttctactgggacttgtataactaatgataaaataaaaaacaattggaaatttttcctttggtcactcctgtgaaaggaggctattcctgtttgattgatttatttattaaacaagtatcatcttcttgtgccaggcaatctgtgaaagactgaagatataaaggtaaatcatctgtggccttgcccctcagggatttataatcaggaaaaaagcctgagaaagcaaaaggatgtgttcaaagtctcaggtgaagtcaagccccgaggatctgacaagctctgagacacatcagtgagtttgcccgttagaccctgccatctgtccccgtgtgaaatatttgctgtaactcctttccatgaactgcttttggtttgaatgaccttggagacagcctgaaatcctgagcttggaagggtgctcttagcgttactggtctgcacttatagccttcaaatagaatttccacaaacctctaattatctcctcttaccatgctccctaaatgacagacgaccagctctttagtcactccaagaacggatttctattcagcccatgcccgggatgcattaggatgcccagaacatgtgtggctgctctgagtggcacagagcaattaacagaagccaagcaatttgcaaaatgcctcaacttcctgctcatctcgaaggcagaaaattgtcaaaccttaacctcaggaggctcatctgcagaattacacctcccccacctcaaagaagaaactctggtgtcagattcaccccctcctgctttttgcaaacataagcactcggctgcaacaacagctatgactcagttcctagctaacgctgcttgaattgatttagtctgagttcagatttagcacataatcatgttcaatttgctccactgcactgcctagagataaaaggcttggagaaaaaaaaatagcttcagcttgtgtcagtctttgtggtgatgtcattgccatgagcgagccgggccgttcgttactctgctgtgctgcctcagacgcggagggctgcgtgcagtgggagcgggctccaggagcccgagcctccagccgtccccagagcaaggcagcaccgaggcctggccacagcaatatccatctggaagctcttcccttcactcccaactctgaggttgcctaactctttattaaaaattcagaagggggaatgccagcccctagcatggactgtgatgtttccactctggttgcctgtgtggtggatgtcgaggtctttaccaatcaggaggttaaggtatgcacctgcaatcttatttttcattgttgctgttactgacgctgcttggcagagcctttttagcatgaagaaataagactttggttaatagttttcagctcatagtctgcgctagaaatgcatgtagtgagtgcatggctgcattaagtagaataagttggaagagggaccagcatattatttttaaatatgacaaggtctgccattgtttcttcttgtcttttttattaggtaatccctggtcagtcctttctgagtagacacattttcatattctcatattgtatctttgtcaataaggagaattttccagccctcaatgtcaagagggattttgaatcaatgattacatgaagaaagcacacataataaacccagcatccaggccagcctgacagtggggcaataaccctttctggcatgtcacttaaatatcctgtgatgtggtcttcaaattaaacaatagctgttctacagatggcagtttcagtccccagctttctggaaatcaaagttggagaacagctgcctaaattttctttgtcaggcaaagaaagcaagtcattttccttgagcagttgttcataaagtttaggcataaatatttcgcatcttaaggcttagtattatacatgctggtcctcactgattgccggcagcagttgttgacttgtcataggtaatcgtcctctgatgatattcattcccttttattttccatttggctttatattatggagaagatgccaggcttgcaaaatggaaatgtttattttttctctcatatttaatagaagaactagctgaagcttcttatttaaacagttcactcacacatatacacgcacagaaggtcagttgttcattgtgtggtgggaggaataaaaggtgaattacattgcataatcatttaccatccttgctttagtcttaacttaaggaaaaaccctgaattctttattgttgggtgtgcaggtgacaccctggtgctttacaggtggggatttatgtgttcttggcatagcacatggctatgtcattcaagattgcagctttaacaatcttttgaaatagatttgataatctggcattttgttcctgaatattttaaacatgtagccctgtatttactaatttttgtgtcagtgccatggaaatgtctaccacctgtcatatgaaggttcagaaaataaggacataaaggtttggcactgtctgtgattgcattgagaatggaaacatgcatgcagagacccacagtcctgccagtcgtacttccatagcacttgagaagggagagcagtcatttaaagccagcgtcaagtccagtgtgggtaaccaggtagagagacatcttccagtaaccactggaacataattccatctatggagaataaaacttcacagctcccttctgtcctcaacagttatctgttgtttacacacttgccctgagaatgtcataaaatattctaaactttattcgtttcagaaaagataatgagaaaatatttattggagatctgcaacatgccaggcattgtgcttatataggaaaaagtttaaaatatgcttatatggcatatgtatctatgatatagctataaaaataaccaactgccgaaggtttctttaaagacaaagaatattttgtggaattaagaggatacaaagttgttacagctggttgtatgtgagtggttggggtggttttatggaaaaatgatacttaaagatgggtagattttatacagaaagagagaaggcacagcattttgcagtctagtgagtcaattcttttgactgcagtaggttctctatgagagattagaggcaaacgggaaaggaggtgagtcagggctagatggtgaacagctgatgctgttcttcataaatttatgaggtttttcgaggaagactgttaccagaaatatgtgctacatgtatttactgccaatagctctgaatcatcatgggcttttttcttttcttttttttttttttagaaaggttacctaatctttctgggccttagtcttctcatataatgtgagaatagtagtaatttctaccttattagcttagagacaagagaattttacatgtagaataattaacacagtgcctgactcctatttaatgctcaataaatgttagctatcaccatcgtcatcattgtcatctttgtaggcactctctgaaagtgataggtaacttttaccagtttatcagaatgtcctaaatccagctgagtttacaatgacagtctagcacacagaaaatgttttccctcccaccccactcccaatacacacaaacactctagccacttagaaaacatggctttccatttttgatatttaatcatctaatgtaaagcagtaacattattaaaaagcaaagatctacgttgtgcttattaaaaagggggaaaatgaacaaattaaggtgggccaaatgttatgtgttaagaaaacctgcgctccttgttcaaaactgaccattactcttatcacgaagaaaggttcaaacgtaaaattctaggcaccaaacaaagcttccccaaaggtatctgtcttcttcattcattactaataactggtggagccaagagttccttcttcaaaatctttaaggtttattgtcagagaaaagggaggcacatggaaagggtctgtctcacctgcttacatccatcttgcttaatctcagtcttgtttgtttaataggcatccccactttctacatgtagcccccatgggcaagcagccatactagggggatgcaaccagcaggcctccttcataagtatgggagtttatttgaaatgggtagaagcatccacaaatctagtttcccatagtgacacagaaagcctcatcctccagtgtggctctcagctgattgtattaggggcccttctgactccagtttcctaaatttcatcaaagctgctcaagcaataatactaaaaagaggaggaaatcagacaaatggaattctgccatatttggctttctctggaaattccattggtggtgttgtgaacttagccgtctgttctgcaatgtgagagttctcagaaagatctagaagttgagagccctcaatagaaaatgctataggggaactgcagaatttctgtgtgtgtgaatgtgcagggttgatgttctccagtattctcatatttctgaaaatagtctacccactccacaaagagccaaacccttgggaaaatgaaagagatccaagagattggtaacgaaatttacatttcactttagtccagtggttcttaaacctgattgcacatcggtgtcccctggagatcttttaaaaatattaatgtgcccaggccccacccccagaacttttacctggctggtctgaatggagcccaggcataggtaatcatataaagccagtgtcttgtctctttcaggcacaagtaggtacaggtgaggtcagccaagaattgtctagagtaagctctgcttaagcacttggatccttatctccccagctaagacttgatgtatgcagttttaaaaacggtatctctgagctgtcagaaatgttgacgctcacccaacacttcagttctccacacctgcagttccttcacctgattctgagccaacagcaaatgctcttctttactgctggccactgtggggggccttctcagagctgcagagtgccaccactctgccagggggcatccaaacctggggctgccccttctctgcaatggtggcttcctgcacagaagaaagggtgggttccttctctctagattggagggcttctgattcatgtaccaggtttccagccttgtctccatgggcatccatgtaggacacaaggaattcacaaagctcccttccgctcattagagcaggcaggaaacatgacaaatcttataagaaatacagaagcttcaaagacccttggcacttgagagatttgttcattcattcaaaaacatgtgtggagcatttattacctaccaggcaatgctctaggcctaggagttcgataaacgtccctgccctcacggagcatatattctaacatgagatgcagacaatgaaatagtaaacaagtaaatatacatggtaatttcagctagtgatgagggctatgaacaaaaatgaagcagagtgagagatagagcattgatgggggaggaatggccacttttgaaaagattgccattggaaacatctctggggaagtgacagtttattaaatgtcattgtttcaatgtcattcagagatctaaagaaatttagagagccatgtacagagctgagagaaaatcattccacatagagtgaatagtaggtagaaagagaggccatcttagccatcttatctgatgtgctcctacctagtccccccaccagcactatttaacctgtttcaatcattcattcatttaggtacccattgagacggtcactgtctcaagctataatttatttttttaaggagactctttttcagaaaactgtacttaacctaattccctcatgctacgttttaagcccaatagctctcttagggtaagggtaaatacaagtagaagtgtgttttcagcacagtaattcttcatatgcttggaatcttaggattgctacaggacagctcttttctcttctgaaaggccaaggcctttttaaggtcactcataaatcctactttctctcctctgcttttgagaatttctcaacatcctcccaatccatgtgacctgggacaatctcttagcctttctggatgcaaaataatcatgctgagaaaaatcccctactgctctgtgcattttatttttctttttacacgatagtatacctgactgagtcagagtctatttgttttatgctgttgtgtgagttatgaaaaagaccagcacatcatggccactgagtacaatgaaatctctctgtcatacaaaccactggacatttcaaatcacttgttttgtatggtgagagtgataggaggagaaggatgaggctgagttggtatgatgcactttgtactctgctttgaggagaaacaagtgacacaatttagtatgtgtcacttgttcaggaattgttttggaagagaaacttaggtgggtgttggtcaagaaagctggttgaacttcatgcccatttcttaagttttttgcgagcactagggtaaggatctgggcacaaccaatcatgacctatggctctgcagagctctaaagctctttaagaattttcaaaaaccattgtgttcactcagtaacttagaagtgtttgagttgtatatgatttaatcctcagaaatggtaaaccctctagaggtattcatggtaattaacgttcagtaaccaaaacgtgaagtcaactgaaatgctcattccctattcaatgaccataatagtaatattaaaaataatattttgtcatacatctctagaccatctttggtttatgaagaacaaaaggcagtgtgtgtgtgaggtggcaagagagatggcatgtgtataacagattctaaccctccagcaaaacaaatgttgctatttctccggtaataacatggactagaattgaggccattttggaaataaatgaattaatgcaaaactgaaagttaaaattaatgatctctaaaacaattctttaagaacttaacattcttaaatgtacaatactaaacattttcttgcctctgaagaaagtagcaaacatctttcagagagagggaagaaatgattttatgaaagtgatactccctgagaaggttcagaggcagatttctcagccacctatcacatttggtaaagacaaggtagaccgttcaactaataacattgttaagtggggaaatcaactaaaaacttgtttatctgtttaaagaatcttttaactgttgagaagtaacagacattggcagttgctacctctaacctaaatgtcagatatattaaaacaaaacagcaattttaatgaaaaattgttttcctaaagaaacagattttaatgtaaaattcagagagtgccatttgcagtcttagtgattctgtttgagtccaactatcagtaatttatatgggtttgttttagtactttctgataaagcttagaattgacacataagaaagaaaatgatacctgaaacacttattatcactttatgtgtttaggtggtaagcttaatgggcttaataggcattgcaactttgcagtgactagcccagctttgcaaggagatcataaactatccaactcatacctggcctagaatttctttatgtaaagggacaaatgtatttatgtaaaggttctgtatcctttcccaatgctaaagctaaactatttcaaaaatagaattttaaaaacacatggagaggtaatttcaactggaaattttgagcaggtacaaagttatatatacccattccactctagctagaatggagagttaattgtcaaagtttttgagaataaaatgtctaccaagttagaccttccctagaaaaggttcgatatatgtaatttcatgttcaccttttgggtaagtatacctgggtaaaacatatgtgtgtacatatatgtatatacggatattatacacatgtgcaaatgtatgtataacatgcatatttactatatatttctctttttttttaaccttctgttaccatagaaggttttttctggatcctctacctattctacaatggcacatctaactagttaatggtaattgcgtgcttttaactacatcaagggattaagggcccaaagaagattcttggcaagtgagttgaatagaaacttgaacaattgctaaaggaaactcccctgggagtgaaggggactaagaaattcattatcttctctttttattgttatataccatagcagtgtccacatccttacagtctagtactacaacagttattctttccagaatctaatatatcagctctgaactatacttttttttaatgtttcaaaaaggtcttgatcctttagcttccagaaagatgactttaacctatctatgcttctgttagattggactatgtactaactttcatttcctaaaacaacatcttcaataatgttttatttgctccaacaataggatactttgctatttaattgtaagattttcttcccctacctctggtagttctatagaaatatgtgagcagtgttcatgctgtaccccaaacatttaacctcaggggactgtttactaagttgagcattaaaccatcccacatgtcaccacatggtgacaaatgtaagctccagagatattcatctccatggatcaatattatatgttatcaaggtgggcaattttaaaacttccaactactgtttccaatcacaaaattcttctaactacaaggcatataacaggtacttcatataatccccattatagcccaaggcatctatgtagttgccccattataaacagattcctgatattcagagaagttacctttttacacaagattacacagctattaattggcagaagtgggacttgaactgttctttccactatcgaaatctctctaaggattaattaataaagcattaatcaattattggggtataggccgggcgcggtgccttacgcctgtaatcccaacactttgggaggccgaggcgggcagatcagaaggtcaggagatcgagaccatcctggctaacacggtgaaaccccgtctctactaaaaaatacaaaaaaaaattagccgggcatggtgacaggcgcctgtactcccacctacttgggaggatgaggcaggagaatggccttaaccggggaggtggagcttgcagtgagccgagatcatgccactgcactccagcctgggcgacagagagagactccatctcaaaaaataaaaataaataaatgaataaataaaagaaaagttattggggtataaagctgggaagataagacattgaactcatatgtaatatttcatctgatgcttaaaacactgtttttgtctatttcttatcagaagtggtgttatactacttgtacataaatcagtagttgagatcatgttagcttttcttaataaatctaatgtggcaattgaaggcatagcatctattttggattttgttttagaatctgtttcaaaatctaattatgccatctagtttgggaaaaagaaaagttttctggaaaatgcaagggtttccctggtttgacatgcgcctggtttgacagctcctccacctccttgcttatgtcaccaagcattttccattgactcagtgagggataatctgtgaagaattgtagggcagaggcagtgaaagcaatattaataatattttacatctgaacagtgctttccaaattatacaaaactcagctttttcacaggaaacctccaaggtaaacaaagccacacaactcataatgggaaaacttggactgggattctttcacaacacaacacaagatctcttggtgtattattatagcctgcattatcagtgcatctaatagaattgatttcatcttctatgactttactgtgcctttgggtattgactaagaaaatctcagcctacctttcctagaacaggacacataacccatgagcaaacttaataatagcaacaatgtattgagcactgactatttgtcaggcactatagaaagcacttttattcattcattcagcaaatatacattgaatgccttctatggtcacggcctcagattaggctctgcagatatagggatgtataatcccattggatacaaaagcctatgtagtgctggcctttattctcctcagttcctttttccccaaaaaggatgatgctgttatgacctctaaagaggcttcctttgctgacgtagggcatgtgagaaggaagtctagtctccagagtgagacatcctggagagaactctctacttgacctctaggccacttgatagtgtgaccttgagcaaggatccttactgctctgtgcctcggtttcctcaactacaaactgatgaaaataatactgcttacctcataggttggtggtgatggctaaatgcattagagtatgtaaaacacttaacataatgactggcagacagaacacatgcaagtaatgtcattcattaccatcatcatcatcctcagtagtagtggactttgtacatggagttctaagttttcttgccagggaagtctaccttacttgcctctcattatatcaaactcttcccctgcagttttcaactcatctttgcacaggggcagcagtgccctcacctcagggacactcagaggtgacagaaccctacatcagaagggactggctcagtttgggagtgaggaattacaggccctcccagggagcagagatgctgcagttcttctcaggctgtgtctcttccaaacctcttttcttgtctcttccaaacctcttttcttgtctcttccaaactcttccaaacctctctagataagtgttccctgtagaacaggagacagcaggaaatgaggggcctggataaacaggaagtatcttcactgtagccacaaggggatgttgtggaatgaagcctccaggaagttgctgttgttgactcagttaatggaaagggaagcagcctgaatgaaaaagcaagtgtagaaccccctccctgaccccaccagaatttagagactccgtggctcctatcacactcagaagaaagcccaatccttgctgtggccctcaaggcccatcagaccttgccccaacagccctgctgacctcatctcctctgcacctctccccctttcactctgctctaacccccacttcctgcctgtaccaagcatcccttggaacttgcctttgctgtgccctctacctggaatcttcttccttctggagcctacatggcttgctcctcactcatcatagagctgttcctgactaccacacctacacagaccacaggccccgctccacccctcatcctgccttgtctttcaacacaatcacaagatgttgtattgtgtgttcatgtattggctcattgtctatctccactcaccagaatgcaagcttcatgagggcaggggcttttctgtgtgtctactgctgcatccctagagatgcatatggtaacatggagaaaatgtgtgtttacaaatgaatgatagactcccatttgcaaaccctaaaacatgctgctagaccaccttctttgaaaaagatggcctagatttctagattcaaggccagttttaataagcattcagacagagtaatgtgcatagcagaatacagatgttttgagacaagatctggctctatcgcccaggctggaatgcagtggtgtgatcttggctcactgcagcctccacttcctgggctcaagtgatgcttccatctcagcctcccgggtagctgagactagaagtacacaccaccatgcccagctaacttttgtattttttgtagcgacagggtttttccatgttgcccaggctggtcttgaactcctgagctcaagcgatctgcctgcctaggcctcccaaagtgctaggattacagacagcgaccacacccacacagaatacagaagttttaaggcaagatgcccatgaaggaaaagagaggttgaactcagaacccatttctttaaaatatatctaaacacctttctttgggcaggaattttacatggagttatggacttgtttcaccgcagtaatgcttaactataattgtaatatttacaacattgaccttcaatttccatttctagtttaaaacagtggagataggtagaaattagattaattgcccaactgagttcagtttttttttttgttttttgtttttttgcttaggaggcatcttatcctaaaaaatctctgtattcggccatatacacctacacacctactctggctgcttataaacttatatcataaaactagtaaacatcttttttgtggttttttttcttttcttttttttttttttttttttgacagagtctcactctgttgcccaggctttagtgcagtgttgcaatctcggctcactgcaacctctgcctcctgggttcaagcaattctcatgcctcagcctcccaaatagctgggattacaggcatgtgccaccaggcctggctaatttttgtgtttttagtagagatgggactttgccatgttggccaagctggcctcgaacccctggcctcaagtgatctgcctacctcagcctcccaaactgttgggattacaggcatcagtcaccacacccagccactgggtatggtgtacccataatagtaaacaattccgatactaaaaaacaaaaagaaaaactaagctaaaagccccccactatttgttgcttgaataaataagagtagatttgaattattaatgagcaagatagtgcatggtgtattttatattctcactgtataatgaagtactccatttgtagtgcttagcaaaatagtattctatatttaaataattcttacatattactaacaacagttagcatttatgtagcctcagaagactggaactcactttgaatgaatgttgcctcataacacctctttgatgtagtcaggaagtatatgattctctcaatgagaaattctggttagaagagttccccaaattatataacaaatcaatagaggagagatacaagtttgcacatttttacttcacgttatgattgtatagttcttgaagttggaaccaagaagccatttgttataaaggtataatggaaagcaacttgttctttggaggcagaaagacctgagttcaggatatttcttatttaagattttccttatatgtaaaaagaagatacaaatttaggttgaaggctatgggatataggtgatcaataaataggagccattattcctgatgccctggtatagcattagtgagacagtcccacttgagaaatgtgatggagcactcagtgtgtagtaggtactgcctccagacatgggaattcaggaatgtgaggcatgcctcctgccctcagtgagtctctaggctggtgaaggagtacaggtagtaaataagtacatagagagtagaacatagagcgtgccatggtttgagtaagcccagtacactatggaagcctgtaagagagtagtctgggatgaggagggaaggctaccccaaggaggtaacccatgagttacagctttataggttaagtaggaatttgccaggtgaaggaaagatgggaaaggaagaggcctacactaaagcagaaatgccagagagaatggtgaactctaagaattagagtcctggatgaacgtagtattacacagaaactggggtcacattatgaaggagtttgggtcttatgtgcaagtctaacaggattgggtcatgggaagcatgttcagcagaggagtggctcattgcctagtctgactggaagtccactctggctggagtgtgaactgtgactgcactaaggccaacatgccaagtagggagcagagccacttgcaaatacctctctattaacagatgaggaggcggctgcagtattgcagccagacccgatgagggcttgtgaaactgcagagtcccagtatccttgaattatgttgattgccttctagttagtcttctgtctttcctttttaaagaagaaagaagtcaaactagaaaagcagccatcttgaggatatgattaagttgccattcaacaagggtaaggtttctggggagacaggcatatttgttggcactacacctaaaatattcatgaggcacatttagttcagcaggaatattgtgattgtcttccagagaagaaggtctaaaatcagaaatccaaaccctggttcctgccctggggaatcacttactctgggcaagggagacagacttacaagcccagacagatatcccttatctaactgttctgccctgattcctcctcaaattcctaaaaactcgtaagtggaaattcagtgatgttaaatgctggacttagaatattctaggcacctcctgagagcaaatacacatgcacatacataataacatctcaatgttattgctaaaatattttcataggggctaaaactcccgaagttgaccatataccacgctaggagaaaggaaaagtctgataccatgtccttgtacttaactgttgccatcatagcaccagccttgccttagcatggcatgtaacccatgagttacagcttcataggttaagtatctacatttagtaggtgctgaataaaggttggatgagggcagcaggatggaagaagaggcggaaggagataagcccctctgcctataggggcagactccagaagttacacatatcacttcctctcagattcaactggacagaaaatgagaatatggactcatctggacacaagaggggctgagaatatcacctttttcctgtgtggtcctatgcccagctaaaagtcaggattctattataaacagaagaggaaggtggatattgggagacacataacaatctctagtgcaggtgacaaatgaatcctttaaataaatgaccagaactcaagttctaggattcacatatgctaaacagcaatccagagggagttaataagtcctgaaaacacagtcttaggagaagtttgtcaagatttcatgaaacaaggaagctttgatctggggtttcaaaggcatggcaggtacaaggcactcttcaatcggattacttctttctaggtcagttggagagattacggcccggtaggctgcttctccagtcccacttccatgccttggcacttgcagttcttccatgctgactgggcatcccatgcacttaccctgttgtatgtgttgctgccattcacttaggtaattctgttcatttgcaggtagatctctattaacagatgacaggaccatttctgatcaaacccagagtatcattcacatcttttacagccattggttggggcgtgagttgcatagaataaaccagtaagtttctgcttatgtagatgtgtccatcctcagcctttcccaacccttttagatgcaacagaacccatgatacagccatgggctgtagagagacagaaggagggctgaaccaggaggcagagcactgggtgtagtcttcagaccactcactttgggcatcatggagagggaatgggatttagagccagaccagcgtgggctggaaccctggccctaatagttactaattttgcagtcttgggaagttttcccctctgtaaagtatgtataataatgctactcttcagggtgttgtaactgaaataagaatgtacctaaagcatgtaggtactcaatagatggttgttattgttattattgcctcttctctaaattttgatattgaaaataccttaagttctactgagtctattaatgatatttagctctcttaaagacacagcagttctgctatattgagaatcatctccatccaaaaaatatatggcatttttctgaaattcacttaatttctaagtaaacttcctacatagagcatcatccatttttgtgaaggaataaaagaaaaatccatcaggtctttctaagcttcaaataaaaataactcttagacaaattctctataaggtcactaattttgatgatatcagttgcttcatttggtacaacactgtgccaaaaataaaaaattgtttaaaacagctatttatttgccagtactatggagaaataagccagcaacaatcagtattaattccactaagagatttctttggaagaagtatgaatcaatcttcattcttttttttaaacaaatattagaaaacaaagtttcttcacaagagtgttaagccgggacactgcatgcttctcattcattccaccttctaatttgtgttgtagaatagaaggtctgagcacaaaaattttataattacttcctgatggtattccagcttcagattctttcttgtgcatggaagtaaaataaactcaagagtaccttgaactctttaattctgaatgagcacaacataataccatctgaatgcttcaacttcccttgaaccttctgcttttctgcttgatcctcctacacaattattccaggcaattattgtcattactcaggcatggaatctgaacccatctttactaacttcatatttaagcaaaaccaaatctcttcaggtcttttctacttagtgaaaattcagaaacagtgtttaagaaccgggtatgaattggagcactttgtaacacccaaaggatgggaaacaccttacctcaaaatcttagtctaccagggatgggtagtatataagcaccatgacaaaggtgcaaatttagtaacttgggcttcctcattttcttttaagttgggcaaatgaggaggaccagttctatctaaaaattagcttttttaggctggaagttgcaaaattggccacctgcaagccaaatccataggtgcattttatttggcctgtacagtgttgtttaaaattgaattccttactagtctttaaacataagtaagatttgacattaaaaactatcttccaaattctcttaaaaaattggtagagctggtatcactgggtgtcccttcccacagaccaccattggctcaacatgagctaggtctgtccttttcatagagcaagcactctccaattgagccactccaggtatacacagggagtagtgagaaataatgctgtggaatgaggataggtcattgataggtcattctatggatgaccttgagcaccaacctaagcattgtcaattaattgtatgaaccacaggagaatcatcagagtttcaagagccatgatttaggaagatcatggtgcctctggagtccagcctagctagaagaaaggagaaaatgggggtaagggaaatcagtaaggaggctattacaacttattaaacaaccatgtctcctttttttaacccctctctcttaatactatgtgaaaattccttagagtgaactggaaataattctggactaaaaattagacaactaggctcaaattacaggatggcccttattagcaaaatgcatgggcaagacttaagcattccaggcctctctttgcttatctatgaaatggcaatgagggtattactgacctctcaggattatggtgatgataaagtgagaaaacattttagataatctttgtggactatatcatcattacctcctggcttcatttctgcaaacttctcctgaacagcaggcttaccccatctcttttctattgattagttttgactttactcaagttatttccaagcctggagctctccaggtcttcctgttatattgacctccttaattaaggctttaagtcaagattgaaaggttgaaaaggactgtagagacaagtaagtgtcccctattttatgtaaccatctcctctccagtatttaagcctctccttgaactcccccagtgatggagccctcaatccttattgaaaccattttcatgattaatcaattttttttttctgaaacctcgtaacttcaaactactttcctattactactgtgctccataagccaacagagcaagtctgctctttgccagaaaagtacttttgttctttgaagaaagctgtttggcctgaccacatttccaggtcttcttctcctgactaaatatgggtcttctccagataattctttatatgacatagttgcaagtgccctcctcacatcccagaggtctccccaacgtacactatattttgtatgatcatccaactgttcttcccctttctcatctcattcattagtcttgtgcttagacattttggtctcattccaccctagactgtgctcaaaagcacctctggccctgcccaaccacatttgcctctcctctcccttaatccaaatgtttcctcacatgttgtgttgcaaaaccaatttgtctaagagaagagttcatgctccttagggtcattggtgaaagatctcaataattaaatgtcaaaagttcatatttgactataataataatgtctaacatacattgagtgtttactacttgccagcctctgcacttaagtgactttctatatcatcccttggaatcttcacattcccatatataataagaactgttaggatcatccttgtttcacagttgggaaaagtgaggctttgtgacatgaaggagctcccaagtcacagagccaagaagtggcagagctgagatccaaactgggttgtcaggctgggagcctgcactcctcatcacagcacaaggccttctcacagcatctttgccctgatgcctgttgctgagggtcttttcatttgtttatttgctggataattactttaggtctttcacaggatttaatagaaagtataattactgttataattactgtaacacataaaggcttctttccttcttccaacttgcttgaacaaagcctctgaaaccacaggcgggccaccaccatcttcaggaagattttcaatagaggattttaggagatgacctaaaaagaggtggtaattcaaacccaaggtgttgcagttcattcattccttcagtgttcttcattctccttccttactctattttcatcaatagcgcttgttttctaatatataattcatgtatcaattttgtttattatgtctcctctcactagaatgcaagctccatgaagccagaagtaaatgttgtctgttttgtttattgctgaatccccagattagcatggaacaggagcacaacatatatttgctgaataaataaatgaataaatgacaacaataaagcaatttcatcaccttttggatgtaggcatttaaactttgaggttcatttttttcagccaccaccatgaccccctgcctctcttaacttcccctcacatacactcttcagctacatacactcactcagccttgaagcctgaactcaccagggctttgatttctgccagaggcttagctgatctttgaggcacatacacccctcatctgtgtttccttaatgacgtgtttgtcttgaacattgcgcttactgtgttgtattatagtagtttgcgtttgcaaacatctccctgactaacctaaagctctttgcaggcagagaccctgtcttcttcatgtttgtttccccagcacccagcacagtgcctggcatagtgctcaatatttaattgatgaatttaaaattctgtttccatagatagggatttggaaccacaggggtagacacaagctagttctgcatgggttttagaaacagaaattgccatttgaggatggaagtgctttattcaataagcgtttactgaatgcccatcatttgccaggctctgttctagatataggctgaaattagcaaacaaagtagtcaaaaatgcttttcttggaatattacagtgggaagagagacatgataaaatgataagttatatagtatgctaggagtaatatatactaaagagaaaaaaagtagggcaggtcaaggggacttatgattagggacaggagttagaattttcagtagggtgccaggataggctcatcaaggaggtggcatttgagcaaagacttaagaaggcttccagaaacgtttagtgagctcctatagtgaatgaagcagtgtgctgatgctgcaattccaaaatagagctcatacatactctagtgagaagactgccatgtcaaccagagtgtgatacatgtgagagcagccaaaatgttaatataacagtttaccagtaggctgtcctagagagagctgactttcaatatgtgatgtaaatgtcaccatcactgccctcctcatctctccttaccattctaagttgccttatatcctttgaaactgtgtagaatgctaggagggtggtaactttggaaagcgtgcatttatgcaaaggagttagatggtatcaccctctgggatcggaggaactttgaggtgttacaggacagccattggtctagaagtgctggtgggtcatctttcttcatcataacacagttatggttgggctggaattcttggaggagaaatgtactgaacaggccaaggaataggggatttcagtggagccgtctgttgacaactctcatcgtttggctctttggacatggagacaagccagtcttggagccatacagcccccttagatgccacactgccattggcaccctgcctactcctcaccatatcccctgtaatcagaggcattttgtaaaaaaccaccctgctgtgtagcacactgggtgtggccacagcatactttcattactgcctcaggcagtgcctataaaggttctctcttgaccacctcagcaacatgtactgagcaccttggctcaccaggactgacgccaggcatacaaagtggtaatcatgaaaaaaaaaaaaaaaggtcttcagcagagaacaggactaggcagtgattgttcgggccaatgacttgttcacatttccaggacagtcaactgtttagtatatttctcgtatgttaaattggtttaactaagttcagtgctttgactagctcatgaaccaacatgatggtcttggtccccctccagcagctgtctatggagaaatattttcagctccatggctaacagagaatctcaggtcgattgttgaataaatttcccatgtagctgattggttggacttaattcatataattatgccttttctagtaaaggtgtgagtctttctttgaagttataaaagtgtaaaattggctcacacttgaatctgatgagacaaaaatcaatcaagcagaagtcttatttagtggcatcttagcctactgtctagcagagtctgagatgaaatcttgagcacaagtgctttaatggtgactgggagccaagaagcatgaatgggggccaagtgaagggaagcaaagaaggaagtggagccaacgtgatgacagggaatggagcaggcccctgttatgatgactatctgctggattctgtggaaagcctgagaagctacgtgaagtgtagtatagaacctcctgtccagggtaagaaaatgggaagcatttatccattagctcccagccaccatgcatcaaagtttctctccacagattgttaactccatgcattgactaccaagtggtttcttggggtgcctgcctttgtgtccgcggagaagtctagcatggaaggagccaggcactgatgtgaagtgaggtcctcaggttgcaaactgcatgaagataatcagaattgcatgaagtaacagaattggctatggcagcaggggctagactgagttaggtgggactaggagactatgaagtgatgcactagaagcatctaatacaagcactggataattctatttatttgagtctaccttgttccaatacaggcataagatcgttcacacacctgtcatttgcacagtgttctactgggcaccccccgttctagtaaattgtgcaattgcttagtgaggtgttaaatactgtctttaacgaaagagcatgggcttgatatatatcagacttgtttgatggttgttaactgttattttgtctcaagaaaaaattcccctgcctaccccaattgtaagtccttgattactgcctcccttcccctcctctccacctcctaaaaaccaccagggcattctgtaagtttctccctgcctcagtaccactgtgcttcttttattccgacccctccacatctttcctctcttatatctgaagaaagcttaattgtcagcattttacacactgtcaaataaacagacaacttctaaatggcttctgagcttcctgagtttaaagatacaagatttggagtaagcaaagatttcttaaataagacacaaaaattactaaccagaatagaaagatggataaattagactttattaaaaattaagaactcctaatcattaaatggcagcactcagagaataaaaaggaaagctacagtctggaagaagatatttgtaatacatgtatctgacaaaggacctatttccagaatatataaagaaatcatgaaaatcagtaagagaaaaacaaacaacccaattaaaaatgagcaaaatacttgaacagacatttcaaaaagagaagatatccaaatggcaagaactattagtcatcagggaaatgcaaattaaagccataattaaacaccattacacacccaacagggtggctagaagcaaaaagacagtcaatgccaagggttagtaaaaatgtggaacagctagaactctcctgtgttgccagtgggagggcaaattattacaaccactttgggaaattgtttgcaatatcttccaggcctaaatctatatctactgtatgatctggtatttctaattctcaagataaatgagtacatatttccaccagaagacatggacaaggatgtttacagcaggcttgttcataatagccccaaagtggaaaagatccaaatgtccataccaaaaaatagatgaataaatttagtcaccagtcatcaatgggatggatgactctcacaatttcactctcaaaatgtagagtaaaagaaaacagattttaaaagtacatgcttatcattccatttacacaaaatttaggaacaggcaaaactaatctatagtgacagaagtcagaataatggtcaacctgaggattggaggaggtggttattgactggaagagggcagaaacgagccttctaaggtactggaaccgttttaaatccggagctgggcaggggttacaatgatagtggttatactatttaagaagggacaagattgagaacataaaattggtgacccatcccactagcaaagtctccaaggcctcatggtcaagtaggagaagaagtagcaccataatgagattggaaattattacattaggcatagatttaaaagatacctggccttcaaattttaactgttaactaattagccacgtaatcctgggaagtaacagttttggacttggttttccaatctgtaaaatggctgactgctgaggatatctcatgcccctccaaatcataagatcccagtaagtacacaaggctaatatgaagatatacatctcgtgttggttctgcttggctgaataacactaaggaacgcaggacccagagctaaagagggaatagagtgaaaactctcacattctatttagggctctgtgatggcaaatcttgcaatggccagaactacagtgaacccagaaagtgagttactgcagttcctgtaccaccaccaccatatgggtcatgaatttctttctgcccctcactgaatcatttcctgccatgtcagagaaaacctgcctccaacagtatatgcagtggttgactgaggctcttgggagtcagccccacttgggtttgaaaccctgctctaatacttactgtctatgtgaccttagatgggtcacataagcccctgagcctcaattttatcatccataaaataaggaggtcaccaactcctcagaatttttgttgtaagcactaaatgagataaaatctataaaagcccagagcacagtgcctctctcctagccaatattcaatgaagtatactggttattattagtgtagccagtgtctgctgtggccaccatcaatgccccaagtttcagttgataccatgtttggagataaaaattacttcttaatttcataaggtagcaaagcaggaaataaccttagaaatgatctggttaaacaccaagcatttgtttaggtcctaatgagtggcaaacaatagaaactgaaaagctagcttgcaaaaagcgtaatttattgaaagaaagcaggagtatctcatgcaatcacagcaaatctaaacaacaaaattgcagaatggcagaaatcagggtcactctggtgatctgggcagcagagtctgcagatcctctcttggacatcactataaatatgactcaactctaatgtctcctgttactgagatccaacacatcgcttgatgtctaatatagcattcatacttaacatggccaaaacagaactctgaggttccctcctgcccccaaagtcagctcaccctgccattttctccatttcaggaaactgtacaatcacccgcccagttgctcaggccacagatggagcattcttccttgactgttttctttcccatactctccacatcagcaagtcctattgatttcaccttcacactccacttctctccactcagctctgaccttgatcccatcaccttccttcttgacactgcagtcacttcctaacagtccccttgtttctacacttgctgtactataatccagtctccacttagcagccaaagtggtcattggaaagcacaaattgggttatgttactttatgcacaaaaccttccagtggctccctgttgcgcttagaatgaattccaaacacattaccattgccaacaaagtactacaggattccatctatttgtccaaactcccctctatgtgctcactcccttattcgttattcttcgggacacactggtcttctttccctcctggaattatctgcctttaattttctatgtggttggttcctttttattgcctcccaagagaggtctttctcaccacctgacctgaaatagctactcccttactcagtcacttctcatcacttcaccattgttatatgttcaccattgcataaaatctaatatattcctatttgttaattgtctgtatccaccagtagagtgtaagcctacaaggaacaagctttgtcagtcttgttcaacagagactagaacagtgcctttagtacacatttaatagatgtttgttgaatgaatgaatgtgttaaattgcttatgaaatgtcaaatgccagagaggatttgattgtcccagcttggggagtagaatgtctatcccaggatcattcacctctggccaagttcccagggtccttgagcagaggtactgctatctggagggccatacctgtgtatctttgcagtccttacagctgtcttaagagggctcagtccccattttacagatgcagacactgggaaggaccagagtgaataagaggcattctcaattattgaatcctgttgggttttatgttagtagggtatgtttcatctgttcttgtctcttaaattcaatggtgttaactacatgttgataaatattttccttcatctccacctactctattttagcactagtgttggaattttcatttcctcctacaagaaagaaatatggcccagattttcatggtgggacaagatgtttcagttttcccacgctgatttttttgttgtttgttttggggatttttggcacttcggatttaaaaaaaaaatgacaaaagagtcttggtgtccctttagttgccacaatcttagtttagataacctatctcttttgttttgttttgggttttcattttttttaattaaggcttagtctttgctgacgaaatctgaaaataagacctcattttagtttcttcttctagctaaatgaaatctttagaatgtgatcatttaatagcaaagaatgtgcctaatcattgacaagaatttaaatgtgtttttagctagtcaaaaataatatgcagctgtcagtccaacatttctactcacttattattctattttctctgaacttcagctaaggaaataaatgtcataacatatgatttcaaagaataaaataaaaaggtgttagtaagtattggtttggtaacaatagagcatatgaggcaaggtataaaataaaattaattccattttatttcctaatttgatttatcagggatctgtgggttctttaatagagagttaaagagatttagatatagatatggccattgtgtatttttaaattttatataccatttctatcataaaactttaagatagtcactccatccttttatgattactgtttgtatgttacatcttttcccattctttgactttaaacctatatatggctttgtatttaaaatgaattttcttgtagagggcatgtagttgagtgttgcttttttaatcaatttggtaatttttgtctttcaatttacttgtttagatcacttatatttaatgtaattattggtatgattggattaaagtctatattttccatctttttttgttccatctatttttattccctttttccctcttttttcccacttttgtattcattgagcattttgattatttcattttgcttttacttttactttacatttggcttcttttaaattgctttaaaatttttttatcagttgccctggagtttacaatatacatactatatatacttttaataattactttatcttcgtgtatatcataaaaatgtaatataattagattccatatcattggtatgatcaccttataaccaattaagtagtgaagcttctttcagtccctatgtatatatattttaaaaatggtatttgcaattataataacaattactgagcacttactgtgttcaatattgtattccattattataagaacttttatatttattgactcattcaatcctcacaataacccagtgagggtaggttgtattcacttatcttcatcttccagatgagaaaaataagtcacagagaagtcaaataagttgatccaggtttcaaggcaataagtggtaatactacttttattttaggagaaaataacaggataggttttcatctataaaaggggggccagagaggggaagaaagccttcttagtagctcaagttttcatgtgagaaaatgaagaaaagctgtattctcaggacaggatggtagtggtgagccacactcaaacaatcccatgtagatacagagtagataaccattatgactgttatagttgttactgctgctgctgccataaatcagtcatctctgctgaaagtaactctgcactaaattctctgtcatgaactataagtcctaaaaatgtttgcattagagggaccaccagtactggtgctcttgaaatccatatgcattgatgatgtgactctgggaaatcatgtctaggtttctacttctttaagttaggtgcatctttctccacttttatttgagtttcatggggtatacatgcaggtttgttacgtaagtaaattgtgtgtgtcccatcatccaagtagtgagcatagtactggataggtagctttctaaccccctcctattcttcccccacaagcagtccccagtgtctgttgttcccatcattatgtccctgtgtattcagtgtttagctcccacttaaaagagcatggggtattttgttttctattcttatatgagttcccttaagataatggcctctggctgcatccatgttgcagcaaagacatgatttcattcttttttatggctgcatagtattccatggggtatataaagcacattttcttcatccagtccactgttgataggcatcttggttgattacgtgtctttgctattgcaaatagtgctgcaatgaacatatgagtgcatgagtctttttggtagaatgacttattttcctttggtttatacccagtagtgagattgctgggttgaatagtagttctgttttaagttccttgacaaatctccacactgctttccacaggggctgaactaattacattcccactaacagtataagtgttttaagttgggtaattttttaaatagagattctccaactctgattagtttgtacggtatctaccaaagtgagggagaatcttcaggtccataaaaatattaaggtttaccaaaatctgaaaaattattggtttagcataagtactggtaacatcgcattgtaagaatggagccattagcaaagaatacagcataaattgggataagcctaaggcagttctctcaaaatgtgatacctggtttgctcaatattgccctcaccactacccccagcccaacattagttttattttgagcattgacataatattgccctacactgagtgacatctatgacctcacataaaatcagtcatatttacaactacgggtgacttttggctgagttggaaaggcatgtaaaatatttcacagtattgaaggacatgtacttttataagttaattatttttagtattatttttcccttctaagctgctgagaagataattgcattttagaaaccacagtattaatgttaggcactttgtcactaagcaatagaatagactttgtaatgcaatttacataaattaacgactcccttctggtgcatgttggatctccaggacttaaataaagctttcaaactagtttgatatttggtggaatattaagcatgtgaaatttgtttcaaagtgtttcagttccattttcactcactttctctcctctttagaaagaagttctcacctcagactatttgttcttttccttctcgttctctctataaaacgtttgggccttaaagaattatattcaagtgatttgtacagaaaactagactttaatttgaactaactttagcaggaagcattctgaaaatgtgacacaattctctgtcttaggaaatagttcacatgaaaagaatggagctttcttagcaactcaaagaattgcagagtgttactcctatttccatcagaatgtttagacctgtagtaataaatgttttagaatatataggcaaattcaaatttaatttggtccttcatggaatctgaagaaaatatgtgttctgtgcctctacttgtgggaaatcctggctcttcttaacatttctcctcccctttcctttctttaggcaaagcggggggtgtctattctacccacccggactgtgcagtggttgtcattttagtaagaacccaggattcaggtgggttagcacttctgcaccctctggaggttcaggaaaagcttggtggtataggaccctttcaccataccaggactaagaagctttactgtgattattcgctttttgagagtatcctcacttcttcattccctctgaagtgacaagaggctgtatcttctcatctcgctggcctggcagagcccatgctgagccaatcagtgtctgtagagcctccttttgcactaaaattctttcttgcaaaattggatgccccatggggtacctgctgcagtgaaaatatgccagttctgcagagctgtgcaagttcaggatcaggtccttgaaacatgataaagggacactataagtagtacggagcctttatcataaagttctctgaagcggagttcagaagtgaggaaaaacattttagaagagtttgtactgttaggaaagaaaatgaagaagtaatttcgagtatttttggtggatgtgtctgggtataatggaaagagacaggacctgacctcttgaaggcctggttttaaatctctgtgtgacttgctacctattgtggctactccattaaaagcagaaactggtagcagaagagatttacagatttttttaacgtattgcataagaaggtgattcagtgttttcatgaatcttgtcataggggattggtagctttttatgttgttgatcttctggagatttccataacatcatagacacttgttcaagaaatatgtatgtacaaataagaagctaaatggtgggccagatggcctctgggtatcatataattttatttcatgctgctattcctccctacctaatgatttaatttttaataacatatagggaagataaatcatattgaatttttaaaatgtataaatatgaaattcaattagttacaaagaattatatattatgtaaatgtaaccttaaggaagaaaagagaaacataagtgtctatttattaggtatctttaaagtcagatagggcataataaggatcagttacactctgctaacataattaagtcagaagggaatatgtgatgtcaaaatatgtcaccagggaaggtcacaagaagtatctcaaaggacattgcattggtgaagtctttataatctagtgaatgaccctccactcttttgactcagaaacatggtattgtcaatattccaaaagtggctcaatctctctggactacatgtgtaaaccagaaggtcatctaacatgcagtgagaagtataaccatcaagcaactgggtattcacatgctctgaccagctttcccagtcgggaaatcaacatggcaggccaaagacagcacacacacacagacacacacacacacacacacacacacacacacacacacgaagctattggactgtaatcccaggcagtgtgactccccagcattcttaaccactgcataaaaggtgcccttataatcgatgaacattgctgttaaaaaaaaaaaaaagtttgctcatttctgttccatagcctacttccttgcttccatccttccactttcattgagaacaaatttgtttttggcctaagagaacacttgtgtctagatcctccctcctgctgcttccccaaatccatcaactctcctgaatcttcaaactctgaatctttgaccctcttctcctctggctccaacctctcaatttgcaaacttgcttgggtttcttccatcctaacaactgatgctcttttgatgccatgtttccttcagtcttttttcttctcttaagtgttcagggtctttaaatagtagatttgtcatctctccttgcttccctgcagtcctgcctttatctcctgcctcaaaaactgcttttgcttcctgccaactctggtagacactttgcattcttactctggcccctcttcaacttttgatacaggtgacccctctctacttcttgacacaagtatcctcctaagcttctgtcaggcttttcttttctggtgttcttctgttctccagctactactcatctccattctcatcttctctttcttcatccttccctccaatgccagtctcccaggttctgtcctgagccatcagctcatctctatgtctctcctaccaaagtggcttcaggtttcacatgtatgctgatggcttctgtctctgtctcaggcccagatctgtcttatgaggccaagatctgtaaatggagctgttaactggatgtctccacttgcatattcccaagaaacagccaacaaagcatgcggagggagatatttcctgtcttcattacctcagatcaacttctcccccaagatccaccaagaatttgcaagtcaccccactcctccttcctcctgtgcccctttagcaagcagtatggattttctctcctttgaagccttcttttcttttctatgttcctgccactaagttggcccagacccacacattttctcttttgattactgcagctgcccttacatatggtttttctgtctttattttttgtcactctccaggtcagccttcatattacagataaattaatatttccttttaaaaatgttaaaatgtgaaagtggtatgtgctcatactatttttcttaagccttggacaatgcgttggacacataacaaaaagttttcattatcttaaagcaaatatataaccgtggtaagcatactggtacatttccttccagctttaaaagaaatgcatgaatagtttttctaatcatcattgggatcatgctccatatatcactttattgcttgatttcttcacacaacacataaggcattatcccatatcattaaaagttatcttaaaatatgattttaatgaccacactatagtctagaaaatgaaatggatgaaccataatttaaccactcctctattgttgaacatttagtttgttcatttaaaaaaaattgtgcttaaatctttaactctttcctctcattatttccttgagatcaattactagaaatgaaattatttggttaaataatatgagtatttttgaattttttgatatactttaccaattgctttccagaaaagagataacaaattattccctttgtaatgcatgagattggatgtctcacactaactagaattgaatgttcacatttaaattatatgttttctgattcaataaatgaataattaaatttctaagtgaagttgagcatgttttcatgtttacttgctatttttaaattccgtgaatcatctatgcatgttgtcggtttgtctttatgttaaggtttcggttattctgttattattagtttgtatgacagagtagtcattctgaaattcaagccttgtcaaaatcctgtatcattccctataactctcaggatgaggttgaaatgccttagcttggcacacggtgccccaatcatcacgcccttgactacctgactttgctgctccaagatgcacataaatacagtacaggctattctgaagtctttccaattctcaaaaaaaaagtatttgttctttatgcctcatgcttttgcaacatgctctattttctactcaaattactattctccacctgacctctgttttgcctagccaactcctgctcactttcaaaatcactcaagagttacctcccttgtgaggaagctacttttgacctattagcctaaattatctagccctttctgtgctcttacctgagcaagcctttctcatacccctcaccacactgtattgtctttcctcataaaaagggcaggttttttgtttctgcttccccagggcctaatggccagcagatggtagatactcaataaagagggaagaaggaatgaagctgtcattcttcagctaaaaataactgcatttgcccttggaagtttatcccaatttgaatttcttatttgaatattataatatgttctggtccttcatatgtacaagtagaaagagctctctagtatttttgctaatctattaaagcttctatatataaagtgtgtggctaccatatagctaatgtctatacccacccatgaagttgtagaaaaataattctttggcatgaatttgataatctccaaaaatatttattattatgcacaaagaagtagaaattataaattcataaggtcagttatcatagcatgtagttttttcagcttaattccaaggaaaacacagtaagatgctaagaatattactaggtatatatccaaaggattataaatcattctactataaagacacatgcacacgtatgtttattgcagcactattcacaatagcaaagacttggaaccaacccaaatgcctatcagtgatagactggataaagaaaatgtggtacacatacaccatggaatactatacaaccattaaaaaaggatgagttcataacttttgcagggacatggatgaagctggaaaccatcattccaagcaaactaacatgggaacagaaaaccaaacactgcatgttctcactcataagtgggagttgaacaatgagaacacatggacacagggaggggaacatcacacaccaaggcctgtcgtgggggtggagggctaggggagggatagcgttaggagaaatacctaatgtagatgacgggttgatgtgtgcagcaaaccaccatggcacatgtatacctatgtaacaaacctgcacgttctgcacatgtatcccagaacttaaagtataataaaaaaataaataaataaaaataaaagaatggcaggatcaatggataagtggatggatggtcaataaatctaaaagtttacttgacaagaaggaaacatgttaatttggaaaaataaatttttctattacctaagaatgcttctgtgtaatttcacatttaagaatgcttctgtataatctcagcagatcatttgaggttcaattatatgctaacattaaaataattaagctctaaaagggaaattggaaaaattttgctgtgcaatttagggcaacccccccaccaaaaaaaaaaacaaaaaaaaaaacaacaaatcaactcccaagaatatggcaaaaggatagcataataagaatatccccaaatctactaattatattgggaagccaaccttcactttttaaacacatttgtcttttaaaaagttgaaataataattgcttgcctataatctactggatccacttgcttaatttgggggccaactaatctctcaagtagagttagctaagttttatcaattgtcacacccttccctctaggtagctttccaagcactgtcattgtatcctctctctgttgaacaagaaagaactgaggttggtgttacaccagttgccccactgactaattacaatttagtgtaagaagtttgctgagcaggcaatttcaaggggtatctgcattttaaggcttttaattccaattgcagaatgtaagaaattttaggcatcagtaaactactggaaaaagctgagctacttgtgctggttgccgaatactgtctgcacattcatgtctctgtatcttcaccagatgctgttctgtctgcttaaaacatcatttaccacctcaaattccacgtactttccctatggatcaagaaagtacatgtgccactttatactatgggttccttcttaggtatgcatagggcaccacaaaaactgcatttcaggggcaggtgtatccttagaaaacattgatgagagaagtcctagccaagttaggctgcagaatcacagaatgtttgtgattaggaaatgttttgtcctaagtaagggtgatcttgtctgtggggaaaaaaaaaaaaagaatgtaaggggcatatttctatgaattttgttgttgttgttgttaggaagaaaaagacactaaatgatcatttgctttccttcctaaagcactctccactctgagcttccaatcaaagccctgcagtgcctggagggggaaatccctgagggtgaagtcacctgattccactagcattgtaggcaaacttggttcccaccgctgggactcggtggcactccacagctgcctcccttcacacacttgtcactcagcatcataccttctcctcacttccccctacctgtctttcccttcctctcactcttcttgctttcatttaaaaagcaaaaataacaccagtggaaaaaaaaaaaaaacactggcgaattaacatttaaattctttcagttcagctggattcagctttttttccccctgactctgtggttgagtttttaagatataaataaaagacctcttagaaacacagtgattaaatttcttatttcatcacggaagcttccccttgtcctcttctaccctttcctagaccttggcaaagtactctttgcttctaaacttttaactcctgctgctcatgaaactgtggcttacctattaggtgaaggtcatgactggcctgctggtaatgggctgcactttgtgggccagtcctggctgtattgacccatgagctttcatgtcagggattgtgaggagtgagtgtagtatcaattttactatttcccatgagtttcaattagacttccaaattctaccaataaatgttgtaatttcctcaaagtcattttacttaaatcctattatcctgatcttgctactatatttctgtgtacataagttgactgtaggaaatataattctttcaggcttccgtcttcacggttttagtcatatatctttggctagtaccaattaacttgacagcaccatattaatactgttctaatgattcatttccttctatgctttttctgaattttcaagatagactttgttccatttggtttatttttctttatgattttaggcacaatgatttactgatatttaagattatcctggaacaataattcattgaaaatataagggtgactatgactattttgagagagggagaaagagttcaaataaagttcaaatgctgcaggcttccatttatcactgaacagaacaataaactaagaatagacaaagtggcctcctgcaaatttcatcccaattatgttttctgtattctctttttctcatcatttaatatctcatccctgttttatgatgttgtttattgtttaatacacaagatatagcagttgttgattccacctacaaaattaggatttattttctaatttacattagttcatgattttctatgtttttcctgcatattcttagagtaccaaatggataaaatcctgtattggggcacaggctgagtcactgcagaaagacacctacagatgcagcaccttacctaagatgcatttttttttttctgcatcactgttcagaggtagctggcagtccatggagggtcggtagctttgccccacagtgtcattcagggatcctggaagcaagccctgccatgctccatacttggtcccacttgcgggtccaagttggctgcttcacttgtctctatttcccaaccttggggaatgaaaaacatgaagtagaggacaatctttaacaaggagattgagaagtttcatgtgtcacttccacttgcatttcagtggcacaaacttagtactatggtaatacctaactgcaaaggaggctggaaaatgtagtctctagatgagcagctgtgttccctggtaaaacttgaggtgagggtcctattactcaaaggaagaattgatgcagggtgtcatccataattagcaatgcctttcacagatacttttaaagttagttaccttaatatagatttataagaattttatttttatttgcaaattgcccttaaatgattccccatttcactatttttctactcttcctaaacttagatgcttggtgggaatgaggagctgtcatcttacatactgtctgtgaagaagtatctgcgtgatacccattgtcctcatattcagcccactctctacattagcacataaataacatgaagataaaatatcttttttctccttataacagatgaatctggaaacaaactgatgatttatttacttaggcattccatagggtctacagtataaaaaggacatcttatgtttcctcttgggcttcccaaccagtattaggcttaacaacttaagattctcacaacccaactctttgcctcaataaaagaatactctttctagttcgttgcagttcaccataggctgtgttctcatccagagacccaggcctggggggaaaaaatagtgaagttggttattatctccactagacaagtgatgaaggtccatgtaggagaggaaggaagttggcatcagacccagtttttgaatctgaggtgttgccctgtgctccctgttaaactagctctgtcagtcatagctgatgcatctgcagccacccgtcagccccacagaatggccagcttcccgcatatgtagccccatgacagaaatagttctgctttaaataggcaagtctcacatgtgtgttttaagaaactgtagaattgcagaaagggaaggaaggaaattaactagcccgagcttgatgttgcatttacatcatacttatttattgagtttgctccctgttgggtgttgtactaggcactgtggatatagtgacacagcttctgacctcatggaactttcagtctagcaagttgacaggcatcaatcagaggataacttggctatgtcattagaactgggatacagaaagagacaaagctaagggcatcctgcccaaggcaataggttgccttcctaggccaaaagttatacttcggggatgaaagaggaaatggaggaataaataacgggatcaggattttgagaaactttccttcactcctcatttctgcttctctatttcttcagaaatgcagataactttttgaatatgtttagataggaggggaacaatagttactagtctgtttagcctcaaatcatccataggttgaggattctcccctctattagaatcctcagagggtatccatagagggaatattgaaggtgggtgaactcaagatctgctttaaaatgggcagctggggcagccagccagagttaaagccagtattcccattcacatcacaccttacttgctggtgcctgggattccttaacgggaaggatcccgcatgagagaataagcctcagagccaagaaagctggtctactctccaaaagttactgctatggttacttgtttcttttaatggtttaattttagttgactggtttttattaggtcttcccaacagccttctatcgtttgtgcaggtcctctctggcccagctgcctgttgctgcaacgtgagaacttctgacagcaaaaagagggagtctgctactgaaagcttgactgtgttcttatttaagtccttaattaggaagaacgctcaggaatatattcattggatgaataagagcaaaaccctctcccctccctgcaagaagaaaagagagtgggggtttgggtgcagggaaggatagacattaatatcctcgggtcgtattattctttgtcgtttacagcactttcatatgagtaacttttcaaattagtgtactaacccagtgaggtaggaaagctgatatcatcaccatcttacagataaggaaagtgagatttaagaacagctatttgctcacagcacccacggcctcttccaggaatcccatactctttccagaacacctataaaaagaagctccaagccagaccctgaggaaaacctcacaatttggctttgaatcttctctaaagaggttaaatctatgacaatgaaagcctattaaatgtgtgtatacttaaagatcatgaatattctacttctgtgaaaagtttagagtctaaaattcaatcagatgaagttcaatgaaaagggacccataatggaagtcatgcttctgctaatgatatcacaggacagagaaattcgtttagtgaaatgtacaagtaatctaagagtggaagacgtgtgtgtattttgggaagtggggggtagcacagagggaaaaagagaaggtttgtgtaaacattaaacccttccaggcaggggcctgtgtgatccatcttccttcacaaagtgcccagcacagtgtccagaactgggctacgtaagtgtttgtataactgaacagaaagtggagaccaagttctcctttgaaagtctaaacaaaaatccatttctgccacaatgccatcagaggtgtggtcactcagccctgccacctgtagagtcactctgtgaacaagtcaaaggccttggtgtgctaggtgtgttctcatctgttagcctccgtttcaggcaaagttttgtgcctacctgaaggacctcttcccattctccaccatggcatgatagcaggctctgccagtcacttcctagataaccacagtgagtgaggtttctttgcctggttgggtattgaagtgctctttctttcttttttttttttgagatagagtttcactcttgttgcccaggctagagtacaacggcgcgatctcggctcaccgcaacctccacctcccaggttcaagcaattctcctgcctcagcctcccgagtagctgggattacgggcgtgtgccaccacacccagctaacttttttgtatttttagtagagatggggtttttccatgttggtcaggttcgtctcaaactcctgacctcaggtgatccacctgcctcggcctcccaaagtgctgggattacaggcgtgagccaccactcccggccttgaagtgctctttctaactgcctgggcatgtctgttcttcagtccacagagagaaactgttggaatattctctagcttcccagaagttctgtacatgtctttaccttctcaagaatcatgccaatcctcccaccccagcctggatagtccatctttattctggccaaaacagaatttgatgcctttcacttctcctttctcatatatttctgctatctgtccttagaaatcagcataattgtgtaaagatagtacatttgtgggaaattttatatccttacttttagggaatgagaagagatgcatgatatataatagtgtgaaaagaaaaaccttagacaaattaaatttaagagtttaatgaagcaaagaacaatttgcaaattgccaccgccatgtagtcaaaaaggatttatggagagaaaaaagaaaatgacaaacagaaaatgctagtgaggtgcagaaacagccagattgggtataggtcagcatttgccttattcgaacagtttgaacagttggaggcctttggcacaaactcgctgactggagtttatagtctgtttatacattcagttaggttacagttcactatgcatggagaaacctttaggccacacttcaaatatgtaaggaggcaactttaggctaaacttaattttacaatacctgtttacaacagctgctacatattaataatattctattggccaggagcttcatgcagctcatctttaattctcacaataaccatgcaaggtaatcataaatataccattttacagcttcaaaaacagtgacccaaagaatgggctccttacctaacatctgtgtaaatggcataaccagaagtccagtctgtctaactcttgagctgcctctagaaaaagtaggcctatgtaacaaatctgcacatcctacacatgcaccctagaacttaaaattaaaattgaaaaaagattccagtaacattagacaagaataaaaactcttttaaaagataatacccaataatagcaaagatctggtagaaaaataaaatgattcaataccaaaaaaagaaataaaggaaaagtaggtagggaagacattttcatagtcaaattcaggatgtacttaccttcaagcaactagaagaacttaccaagaaatgcttgttggtcacctactagagaggtctttctcaaactgacccatgtatcacctgcatctgggcctcatcccagaacccctcgattagaacctctttatttgcgactttgcaattgccattgctaacagctctccaggtaattcttacattaccagagaactgtgccaggcccagagcctagagcagtgtttctcaaaatgtaatgttggaccacttgcataagatcacctagagcaattgtgtaaaatccagagtcccaggctccatctctggaaatagggtggagcccaaaattgatttatatttttaaacatccatttgattaagcatcacatgttatcattaatggtgcaatggtggtgaacattacatgttgcataattttacgcatacacacacataactagagattcaataaggttttagggtatgtgtgtgtgtgcatttctaggtgtaaagaaattatgacctgaaattattagtgaactaatatttgagaaagcaaagcaaacatgtatagatcaacaaatagatggtatatatagatagtgtataatcaaatgctacctgtgtggtacagaatctgatttcagtggaagtagataagagaacaattaatgaaggttgaaagaatcagtgctgtttttatggagaacggatgtctcaacaggcatcttaacagttgagtatttaatactttcccatatcccataattcatgaagattgcagtaatatactgcttttcccaaaataaactacaggaaaaaggaactgtgtcagcttttcagagacagagctgcaggaatacagtaggcaggagtagctggccctgaaatgatataggctgtggatgccatgcggccagcactccatcacagtgactcactcgggcaccagcctgttctcacttgtgtctcaggctcccccctcagcagaaaagcttgaggaccacttaggaatagtcatgatgcaaatgtcagtttctcctttgctgcagcagtaccaaaatcttaacaaatgagctgagtcacctggggagctcctgcaaactacacattctggtctattgggttttattaaaattagtgatttttcttccttttaccattttggagttcatgtttgcaagtcattcccttctagatagtcatgacattatctcccccttctgggacagcagaaacattggagtggcctcactgggctggatcattcaccagctttgcaattacacccccacatccctggagtcacagagtggaatagtgatgcccactctgccgagactaaatatccttactccaacctaagagccacctttaggctctaaggcctttcaactaaattgttatttgagttcttaacctttcaccatattttgcaatgagaaggtacaaattttctgcccacattaactctatcgctttatcctttagggcaactgttcaagctatttctcatttattaaaaaaaaattatcaagtattctctgatgttataagccaaatttacgagaatataatttttaaaattcatacaagtcacatttcccaatttttctaaaccatctggcacctgcaatctaaccaactgccacctagattcagcaactaggtctttggaaaggtttgtggagtgttaaaaatccaagcacacagtaggactttgctcagtacttaaaaattctactacttctaccacgaggaaagctcattttgcttctcttcattttaaatcagtgtgatgagtttgtaatattcatacttatatttaattgcagtagtaaagagttattttaaaacctcataataaaatgggaaagtattctaatatctcagttaaccaggcctttgggaaactgatgtgttcaaattatatccaaaggattatgttgatgacaacccaccatcaaggcagtcctgaatattgaggacaaagagaaagtatcttgagcaaggctgcacagatacctagggagggaagtcagaaaatcagagttcttgtccttgccactgacttcctgggtataagtcacttttcctctgggccctggctaatattagtttacattggtatgtgtgtaccagattcttgaaatatggttggattttttttcttaattagagagagacagggtctttgctgcccaggctagagtatagtggtacaatcacagcccactgcaacctcgatctcctgggctcaagtgattctcccacctcagcctcctgagtagctgggactacagctgtgtaccaccatgcccaactaatgttgttttaataggtagggtcttgctatgttgctcaagctggttttgaactcctgggctcaaatgatcctcctacctcagcttcccaaagtactgggattacaggtgtgagccaccacgcctggattgaatatgtttatattggtaaatatcctttacccaggggccctgcagtgctgccttggtcactcagcccctttcctgagattccctggatttctccatcattcagtcagtaaaggcttattgcctccctgccagcccccggtcaggcagtttccatgcagaaagatttccaaatattttgagcatcacctgtgctctgggcttaagatttcttacttctggaatgaaagtttagaatagataaccctaactctggaatgctgaggttttatgttgtacgtttattatttagaggaaaaggcagatttgacttggggccagaaccctgcctttgcctctggaattggctttttggaaaggtgtaaaactatttgcattgaaagccaggaaggacctgaaagcagttctctgccaaattgatctgtacactttggccatcaataacttcaagtataagattacttatggggccatcattgaatcataaagatgaacgtctcctcctaagctctagatcagtggtccaaaaacaggctttggtttcacagtgcgatttagaaatgaacacaaacatattcagtagatgaagatagagggtcatcttttcagagaaatttaaggattaagacagcatcattttctcttgaccagtgtgaccttttgtttgtttgtttgtttgtttgtttgttttgagacagagtcttgctctgtcacccaggctggagtgcagtggcacgatcttggcaccagccaccacagccggctaattttttgttttttttttttagtagagatgaggtttcaccgtgttagccaggatggtctcgatctcccgatctcgtgatctgcctgccttggcctcccaaagtgctgggattacaggtgtgagccaccgtgcccagcccagtgtgacctatttttgaggtatcagtaaccacaataatagagcagtaacacaagttgtatgttggatatttgagtggtctgttttggataatatatgcttattaggggaaatgcgaagtagttgttctaaaatatgtgtcattcaactttctcttctatgcaattaaaacattttaattgggcagtttaggactttgctaggccctgggcaaataggaatgaacaagacagaaagtgtccctgactttatagtgcttccagtataggtggtactcagtgaaagaaagttaccattaatgatgataatgggaggcagatttgcacagtggttaatggatgctagagaaaaactgctacttattaactgtgtgaccttggataaagtaattacctagccacttataagccttagtttcattatctgtaaaatgggggcactaatatttccttaggtctgttaataaaatcaaaaagatcaggccttataatatctttggaacaatgcccaacatatagtaactgttcaacatatggcatctctgattattaataaattggaatcactaataaaaagaaaaataacaaaataagagaaaaatgtttagctcagttctctttttcaagctctctctggagcacagaggaacccattttctataggctaattgatactgtttgaaagctgctacatcactggtgagccttccttttctctgattaaataattcaaatctcccttttcacttgttttaaagtcatgcctgctttcttaaccacaagtagcttcttattgtttgaatacactttttgaagagtggattgaaacccatagctgcttaattgtcacttgggaaacttgtttaaaacattcattcccagatggcaactccaggaatctgtggttctgatgagcaaaccaaggtattttcatgcacagaccaattgtagacacagtttgagaaattctgctcgtgacagctggtcttgcaaacccctataataaaggcagatgccataaactggacatatgtccagggctgttattagtcagcgcatgcctgttgaaatgtcaagctaattccctactgccattcctaggtagctgtggcctggtgtctctgacttttcttctccccctccctcactctaccccaaacctcagctgcctgaccctttctccaggaacctcctgaccaaccaacaactaaagaagtaacacctagcacagcattggcctctgccataggggtatggctaatgcgtactctagaactgtactgattgataatatttttaacattgcctttggaaatgattgatttagggaaaagatgacatctctgttcctcagtaaaatagccacacatacacacacacacccctacacacatgccccacatgtatgcacatgcatgtgtgtccacatacctccctgagacatctcactaaccactctactaagactccttcagtttaattaatacccaacttctttattgaagaggagaaggaatggatggcacaggcttctggcccactggttatgatgaatgaacttctctaccctgatatttcataaaaagctacagcatcttggcagtattctccaaggcttcattggaaccagcagaatcccctttaaaatacagctttatagggagagaaagccctcttagttatttacgttataacatggttattgggtatctggaggtgcctgctatgtactcctgggagtttaatttgccttgctgtgtgtgcttttgtgtgtgtgtgtgtgtgtggtcttctaatctgagtgttcatccttactatgttcacctaagttttcagcaaagatccttttaaccgttaagggttgacatcttgcaaaggttcaatgttctggtgtgccaattcctggctacaacagattaaagtattcctaatacttttctgttctcatttttaaaaaaaatattttcaggagatggtaagagattctatacctttaaatgctcccttgaatggccttagttctgacttctccaattcaaaatgattaatcacctcacttttactgccaagcctgggatattatggcactgctcagagctaacttggtcaagagtttcatctttcctggaattgtccttggtatttcaagctttgtgtggggtaggcagcattttactaggagtactaaggcatggattctgttcctagttctaccattaacttgctctgtgatcttgaccaagactctgaatcactctgtgccatagtttcatcattaataaggatgataacaacaaccactcacagctactgagttatcatgtgccaaacactaactcatcactttatatgcactagctcattcagcaacccttttttggggagttactattcatcagacacatcttgtgcattatctcattaaattctcataacaatcctatgaaggagctgttcttattattcctattttgcagatgacaagactgacagttacaagggcagaattacttgagcaaggctctcctacagtaagtggcagatcaaaaagttgaacccagtatggtctgataaccaagccaatgtttatagccacatatataccatacttcccccgattcaactgacaaatggagatgggtgtgaagaatactttgatcaaagatccggaggcaggaatgtacagagcagtgcttctcaacagggagcaattcctcccttcccaggagacatttgagagtatctgcaaacacgttgtcacaattagggggatgctactggcatttagtggatagaggccagggctctcaccaaacatcctacaatgcacaggacagttcactgtaacaaagaattatctggacccaaatgtcaatagtgccaaggttaaagcaaacctctcgagagcaagactattctgctagtgtatctcaaaagaaggagacaattgggcactcttggtattgcctggttgctaatgtacccacaaatgtccatcaggttatgaggaattgaaactgtcaggatatggggtacagtgagaatcaacagctcttcttgctggcaagcaagactttggcttttattaatcaagtttaatcaagatggatagaatgggaaggtcttcaaactatgtgaattctcacattacaccaaaaaaatttagtacctattcaagggtaagaacaaaccaactaacccctggctacatattagaatcatttgggaagctttttaacataccattgctcaggtttcaacccaagagattctggttaacttgtctggtatggcctaggtggttccaacgcatagccaagattgagagtctctgactatattagatcaaggtgtgcagttaaggagtagaatttggatgaaacagcagctttagggatgagttgataagaaaatgagcatccagtacatggaattttaaaatatttgcaacagggttccagagatgtattgcccgaatctaatcatgaggaaacagcaaacaaatccaaattaagggacattgtacaaaatacctggcctgtacaatacaaagatgtcaatgtcaaagagtgaggaatgttccagatgaaacgagactaaagagagatgataattgttcaatacattatgtgtgattttcttgtgttataaaggaacactaatgggacaattggccataatggaaagtggtttatagattataatattgtatcagtgttaacttcctggtttgataattgtacagcagttatagaagagaatgtccttgattttagtaaatatataaaacattttagaggtaaaagggcatagatctgaaacttttctcaaatgattcaggaataaagtgtgtgggttttttttgtgtgtatgtgtgtgtgtgtgtaaaggatgggtgggacaaaaggataaagaaaatgtcgtaagatatgcatattggggaatctggatgaagggtatataggaattctttgtattactctatttttgccacttttctctaaatcttgaaattatatcaaaatacaaagttaaagtaaattactttaaatggtaataaaagaattcctgtctccagagtccttttgggggctaagatacttgtctgcatttcatggatgtcttaggtgacatcttttgttcaaagaagagggaatggatagaaatgggcaagaggtatcctgaagattatcaggtaattattattattttataatgagggaaaattaattgtgactttcaagctaggagattcccctaaacaggttttctgatagagctaagttacctcttaaagcgcctccgtctttaaacatctaatgtcaagtcaggttcatctaagtcagaatagtgacctgaagagctacagctacttttagtactttgtctcggagaatgcagtttccctctttttagatccttttatcataaggtggggtgagggcatgggaggagtagctactgaagaagacagaaatagattaaatattcaattgagtaaaaccctttaaagcactcccttccccatgaccacccacaccctgccccatctatgcctccctctggcataaataaaaaatatttaggtggtgaaagggggtgcaggaactgttccttctttatagaccaaaaaaaattaagtaaaattaaaacctactttctataaaaaaaaaaagttttaaaaagtgaagtcaatgaatgtttatgggcacaaaatttattgtctacttcgaagaaagtgatttatttttacattgttcttcatgatccattgatagggcaaccacccaccccaactggcccaggacagttcttctgggtactagtcctcctaccataattatcaacaccttcttttacactgaaatgtgtcttagtttgaatatttagttctatagtcatctacctatagaaaaagccatttctcctcctatgagaaaataatttttaccaagaatggtattttacccagatcactgggcttcctaataggaaaattaacaagatcaggtaaatagccatgtggaaatctgagcccatttgtgatagaacagagatggatgtacaaatagaaaaccaacacgttccacaaatgaaacaatgaaagacttgagaacagacaatcaaaggggacagttttgctgtttcttttttcctcaaccaccattctaaattacttttttgatagaacaaaacaatgttttattcttgcccttgcaggcagaggctgcattgccagcatgcatttgtcttccatttccacataaaggccggatagtactgatggtatctgcttaagaacttaataaaactcacacctagtttcaggggaagtcaacccaggcatctgtttggaggctgccactcacctctagccctgtctagctcacaaaatgacatacatgtttgctgctctgttcaacctatctgggaagcaaaggctccatcaagaggaaataaactgtagctgatacatggccaagaggatgatttaatgcagtccagagagctttcagagcaatttcaactcccatgcttgagtgttgaaaaagtgtgactgcagtttaaagtccttatgtacgagcttatgggacagcttctttcaaatacagacaggtttttgtatttaaaatattccccaaagtagcattttgtgggaaagactgtgtataacccttcagatctgaaacagggacagtttgatggtgactagattagagtttaaacacgttctttatgttttggccagtgcagattgacaggtctcatggatgcctcttttgatggtgggatatttaaatcataggaccacagagctcctagttgtggccataccttacatactcctggacacagttgctgtttcttgtggtgggggcttgtctctcctcagagcttgtgtcgtggcaaagtatactctatgatgggcactgctgctgatgcccataattgaaggcagatattccgaggaaacctctcatgatgtaataatatccactagaattctacacaccaaccctgcatagttggtttttgttttgttttgtttttagacagagtctcactctgtcactcaggctggagtgcagtggcacaatcttggcttactcagctcaatgcaacctccacctcctaggttcaagtgattcttctgcttcagcctcccgagtagctggcactacaggtgcacaccaccatgcctggctaatttttgtagttttagtagagatggggtttcaccatattggccaagctggtctcgaactcctgacatcgtgatccaccccccttggcctcccaaagtgctgggattacaggtgtgagccaccacgcctagcccaaatattcttcatttgggaaaagaacccacctcactaaaatggtgatgacctcatagtggatgttcctttactgttgttgcatttgtggaacatcttccatactttaagaaactttctggtcgcatctgataatttttatgtggcatttgcactgatagagcatgagaaattaaccaagctctaagacggaatagtggagaagagcctgtgtctcaatagctgtgtagcaaaataaaggtcttagctctgtggccgtgctacaagcactttgtcatcactagcctctgacaatcaaatagcttttctttctcaagaataaaaaactaggtgatgcttataccaagccaacaaaaaagattttatgatttttagtgtccaaccattaaaagaacaatgactttgggtgccatctgagtggcttagaggaggtctctatttgagagaagatggtggagccaagtccagtgttggcaaactcaccaactgttttgcattgtgattgcattctcatcatgagctttagtggggcatagaggctacagacttcaaaggcaattggctcagggaaacaaaagcaataataccctttattttttgtagcaaaaataatatctactgtaaaaccctagtctgctgatcataagaatataatcttagccacctcagggttttctcagtcaattcagaccactcccaaacagatgctgaatttaaaacacttacacatgattcctgatcaactgtggaaaaaaaaaaaaggtgatgattgcaccactgtactccagcctgggcaacagagtgagacctgtctcgaaaaataaataataaataaaatgaaacccttatacattgtcaaaatgttgagatatggttgttaagagtgacagtgaccttgtttaaatttagccaatcagtatccgccactatattctcagcctgctggttccagtcatctgcatatattcctcatggcaggaagtgcccatgtttccatttgctcccctgttaagaggccacgtggttaccctccatcttccttgtcctggccaaagggtctccttgggtatcctgctctctcagcctacctctgtacccctcttggaaaaattcagaaagtacttggtggttcttccattacactctagaactatgggaaatccactggggctgtctcgggacctctctgcctagatgtccacacaaccatgtctgctctactgttaacataggacatgggagagggattctggaggctggctgctttcctggtcactcctccctctccaggtggtgaggcacaggtgctgtctgtttcagatttctcaactcacttggatcccagaattttaccaccctttgaaggttgtgaccaagatggggcggggggatgcagagcccatactcagagacctacatcagcatacaaccttattgctcccttctctaactctcctacttttccctagtccagagaatttttatcttctctttgatggaacaactgtttctgcaaatatacctccaaatattttgtgctagcagctgtaccttagcttttgaacccaaggccaagaatctgaccttttgttttctgcttccacagttgaggcagtagatgacctatatatagctacctgaatagagtaatgggattcagtgaaagaaaccatcaattaatatattcctctgcaaatgcaaacagcattccaaaaacagaagttctcgagcaaacactttccccttatcaaaggtttgcaggttgaataccttcttgtcttaagtaagctttgtgttaatatgtgaaccacaaacaggaaggcagccaaaatgctgctggaaagtaaaagataaaataatcagagtccaaattttgcttgctgtgtgatccatagtaaacctccatgctgtgctccattcagctgactcctcatcatctttctcagcatcttatgtacccagcctttcatagagacgactacaggccaactttgccctaagaacaaaatgcaaggattaggcttgttcacaaaagaaacacacaactcatgatttaaaaaaaaaagaatctgccacactcttacagctctctaaaaaggaaatgatcatgattagctcaacagctacattttcatttagagaaaatgcccatgccatagatggacacagccattcagccaaatcaatgttgattaatctcttctgcattatataaagagaaaatacctaatggtcctgagatatttataattctatttttatctgttcatgtttattatttatgcatttttacaatgctgcacaagatttttttctcatgtgataaaggagctatggtcataacttttagttattccaactagaatgacgagattaacttcagcaaaggaaaatcacttaagctccttaagtcatattttcttcatctgaaaagtggtaatagtaatgtttcctctgtgtacctcagagggttatgaacatcaatgatataatcaatatcaaaggtagacaacacatgtgaaagcaacttttaaaccctgaagtgctacgcaaacaccataatgttaatgttatcataattagtagtatacaaaacatgttttcatggatgaaacagagagagcagagaaattgtgaattctgtgccctcatctttagtggaagcaagactaaatgtcagaaagtctgttaacccaatttccctgctggccaaaaagaaccatgttggtccatcaggaagggcactagagaaaatagtgtgagcgtgagctgcccacttccaagatgttggaaccgcaactcctgaaattcaaaataccacagctttgggtaccattccttaaaacaaaaacaaacacagacatagctaaggtccatgaaggcttatataaggcaggacaggtaaaatattgaagaatatttgtaaagatcagacacctttaaactctaagcaaaacagctacaatgaaagacgcttagaggggcttagatacggtgaacatggaacttattcataacatcttggaacctccatttaaaacttgcaaaagacaaactgaggaccaaatgaaaaaggaaagagtctatacttttacaacaaagtatctgttgaatataaaatgaacttacgaaatcagtttcttctaggagtgatacagactgaaaattattatcttaattcaaaaaagtcctatttttaacatttgttttttccaattaaacattacatgtttacagaaaaattaaagagtatgaccaaaaagacaaagaatgttaacacagttttataacagaaaagcattttaacattttgatgtatctttttccaattgttttgttttatgtattgtgtgacatttaatatacataaaagtagttatgcatctatatatatgtgagttgtgaagcataatgaaataaacctctataaacctaccacctaacaggattaagtcattgtcccttatttcaagaggccagcaatagtttcacaaggggtagactctttaaagaagcacaataacttgttacaggttctatgatgacagaatgtacaaggttcagtagagagtctaaggaggatgtgatcggtttcactcggctgaaggtgaggggcaggtagaagtagaacgcccttgtaaagggtgtaacccatatttaactccattttgaagctttaggtgatcattaagataataatattttgccatgttcatctttttagcaatattggctattttgtataacaatggacagaactgtgcaagcatttgatagaaaagggcacaagcttcagagacaaacattggtgttaaaatcccagctatactgtcactagctgagtggcttttggcaaggttcttaacttcttcacaattaaaaagtgataatatctgttattgttttgtgatataaagcttatatctgaaatctgaacagtgttaaaggctggctttaccttggcccaattactacagcacagagtctcgtcacctacttggctgctcattatagtggtgcacatgacactggctagtttttcagagatggggaaacagttaaacctaaaagagactggtgtacaaaatacagtattatgtgttaattcagcatgagatgtacttctttctacttcccagaataatcgtgaacattatccaggttatccctactaccactaccacgagtaagggaaaggaagcaagaaaaaagagaaagaaaccaacatttactgagcaccatgtgccaagtgctttgcaagtatcctgttatctaatttttatgataatcttcaaatttttgttatacagctgcagggatggaaatgtggtgggattaggtactggccttagttcaccagtggatttgttgtctgtggttgggtagctgagatggttaattatgtgtcaacttggcagtgccacggtgctcagatgtttgatcaaacattgttttggatgtttccgtgaaggtgctttttggatgagattaacatttaaattggtgggctctgagtaaagcagtttaaccttcatagcgtgtgtgggcttcatccaatcagttgaaggccttaatagaacaaagactgacctctgtgactaagaagtctgtcattatactgtcgttagactggagctgcaactcatcttacctctccagcctgttggcctaccttgcagatttcagccctgtcaagcctccataaacccatgagcctcttccttagaataaatctctttctctcattaaatagatggatggacagacagatagagagataggcaggcaggcagacagatacacatcctgttggttctgattctctggaaaactctgtcaaataggtagcaaattgccccaaaactcagtggattaaaacaacacgtgtattctctcacagtatgtatgaatcaggaatccaggcatgacttaattgggtctttagctcagggactctcacaaggatgtatcacagaactggctgtggctacagtcttatctcaaggtttgactggggaaggaagcacttgtaagctcactcagtggctgttagcaggattcagctcctcacaggctgttggatgagggcctcggttcctctctggttgttggctggtggtcaccccctgttccttgccatgtggggttctccagagggcaactcacaccacagcagcttgcttcatcagaagaggccattgagaggagccagagagaataaaacgaggagtcacagtttttttgtgtgcattcctctcagaagtgacagcccaccacttttgacagattgtattatttaaagcaaatccctacatccagcccatattcaaagggaggggcttgcataagggcatgaatagcaggatgtgaggatcactgggaaccatctgagaagacagccaatcacacacaacgagtaaatacacatcactggttgacgagaagctcagtctgactctggggcccaccttctccacgatgccagctgcaacctcgaagagccgaggggaaccctccacaggaatcagcaatgagagggtggtctgtgagcatggcacaaagtgggagcatcgaatggcctaaaagaatcatccagatggtgcggaggcccattgcccctcagcaaggtcccggcactcctgcagccctcagagtcagcgcttctctcctctgcctgcagcaggctctacctgccccagagtaaagccactctggtgggcttagtcctggggccctatactcacttgactcctcctggcttctgtgtcctgaagcctgtcagcacttcccacccacaagcccaagcccccagtcttcccatccagggtgtagtgaagctgtgatgagcagcccagatcctcaagcaggcccgcagcaatcattcgctacctctaaattatggacagctgaatgttctcagctgagtccctgcatgagaatagcccttagccttggagagctggcatcacctcccagggccatgctccctccccagggatagctctcgacctgtgactgctccatgagaggagaggggaacataagatcctgaactgggggtgcctgtgaagggtacccctcccctcattgccaccttgaatctgcagagacctttgttgggactgcattgagttcaagtcctccctctgcccaatcctgggtccctcaggtctccacaggtgttgatcctgacagcactcctaaatgaagctcctgtacacaaaacctccactcacaggcctcagcctaccatccaagaaaggcctgtatctgcacagctgcagctggcactcctccagccgtctttacttactagcttcattctaatgttgtgaatgcatgaccaaggatctccacgcacttgagaagaaccaacagcaagatacataactagtgagataaaccaagagcacaggtgacctagagtattcagagctatgcagaaagtagacaagatcttttttaaaaaagagatctatttaatattcgcagaaagatttaacaggctatgacagctgtaacacaagaacacagctgctgtgaaaaagagagatataacaaaataagcgtccctgtgctggcaaaatttattggaaaatttagcagaagagttgaatggacctaactgaagaataagttaatgatctgaaaaataatgtgaaaggaattctgagaatacagagtcaaaagacaaagagatggaaaatatggaagaaaagaaaaacagataatagatgcaagaaattctatatccaactaggaatgctgaaggaaggtagtagaagcaatggagaggaagaaattatctaaatatgagtgtgaagaaactatgaacaaagacacaataagagcccactgaatgctctataggaatagtcagcaaatttttttctgtgaagaaccagatagtaagtagtttaagttttgcaggtaatatttcttgactgtattgcagcacaaaagcttcaatatgtaacaaaaacacaatacgtgactgttttcctacaaaaccttattaaacataaataagcatcaggccagactgggcttagtttgctgacccctgccttccagaaataatggggaaaaaaatcacacatctagtcacattttactaaaagttctgaactccaaaattagggaaattctgtaaagcttccaaagacaaaacaaggccaggatctcacttgtcttctataacacagttggctaaaaaccaatggagtcatattctggggaaaattgaagtgattcttaacctggattatgttctaagtcaaactatcagtctagtgtgatacacacgtatttggccagtcaatgacttgaaatgtttatcacctgtcactatcatgggaggagagggcctactcaaagatgttttctcacacaatgtaaaatgttactccaagaaagaggaagatatgagatacatgaaacagctgaaataaccccagatttagatgaagagaaatccagttatgaccattatacagcaggtgaaaaacccgatccattgaaagtgagacaccaactcagagggttctatgatgaatgactttattaaagaacacatttgctataataacacaaatgatagaattaggaacctggaagttcaattttgtggagttaccaatgagataatggcttatgtctgctctcttcaacaccagtagaaatgcatttaggaattttaggaggaaaaaaatgagacagacatgattgtttaatgaagcgagtaaaaatttgtgccgttaatgaagtgaataaaatggtgttttctgaaacagcaaatccaaactcccacaggtcaagaaacttagagttggaattaagagagtcactaactgttcttgtaaatttattttttgtttattgcatatatgaccattacagttacttctctatgtggctatttttttttctaccactgcttttgttacttttatataatattttataaatttgcctttttccatgattttattcttaagtaggctcaggttgtttttaaattagaaaatagaagtcttaaaattttatttagatatcggtattataacatcttctgattttcttaagacagatgacagattttacatctagaaacataaatttatttttcttgagatttgtatttaaagtatagaagactccttcaggaaatgaatatttcttgttttaaagaaatctttttctgaaagtcagcaatttctcatatttcttacatttcttattttattttattttacacaaggtctcactctgttccccaggctggcatgatcatggttcatttcagcctcaacttcccaggctcaaatgatcctcccacctcaggctcccaagtagttgggaccaccagtgcatgccactatgcccacctcgttttcgtttgtttgttttgcagagatggggtcttcctatgttgcttaggctggtctcaaactcctgggctcaagtgatcttctcaccttggcctcccagagtgctgggattataggcgtgaaccaccataccgaccctctttaattctttttttctgataaacttaggtaaagttacatgtaatgcttttcatttaataaaaatattaacagtgattatctttaatgtatgggtcactttgtccttatgtttatgtatatttttccaagtggtctaccatgaccatgttattttctaaaaagaacaacattattcctttcgagttacaatatcattcaaagctagagcttggcaaatatatgaattagaggcttgacgttaccatcacttgcccataacttttaactaatcactcaacctcttttaaccttggttttatgaaattaaaaaattgggttgaaatttatatttgatgattttgaaaaaacttatcctagacctgtttttttgtttgtttgtttgttttgaattgttcaaaccctttgcatcatttacaaggtcatactatatcagggaggattcttgattttaaatgtcggtggaatgtctctgggttttgtgtgtgcctacatttatgtcccaagttctatgcaggtctgcctccgactggtgatggggccttgagcatgtcatcccctgctctgtgctttgcatctttcaactttcaagtcgaggggttggaatcagtcgcctccagtgtcccttccaagaataaagggtaaaatgatgctggagacaaagcttgatcactgggaccctgtgggaaaagtagttacaattgagtgagatcagggaatctgctgcttatatccatgacgcaaagcctgaggatggtctcattctcatggatgtactgcttcatcttaaatgtaccaggattaggcaacacaaaacagcagaaataaattcttccggggatactcctaggcagattgggggtcacattaccaatcagctcaggtcaaagcttgtactatttgaatgtctctgcacattctcttcttcacttgttcatgagaacttccaacagtgtcccacctacccaatgtgttccctctttgtagtggggagaaaactcagtcaaaataaagaacgtgcagataacatgataataatcaaaggaaaaacaatgtcgtgattgtaagaacaaaccagtctacaagcgttaatgcattaattaatgcaaagagctgaaaactattaacacccaagaacagtactggtaattctcagtagcacaattgtataaatcagtttattcagagtcaggaagtgcttaggtcttaaatggtccaacccatgtcttctaaactggtacctcttaaacttcaatgggctactgattatctggggggtcttgctgagataaagattctaaattagtaggtctagagacttgtgacctgagataatgcatatttaggaagcttctaggagatgctgccaccgctgatctgttatccataagttggactataaggatgtaaagcacttagaacagtgtctgcatttaggaagaactggtgttagtgatgattattatttctactagctgcaagaattccaactctccatatgctcatgtgctacaggagtaccaagagttgtgcagcaatagccatatttttaagctgaataactagaatcattttgtaaactcgtttatgaaattttatggaataaaaatttattccgtaacttttattagatcacaaataagcagcccttggtagaaagcacatttatggaatgagcataatttgctgctgagaactgcagagaaggcctgcatattttgacaggttccactcatcaagaggactgtcacgtctctccagtgagctgaggaccatggtttcagaattactaactcagaggaccaaccagttggtgactacataaccagtgtgcccaagacagtcctgaagtcacagcataattaatagcacccctctcctagcttggacaacgcattgtgtagtcatcctaattatagtggacactatctataaattactggctttacccagcttccctagctgtccctaaactttcatttctaccacatggagaaaagggaattctcagtcaaattttcttgcttagctgacaatggttttggcactgaacgatgcctatattcaacaatcctgaagttttgtttgtaacacacacacatatacacacacccatacccacacacacggaggaaaccaagtttcatcaatacgatccaattttcaggtgcttctaatctgagctgcttatgtgaagctctcttccttttgacagaaccagctcctctttcatttccaatcatttctccaggattgcacaagaattcttcatactgctgctggtctatgagatatgcatgagaaaaactagatgaagacaaaagacgtgtccatcccactgggtgagatgcactgaaaggggtgaagccatatcgacccagcttccctctgccatagatagtcctctgggatgaaatctgcattctgtcactgacgagctgaccaccttaggcagatcgtttaatctcttttaactcgtttcttcatctgcctcataagtgtattgtgagaatgagataaattagcatatgtgcggggcctagtgtggacttggcatatagaaagcattttaacctaagtcatatctaataaattcccacatgaaaatgtaaccactgtgcaaagttgcattcccaaattttgggcagtgttagccatagccgaagagtcggttttgtttctagtaaatccacttcagccatgatagatgtagactgtcatgtttcaatttggaaatgctttccttcaggtctcttgtgtcctgaatctgtgatgggttgaaacaatcatttttgtttcaaatcttaaggaatttgaacatgagagatttaattttatataaggtttcatcattaatatacattcttttctatgtcattacataaagaacagaggaaaacaaatagaaaaggtgagatggagaggaggaaaagagattaggagtataacaagctgcacactttctaaatttaatgattgaatcataagaagttccttatatctgcatcttaaaagaatgcaaatgccattttaatttcatgggaaaaataagttaaaggataccctgctgcttttgaaaagcttactttgatcacttgccaaatggcaaaatgaatggattaaattttaaatcgcctgtcttcaaaggacatgatatggaacatatttaggatttagccctttaatttaacattaaacttactaaaaatgtcctcatcaattattgacagctcgattttaaaacagagcctccacctcaatgttgagaaggtagaacactgcttgtttttagaagtacattttctacttctttcagctacaacaccgggtagcattctgcaaaggggtaattttttaaagaggctccaagctggtgagcagtttgcctatctgcatcagcaggctcatgacccatcatttagaactcaaatggaatgtattcagtgaagcatcttgctattaaataaatgttgtaaaaaatgtgtgagtgctgactaataccaaaatctcaaatctcatttggtttatgtttcctgtgattctgtgggtatttaataacagatgttattgtgcaacaaacaaggccattcccagcaaaatatggcttagggccaactattatttttatcctcttcttaatcccttgaaatacctttttttttttttagaaacaacatcatattaatgtaaatatttaaatcctttgataatgctgctctcctgcctggagaattctgaagtcttccattgccacttatttccacatacacaaattctatccatctcttacaggccatttcttccttgaccacccccctatactaacacacacacacatacacacacacacacacacacatacacacacacacacacatacacacatacacacacatacacacatacacacacacacacacacatacacacacacacacacacacactctctgatgacacattactctgaaatatattcataatattttaaatagtaagaggaattggagattaaagctcaatagaagaagggtatttggtaggggagtagtcaagaaagacttccgagaagaaatttgtataatttttattttggcatccctgtttcattacattatggaggatcttaatacatatgtttagtgtgcatttgttgctttggttgaaggatagctttgaagaaaagaacaaattcatcaaacggtagtgtgtgggagggaggactgttctctcaacattgtctggttcatttcatcaccaagtgagccctttccaaagtgtaggcatctgcatgtcacacagttggcactcaatagtgaatatgtgagcaaaacacaaaaatgacaccattactgcccttgaagttcttgtaatccagttaatgatggcacatttgccctcactaacaacactgttatgggagcacagcagaaggatgtctaaaccttaatgggattcaggacagatttcttggatttgagatatgagctaggacttgagagacaattagaaagttatctggaggaaaaggctgttactggcggaagaaagggcaaatgagaaggcttgcaggcacagaataacctgcctttgggaacctgtaaagagaagtttggctggaatataggcaaaaaaagcaaaggagaggtatgagattagtggggtgggtgatagccattttatgaagggcctttaatgccaagcagagccttattctaaaagctgtggggagccactaaagaattttatagaggaatggtataatcagaattttctcttttgctttatttatttatttatttatttatttaagacagaggctcactatattgccaaggctggtctcaaactcctgaactcaagcaatcctcccaccttggcctcccaaagtgctaggattacaagcatgagctactgcatccagcccagaattttctcttttagaaagacctctctagcagcaggcttccaaggttgatttttgggtggccagacagagaccagggagaccaagtgcagtcatagggtaagccacaaaattgatggcagggtgaacagggggctgatgggagacgtactgaaaggtccagagaacatagtgcttgttgagtagtgggatgtggaagtgagggagaaagaagagatcaggataacatttaggttgcctgcttaagcaactgggtagagggggccatttgttgtgataggatgagtggcagatttagaggccccagcttaaaaaaaaaatggcttcagggccattacatcaaagacacctattggaaatctcagcaaaacaattgaatatggggcgtggaggtctggaaatgggtttgtctaaaagacagtagaggtgtgttgggagaagaggagaaaggaaccagataggaggggcttacctactctgtgtgtgagcttctgatgttttcaatagtcactggcatctttatcctttgctcactgtctctctgagctccagctaatggtgcaggatccccaaagggaaggattgaaggcaattacccagttgatttcctccttagaattatttaatttatcatgttgttttgtaaaggacatgattaaacctttacagacaaaaaagaaattttgtggctaatttgggctctacattttcagtagataataacatcaataaaatcaagttagtttaattagagttgatttcataggagacattttgctgacattcctataattggtctttacaatctttgaagattatatacaggtacgagtatagatataaatatatagatagatgtagacatagatataatatacttggttccggatatagggatatttggatgtacagctaataagccaaatacaggcatataaacaaaatgtttatcttccaatctgggattagtaatagctcacacacacttactgtgctcagcaaccttttaaagtgatataaatatactaatttacttaacagccaggatacccctatgaggtagatactgtcattatttctattttatagtaaggaaactgaggcatcaatgggtaagtacattgttcaaggttgcacagctgggaccagcatttaaactaggtagtctagctctagagtttgctagtaacataactttatactgcctcttcttacctgtatcttatagataaatgaatatttaaacaaatttaaagtaaaattcctgtcctcttgtgagactggataagctgtaagacaggctatgcatttcatcaattacacatgcacaattagagcctatatctaatcagggctgatgacagccacagacgtttgtacagattaatgatcagagaagaggaattgatgggccagagaaggttgaagctgtcagcttttaggaaatgccctgagccaaggcagccattgatgttgtaaactgaaatgtggcagctataaaaggactgtcagatccttcctttgcataaaaagtatttattaccatgcacagaagcccaattttctggcatgtaacagagatctgtattcataactacttactcaaaagtctttagtatgcctggtccaccctcctccccatcctggggacatgtgggagagctcctttctgctacctcttacattttcatagacccattgggagacttagaagtgtcctggtgcaggcaagagacttgcagccatccacaaatggtaccttgcttggcatagccgggctccatagcctctggtgagtgccccaccagaacaagccctgggttcacgtaatgagagggtcccactcacccaaaggatggacagtcactgcatggagtcagaacaacaagagccctaggcatgcaaactatgctgcctttcggttcctctcttgtcacctgcccctacttattggacagcttccaggacaggttccaagcaatcccctcacttgctcctcttcctcagtctccactttgggtacttacaaagtggatttaggcaaggaaaggatgtactcagccatctataatagggtgcgttgacttaaactttgcggattcaagtctcttggctcgttctggtgtttaaaccttttagggaattgacccttatcagctaagagtataatattttgaatataataagaaatatattttttgtcttcctccctgtttcctggtacacagttccaagaacccctggaaaatctcctcagtgataagtgtctttttgtatgctaatgagaacactaggggccctgggtggcctcaggatggggttagaactttcagcttttcagcctactgtctgacctctgggaaggggagagatgctgaagttagagttgatcaccaattggcaatgatgtgatcaattctgcctgtgtaaggacgccttcataaaaacccaaaggacagcattcagggagtttccaggttgctgaacatgtagaggtactgagagcgtggtctagtccagagaggagcatggaagcccagtgccccttctcgcataccttgctctatgcatctcttccatctgactgttactgagttgtattctttataataaaaggatgagcataagtaaagtgcttccctaagttctgtaagccattatagcaaatgatcgaacctgaggaggaggttgtgggaacttccaatttataactagtgggtcagaagcaaagcctggacgtgcaattggtgtccaaagtggggcagtcttggagtactgagcccttaacctttgggatctggcactatcttcaggcagatagagtcagaattgagttaaagcgtaagacatccagtgggtgtctacagagaactggagaattgcttgctgtgagaaaaactccatgtgttaatgaccagaaatgaagtaatgtgagagtatagaaaaaccaatgttttggttttctttctgtacagtacagtgatagaaacactgtacttgttttagctgttctgaaaacctggactccagattattttgtgactgcacagtacatacttcacactctcttgggcatatttcccaggggttaaatgaagctttagagcccctcatttgcattggtctttaccaagacttaatagagccctagcattgtattcatgtggttatatatttttgcaaaatttgcaaaagttatttcttatttttgttctcattcttaaaaaacaaacctccaatgtttatgtttagttgctttttttgtgttttgtttttgtttttgttttgagacagggtctcactcggtcacccaggctggagtgcagtggcatgatcttggctcactgcaacctccacctcccaggttcaagtgatcctcccacctcagcctccagagtggctgagtccacaggtgcgcaccactgtgccaggctaattttttatatctgtgcttagttttctattattttgcttaaagaaggctccccaaggtgtgaaatcttcaggttacataatacttggattcacccccgctctgcctccctcattcaaaggttattccagttaatagtcctcatacacgtttttatttgtattggaggtgtttgggttattttgtttgtttgtttgttggcttggagttttttcaagttctaagtgtttagatgatgactaagaagaatcagagaaatggaaatttccttaactaaagaaaactaaaaatatacttttgaatagcaatgttattcagccacagtgaactttaggaccgctactgggaaagaaataatagactggaacatggatcatggaacttgctccactgagagaggtgtgtgatgagtccatgaggttttagaacaaagtggcttcttctagagtttgaggctgagtattagatctttgcctctcacaagaactccagggagaaaggataaaggcttctatacctttaccagcaagctatcttttcttgaagcagttatatgacacaatgtctgtctgcttctcttgttagtgaagaaagattgcagttcctcttttcacaatgatttttatttaggtagcatcaggaccacaaatggaacaaagcataatttcatacaagtttggctggcctaagaaatcctgataggttaaagtccagctgtgggaactctcacatgcacgccagttatgcccgtcacataaggagtctgcatcctgtccaggaggtcctcctgagacgcccatcacatccagagtggttcttcaacatgggatttgcccatggcctgtcaatagtatccactgagaagtgataaacctaaaggagtggttttactctttggcagtttctagtaggtattatctgaaagatgagagccttgtgattttgagagatgccaaatttcttattaaagcaatttatgcccaaagggatcataattgtgaaaattgaaaaatatataaagcgtatagcatcatttggaaagctgacaaaagtaccagtggacttccctagtagctgtttcttcaaagtcagcactgttcttttggattgacaaggaaagctggttttcttattcctgtttggagacttctcactcctctgcatgtatcagtgatatttatgcagtataaataacttgaactcactagttttggttttgctaactggctagttgtgtgacttagtgtatgtgattagcttctctggctttcagttgctttctaggtaatatggtttggctcctcgtccccacccaaatctcatctagaattgtaatccctacatgtcgagggagggacctataatccccacccgtctagtgagggaagtgattggatcatggggacagttttccccatgctgttctcatgatagtgagtgagttctcacgagatctgatggtttcataagcggctcttcccccttcactctctttccctctcctgctgccatgtaagacgtgcctgcttccccttccaccacgattgttaagttttctgcaacctccccagccatgtggaactgtgagtcaattaaacttcttttctttataaattacccagtctcaggtatttctttatagcagtgtgagaatggactaatacactgggtttctcaaggacaacaaaaattccaattcttgctcaaaggacttattgaggattcagtgagataatattttagaagttatgatttgtctgccacctgtctgatttagagttaaattgagggtaatattttaatatcctaatattttataaaatacttttttatattgaccaaatagaacatattgagcactccctgagtactgaggtcactgctgaaagctattgattgaaaaaaataataatacttgcttacattctgattggaaactctaacagaccaatcgctgcttgtttcatgttctgtaattactgaagacagtgctctccgcataacaatatctttttaatgaggatgctggacagatccttctgcctggtttttagatcaggcccatctttattccatagaccctgtgaactgtataactgatgagggttactctatcctgttaatgttaagaaagattacaggcaaaatgttggcccactcattgtgatattcaaggatctatgagaagcttttcagtttttggaacagacctccttcttggcttcaatgtatgtttctacacttgtttccccctttttctcttctcgttttccattttactttattttattttgccataatatatctttataagccatgtttgagtctttttaaaaatctggggcacaaataagaaacaaataattatagtagaggtgaataagatttaaggaaaaccacagtaagcctctctaagacagcaataaatacctgtgtccgtacatctcagactacttaagaaaagcaaatacatctaaaggtagaagtagaagccttaacatccacaaatgttcatatttgacactatataatcattttatttcaaatatggcctgagttcggcctggatctgtgtttgttatttggtaagcagcacatgcacatcttcagacattctacctggaacatattttattttattttattttattttatttatttttcttttttgagacagaatctcgctctgtcacccaggctggagtgcagtggcacagtcttggctcactgcaacctctacctcctgagttcaagtgattctcctgcctgagcctcccaagtagtagggattgcaggcatgtgccaccacgcccagctaatttttatatttttagtagagacagggtttcaccatgtcagctagtctggtcttgaactcctgaccccaggcgatcctcctgcctcggcctcccaaagtgctgggattacaggcgtgagctaccgtgcccagcctccaacccctattctaacctctcccactttcttctctagagtccattattgattttctcagagtaccatttgtgctctacaataatcactccatatcctctccttaccaagtctttaattgctctgagcaatgcttattccctcgcaattacacattgctaggcagattattctccagttccctacctctgaagcccagaatattaggcttagaattctctggcttcctcctatgcttctagactgttgttccatccctttttatagatgatctctgtgaagcccctgccctccagttgaactcttttcttcctgtctatgctgccataccctgcggctctccaggtcactcctcctgtttctcacgcagcttatctggctcatggttgtccctcaactctgtttcctgttgtcctcctgagtcggtggtcaccgtgcaatcctcttacctcgctattctttagcctctattcccatcatcctcaccctgtcatccatcacaattccattcatgtgcctcatgttgaccctaagggcatctgacactgaaaaccttctgaaaccttaaacttacaaaattatcttttgggtttacaatttttttgtcttctacttttcccactatgtcattcctacaaaacttatttttctaactcatccagaaccttgaagtctcacatcttcccattctttcagttgaatgtgatactcctggtttctcttctttcctcacaacctctcatagtcgggcatctcattgcctacttgccaagcctttcaagttattccttcatgtttcttctcctatccctcaacacacacacacatacacacacacacacctgtcttgtactcatcaccttggaatgacccaaatatccacttcctcctctcctggggggaaatggtgtaattatattaggtgctctgtattcttcccagagtcatctggttctgtaggtctgcaaggctgcctatatttgtttcctggggctgttgtaaccaagtgccacaaactgagtggcttaaaacaataaaaatttattaccatacaattctgaaggctaaagtccaaagccaaggtgtcagcagtgcggtgatacctctggatcccataggagaatccttttttgcttcttcctagcttctggtggtttgctagcaatatttagcattccttggcttgcagaggtgccacttcactgtcttcacaggacactctccctatgtttctctgtcttcacatggctttcttataaggacactagtcaacttagattagggtcccataccacttcagtatgacatctttttaactaattacatctttgatgaccctatttccaaacaaggtcatgttctgaggtcctggggttcagacttcaacatatccttactatctcttctctctccctctttgttagtttcatttcttcagccaataagtgtttccccacactaccaaaaatctgcttgtgaccgtgactgcccacatagttagcccagctccctggttttcattgccaaactctttttccagctttttctctgcccttcactcctccatctgtaattaatctattacacatctgttcaaacagctctctcagtaaggtcatcagcatcagcccatttgtcaaatccagtggtgtcatctccatcttcaccctatttgaccttcctgcagcattcaataccagtattatcacacttccttgaagggcagctcttttctgaccattatgttgtacccttaagggtctcactagacctcctgtctttccccaagccaactggatccttacttctgagatcctgttgtacagcagtgttcagtgtgtggtttatagactcatgagggatcccaataccagttcctatgttgtcaaaactattttcatagtaatacaaaggtatcatttaccttttaaattgtgttgacatttatacccatggtgcaaaagcaatggtagttaaaactgctggtactttagcatgaatcagtgcagtgccaccaaattgtgctagcagtacagtcatgtgtcgcttaacctcaggaagatgttctgagaaatgtgtccttaggtgatttcgttgtgtgaacatgatagagtgtatttacacaaatctagatggtatagcgtactacacatccaagctctatggtacagcctattgttcctaggctacaaacctgtacagcatattactatactgaattcggtaggcaatttttacacataagtatttgtatatctcaatatatctaatcatagaaaaggtatggtaaaaatatggtattataatcttgtgggaccacagtcagatatgcagtccattgttgaccaaaacttcattatgcagtgcatgactgtatttctattcatcacagccacacactcacagttaaaaaaagaaaaaagaaaaaaagcagaaaaagaaaatgccaattttacttagaaatgtccttgataaggcagtaagttttattcatttttttaaccctttaaccttaagcacatacctttgtaatattctgagtaaaaaaatggaaagtacacatgagaagcacttctgtgacatccagaaatacaatgtttgactggaggaaacattctaagctgtcctaagctgcccttggtacttttctcatggaacaccatttttacttgaagaaacaactgacaggcaaagtatagttatggacactttggtatttggcagacagtttctcaaaaatgaatgaaatgaatctgctactataagaaaaataactgaaagtgtgtgttgcccaataataaagaatgagctttcaagcaaaaattaaaattttggaaaacttgtatccaccaatgtgaattccacagcttttgaataagatagatggtagatagattaaaagtaatggcaaaaatcacaattacttttgcaccaaactatagtattaatgaatgtgatttttaacactgtattgaaattggtcaagttggaaaagttatataactcagggaaccaatattgtctaaatgattaatgtacactattatgaaatcattgcatgggttaaaatttattcaaagtgaaaaatagataaatggatcttaataaaatcatataaaatgttatgtgattatgcagtacactttaagaaactactacttattgagttttgatgagatatcaatgaagaatactcacaattatttgaagggctgttaaaatactccacccttttccaaccgcatatttggatgaggccagtttttcttcatacccttcagtcaaaacaacttggtgcaacagattgaatgcagaagcagatatgagatccaggtgtcttctattaatgtggaaattaaataggtttgcaaaaatgtaaaacaatgtcaatcttctcattaaactttttcttcttttggaaaacagttatttttcattaaaaagtttatgttaacaaacaaagggcttattattattacttttaaatagatttatatataaatattttcaagtttctcagttgtaatttctagttcaataaacattgttaaataaaacccacatttacaaaaattctttaggatcctcaataattattaagagtgtaaagaggtcctgaaaccaaagagcttgagatcgctgctgtggaactttattcaaacaggatgctacaaagagaactaacgatcgaggagaaattaataatttattggatttgttgggcaacacaactggagaaaaatgggagccagaggacaacaaaatattattgtgtccctggtgagaacctgcacatcaagaccacagaagattttctgtaatggcaggtggagaattcctacagctagtgcttttggtgacactgttttgcctcagtgtacatctggtggcttcattgtgctggatctgcctctaactaatttggtctggtatcttgttgcctcagcaaatgatatgtgtgtaatgtcaccaatggaaacaaaaatagagaaggctagcaagtccctattcttggacaactgtcacccctacaaataaaggtcccaaaaggcctgaaaagagaggacatgctgagtaaatgtcagctgtttattattatcatcattgtggactttaagccccatatgatccagtgaaaaacctggtgcctgagctctggactacaccccaggtttggtgcaagagctccttttgtttttcagcctaagcccaaaacaaggaatatcaaagagtttcacgtcaacggccaattctaacttggtgggagttggtgcctggagccttctattgaggatcagtgggaacaagatgttctcgatgtctgccaatgcctcaccaaggaggtagcacattgtcagcaccctctaagcctaaaacctggagtccttgattctttgctcctaatgcagtctcttgaggccaaactgctctgataaactgagatgtgaagcataaaaatgaaatatgaaatgaaaaggaaggaattagactcaaaggaaaaagcacctcgctttcaaaagctagacttaatggcccaagctcaggcattggagaggtgatgagaaggtgaaactcccaccctggaaatgggaaaacataccagccacaaagaagacccaaggattctgtccttaaaaaaatattatactctatatagaaacaagagtttttaatctcttaattctcctattcctgaaaacttcccaaactaatcaaactaccagctgtgacttgaccagttcagagtactctcattgtgaggaaacagaatgcattttagtcatcagtattcctgctcaggaaaacacagtattgttgggacacaattccgtaatgagactacttggagtggtagctgaagccctgagtctgggagttggctgatcccaaggcttaagagatgaagggagacaaaaagcctgctctgcataagacaaggaaaaattcttgttttgttcgtgatgggaaaaggagtataagaaaaaaactgaaaatgcgagaaagaacccctcaaatctccacaaatgtcacaaaaaaagcaaaagcttttattgtattctttggggtccttggactggtataaaagagaagagtgtgggcagacaaaggagtcaaagataggagggggaactgcagcctggggattctcagaaatgggcagcagggtatggaatcatcaccaacatgggcttgaaggtctgatacaagttgatctggatgcccaagaggcaggaagaccttccctgacattcgagttactcctcctgtggagcctcagaagtcagtgtttttacaaccccacctcactatgttgattctcttagatgtgatctaattaaatataaatgctcttattaaaataagcatctcctcctatcaacctgacagtataattctttatcaagttgacagtatctctctagtcagggtcacaaggactttggcctggtcctggctctgctactgactgtccatgtgcccatgggtaagtccttatcttttcagatctcagggttctgactcgtaaaatgatggaggtgaggaggaaaaggttgagttcatcatctcttaagtccattcctagttaaaattctatgaatcttgcagtattaatatttcatgcatctccatccttacttgtactcactgttatgagaaattaccttttactgttgaaataaaagaatcaggttggttgtatatataatttccttagtggaagtttctctattaagaacacactagcttataacatatactagttttcttataataaggatatttttatggctaagaggaaccagacagatcagacagatggtattaacataatgcctatatattttttcttttttaattctctagttttctgttatgcctttctgcagtgttctgggtgtcctcttacttgtgtgtatctgcttcacatgttagattgttagatggttgagggtcagaacaatgtgatactcatctctgtatcctcttaaagtcttgagagagaccatgcctcatacaaagtaagcatttaatagatacttactcagttgaattgaaattgtgtattgagtctaaagtttttaattactgctttgtattgtgatagcttggttatgctgtaggaataaaataattctcaaatctcagtgatttaatgcaatagagattttttttttccttgctatggcagagttggctatagaatggggttggagtcgggagaaaactatttctgcttcatacagccactcagggacccagagtgaagagaatcctgtttctgacagctgtaccttttgaaacacatggcctcttcagagaaataaactgaaaaattactcgagggctttcttctgcactctacacgtatttcattgaccaggactaatcaaatggtactgcctgactaggaaactggatggagtggatcccatatttttaggcaagaaaagtgcccacccctccctaggcctggcatggtggctcatgcctgtaatctcagcactttgggaggctgagacaggtggatcacttgaggtccggagttcgagaccagcctggccagcatggtgaaaccccatctctactaaaaaatacaaaaattagctgggtgtggtggcacatgcctgtaatcccagctactcaggaggctgaggcaggagaatcacttgaatccaggaggcgggggttgcagtgagccaagatcatgccactgcactccagcctgggcaacagagcaagactctgtctaaaaaaaaaaaaaaaaaaaagaaagaaagaaagaaaaagaaaagtgcccccaagattggtaatcacaatatttaccatatgctttactcagtagctccagtattttggagataatgaacttctttgagaatctaatgatcattatgatccctctcctctacagaaatactcaacattttgcgtaatttcccatttgtttcatatactttgaatgctattcactggtcctctagagaaccttggaccaagattataaatcattcaggcatgttttgcacctggcaacagatctacagatgaaaaaaatacattactggtgttctatttaaaccatatgttattaacagcctatttatttagttgtttgtttttatcagatatgacatcatacgagatccatgccatggccaatggattttcctctgtgtttgtttttatcaggaaaaatttgagggactgtttcggacttatgatgactgtgtgacgttccagctatttaagagtttcagacgtgtccgtataaacttcagcaatcctaaatctgcagcccgagctaggatagagcttcatgaaacccaattcagagggaaaaaattaaagctctactttgcacaggtaaggtaattgtttaccaaagttattctttttgccctacattattttttaccattttaaaatgtaaatgaagccctttctattttcagattggttggtagtctataaattaattcactgagaaatagacccacatcatgatttccagacagaaacagcttagtggcttagaaaacaggctctgagagctgcctaccagagcaagttacataacctcactggggctccttattctcatctgtaaagtggggatgatcaagatctacaccccatactgttatgaggattgcatgaattattgtgtgtttaagtgcctaatatttggcaaatacacaataaatgcccgctagtagttataataagaatgacgtaatcacagctattcctaaccttcctatcagggttataattaaaacttaaatcatatgacagctttagtggaatgtataacttttcaatgattcatatttatgagaaaaggtgacaaatatatggaaattaatttgtttcatccaaaaatcaattctagctcttccaaaatgaaatgagtaattcttggcaatgcttatgaagttcacagcaatagaaatcaatatccatcatgttccattagtgccctcacctcatcactagataccttgatccatctcttaagtgatctgtaagtatggtttccaccttcagattctacagagatggcacagtgaaaagaacacagacattggccctgcatccatgttcaaattccatcattgctattctaatgtgtgtgatgtggacaaacctcagtttcctcgtctttaaaatctcactcagttccttaaaaagttaagcattgaattaccatctggcccagcaattcgactcctaggtatttaaaacaggtactcaaaaaaatacatgtacacacacgttcacaacagcactattcacaatagacaaaaggtggaaaccattcaaatgtccatcaatggatgaatggattagcaaattatagtatgtccatatgatggaatattattcatccataaaaaggactaaaatactgataaatgctacaatgtagatgaaccttgaaaacattatactaagggaaagaagccagacacaaaaggtcacatattctgtgattctacttataggacatatcaagaacaggtaaatctgtagagacagaaaacagcatggtggttgccagtgaccagtgggagacaggaatggtggtaactggtaatggtagtactggtagcaataggcagaggagttcctttaaggtgatgaaaagagcttggatctggatagaagtggttgttgcaggttaggaatgtactaactgccactgaactgttcactttcaagtggttaattttatgttatgtgaatttcaccaaggaaggaaggaaggaggaaaagagagaaggagagaaggaaacatttggcaggtgcgtggtgggacagtggactggcagccaacagcatagcctggggatctattagaaatgcaaaccctcaggccccatcccaggcctcctgaatcagaaatgtaggggatagggctcagcaatctgtgttttagtaaggactgcaggtgattctgatgtacagtaaaggttgagatccactattttcaggattaaataaggcaattgagcacatggtatgtggtaagtggtaattattattacggtcgggttcatcggttcatttgtcgcaggctgaaactaaacccatgttttaatgtgccaacatgacacatctgaagccatgatgaataagtttcttcatctctactctatttgaaaggttcagactccagagacagatggagacaaactgcacttggctccaccccagcctgccaaacagtttctcatctcgcccccttcctccccacctgttggctggcagcccatcaacgatgccacgccagtcctcaactatgacctcctctatgctgtggccaaactaggaccaggtaagctttgcggtccattttaaaaataaacgtttgtcagcaacctagaaaagccaaatgagattaacaaccttgagatcctgggttcacagtaacatctgcatttctaatagatttattcctctgtgtggacaatgagagggaatgatggatgagaatgcagcatcagactttgcacccgttcaaaaagcaactcaggaacctgtactaaaatggtgtcaagtccatgaagcttctggattgcaatgcagatattttaagatccaacagcactacctaattcttgtgggatttaactctatcccaggaggaaattgtttcctcagaacagacaaaatgaaccctaccagctggaaggaggcatctatgctgtgcaacccagttttattgctgtcacagtgctagtacacactcaggaaccccctgttacaagaaaacctgcctgccaaagtgaacctccaagttcctaagaagtcagtcacagcagcctctaactttaaaaaaatcttagtcactttgttctgatgttggcatatgtagctctgattcactcattctcacgcagtatagcattctaaaatatgaatctaccaccacactttatttagccactctcctgttgatggacatttagattatttccaggttttttgctattacaatcaaagtaacagttaacattcttgtacatctctatgcacttgtccaaaagtttctttaggctttgtagttagaagggatactgccctcaatttcagcagatgatgacaccttgcgccccaaagtatttttttctgtgttatattaggagaggaaataatagaaattgaaggggctgaaaccaggtggcagctgagatttttagcactgtgaattgagtggtaactaatggccattatgtctgctctgtctactgctggttatcttgggataggaaggagctttaaaaatagaatctgaatgcctgaccccaccccaagagattctaatttgatgtgggtaaagttcaggtatcagtacattttaaaagctcccccactgattctaatatgcagataagttcaagaaccactggtagctaaatgccaagtaccaagaatagtcaacttataagttcttaccagcatttcttaatgtagcaggaaaacatttggcccagagtcgcccaccccagaaatctgcagttttgataatcacatctgttgatccttgtatacgccaaaacctgagaaccctaggaattatggtgaccaactgtcctggtttctccaggactaaggagtcccttggccataggaccttcactgctaaaatcagaaaattcccaggcaaaccaagaaaagctggtcgtcttaccaggtacctagattaagatgatgctgatctgattaataagcacttcttgcaagaagattgccagctgttgcatgtatgtcctgaaagttaaattatagaactttcaagagcaagctcactggaggtttccttgtaatcaccatcacatcactcagcttctcaggccctttaaaatggccataagttttaccttcaagaagcagtaggtatgtctaactaacatgtgctgatgaaagaagcaatataataataagagagatgttagtgaaatatgatttcattaaacgtctggttcacatccaggatcctgatcttagaccctcccccttcagagagccacatgtgtgatatgcttaaacactgcacagtgtataaagtaaattaagtctactcacatgaagccttgtgaagccctttcccacagtcattcaggacattgcagaaacaagcacacatatccaaatggaccaatttcagccaaggtccttgaagctgccagtttgactcctatgcacagatattgacaaggacacacttgaacactttgtagaggtgttttgaatgtcagcaaacagagctctttatagaatcactaaggtcttggctagaggacctaggagtctgacctggattttacagaaaaggaaactaaggcccagagcgaagcagggagctgatttgacaatgaaagtgccagagcttccaatgctgtgctcttcctacttcactatttagaaaggaggctcaggctatgtcagactttctaaccatcacaccccagctggactccagctcactcatgtggagctgatcatccagtaaaattcaaatcatttttatcaagaatgtgaaagaacattagttgttgtcagcattcacaaagattgatgcagaaaaagctaggggcaagttccagacacccttactggctgacccagctgagtccaggctctggaaggcacagacagggacaaatgtgacttgggactgatggaggcagaaggcacagatgggatggaaattaggccccggaagggacgctcacagagcctgacacagaagaggaaggaaagaaagagggaggaaggaaatggtcttaaagaggcagagaaaaaaaagcagttggcgatgggggatggggagctcggagtggtaaataacttatcaataatgttaaaaatacacgccttttaccttaatgttacagctaatctatagcacccaccttcttttatcacaataaatgtaccatctaccatttttgaagggccctgctttgtaataaacacagagataggacctattattatccccattttatggatttggaaacgaggctgtagaaagaagcatgaactttcccaaggtgacacagctggttggtgacatcgtcagatttcaaaccctggcgcttctgactccagagagtaaacttcacactccgccagctggccttctattaaggatactggttggcttggctgacttcaggcctgctctgcttcaactctggcaaacatttatttgtttttaaccctgaatcaagaattatttcttggtttttttttttttttttttttttgagacagaatcttaccctgtcacccaggctggagtgcagtggcacaatatcggctgactgcaacctcctcctcccgggttcaagcaattctcctgcctcagcttcctgagcagctgggactacaggcgcatgccaccacacctggctaatttttatattttttagtacagacggggtttcaccatgttgaccaggctggtctcaaactcctgacctcgtgatccacccgcctcagtctcccaaagtgctgggattccagacatgagccaccgcgctaggcctcaagaattatttctaacaaacaccaatctaaacttccagaaagcctaacctagtgtctggtaaatgtgcaaatggagacttgtgcatttggtacaagagcaaatattgagagtttcctgatttttaagtatgactgatattgtgtccatggaacagctgcaatctggatgtattttctaggatatgtttctctccattccttgccagcaatttgggactgtttgtctttatttggttatccatttatcccttttctatgtccttgaagcttcctcagccacacacatgcatgatttgcgtccaacaattgagttgaaaatatcagacgttaaattaaaggttgtttcagctgcaacaatcagggagcagggccacacccttcctcctccccatggcatcctcccccacatcgcgtctctgcccccttcccaaccaggtgccaaggcaagaggttgctccttcagtctcctcctgtcactttgcacaaatattcacttttccttatggtaattttctatcattcaacttactatcttcacttcttactgagggaaagaatgcatgtttcattcattttggtattcccagtacctgaaactacctggcacatagtggatgctcaataaacattggaggaatgaatgtgtgaatgaacgaaggaatagaccagagctattagcctgcctagagatagtttctttactgacaaattgttgctttcttatagctttagccagactcagtcgggaagcattaaattaatgttttctataattagaggacttctagcattttcatttttaaaaaagtgatttagtaaaatttagttttaatcctttggcagaatcatttcagtaacaaattataactaattgcatgttaaagaatgactacctcagttccagaagtacagaaacaaattagaatgggagcagaggaaagcaactcaaatgatcaaaggaatggagttttgcattagaggaatgatgaacagtgtttaattggtagagcagagtgattgagaaggtatgtagacatttaaagctgctgggaaaaagtcagtctaaagaaagaacgttatggagcagggatccagagtgagatgggactcgggctaagtcaactgactggctgcccccagaggcaatgacacagtttattaggaccctttcatggagaacaaatgaaacagtggggatccaggcctcatctcagacaagcaaggggcaaaacagtctgtagttctttaaggaggaatattggtgacctctcagagagggacaagtccaattcctgaaaacttctagagtggtcctagaaacaaacataaagaaagcagtgcagttataatggaaccatgatcagacccaaacctgtgggtgcctattgaaatcctttgaaatatttaagatgttgcgacaggagacgagggccacgttatattcaagaagtgtctctcagttccctttattataccaagagcaagtttatattccgaaaattatgagaggcataattttaaacatccttaatcattgtccccatgaccattctatctttgatccagagagtaagtaaaataggtattatacattagaaaataaataaataaaaatgacttaaaattatgtggggatgaagataaattacttactatgtgccaggcactgttctaaataccttacaatattatttaatgttcacagacaataacaggtattattattgtcctcaattatacagctggggaatgtgaggcacagagtggttaagtaacttgcccaaggcgacacagctactaaattaaaatatgtcctctgccactggcaagaagagtaaaagattggttgagccagcacccttgccctgggaagtgaaacatttttctctagaagaaatttaagattgctgtaaaggagaaatttaagaatacaaaacaacttatgcctttcgttccctcacattttatttctctactttttggcacccactaaaacacactactgcatcaattctttacggtacatttcatgcttttttcttgtgtccagcaggacgtgcagatcaaaatttgccttcctctgtttaaggggcagttattgtctctataaaacacaatccttgtgtgtttctattagtcccttggggaatgtgtagaagcccatcagtttaacagtgacctagacagaataagatgggctctgaccttgaggagaattatgagttgaatatttattttgaaatatctgttgttcctgactccagaagcagtacagtgccaggttcttttctgatgtaaaacaaaataggagaaaataaaaacccagcctggcaaaatagcttatctccaccaatcagcagaaaatggtaaaatagagacgcacgtggcactaactagacaggaaatcagaggtgggaagcaaaatgccagcctttattctgctctctaagatggctctggaaggtcatgttcattgtcactgaaaatgcctgcagggagcgatatgaaaagtcattgtctcttcttttttttcctcctgctatttttagctcttgttaggaagatcaattttagttaactgcagagaagggtttttaaaatggtgcttgagtttcaagttgcatgtgtctgctatatttagatttttttccaaattcttctgtatcaaaacatgacatagtaaggcaattttgctggtgttactgcttggtatggtgttttccccaatgggaaaagatattccattaactaatgtaacctatactaaagaaacattttctattccaggctctgattcagaggtagaaaaaaattcagtttttaaaatatagatgaacacctatgtttttggtgcatgtggtatgaatattatataaggcctcgattctcattcagcaattgctgtattctctgatcacaaaaacaataggcaagtaaaacagtgagtgtccagtgttcccattagcacagtctctctgtgtcataccccacataagggactcagattgggatcctggagcacatgttcaaattttcccattgcctttgaaagaattgtccctggaaaaaaaaggttttttcagaggcttttcttcccagcatatattccattaatctatcttccatcactatggagtagcaatattaaaatacttccttttctaaatttacaggtaaactgtgtacattgtagaaaaacagaagacatatgaccaaaaaatgggaaaatatgaataacaaatcctactgcctataaaaaaaagtactttaaggaagaatcattgtagtgtttacccttgcattttttcttataggtatgtgtgtgtgtgcatttgtgtgtcctcacagttgttgtggaggctgggcccctaatatggggcaagggagaacaggatgtttcattcccagggaggacccagctcacagagggctctcccaggcagctccccctttcttcatctccgccactttcctctcaccccatgtggaggagcccctttactctggtcgctctccctctttatcttcccacctctttcccctctgtggttcccttagttttctttgcctataccttccctccgggattctgcttctttttctcaaccattaattcaggtcctcagtcaatcagttgatcccataaagtactttgggtcctaaatgtctcaggaagggttgaagataaatctccccattcccaatctagtattagagagaaacctccagaagataagcaaatgttcttatactgaaatatatatagctccccttataccaaaactacagagtatgctctttgtcttctttctttcccttgctctcttgctcactctcatcctcccccttccccatcttaccaaggaccccttcttatttcctactttgatatggatcagaactgaggagggggaggaaaggaaagagaaccccaattatttcatcaatattttcttaaaatgcacacatacaaggcctactgaggcagaatgtcagtttacagccctgatgccacctgcagcatcccaacctcgtgcatgcctaaatctaggaagtagtaaggcggttacgctggtcgctcagcagacctggattggagttcaccacttttctctgggatccaccaaagttcaataggagctcatggaaacacaaaagaatcagagagaaaaaaggttacaaaggactgaattccctggactctgtcttttaatcccaaatcctctttccacttccacttagaagataagttctttctctgctcccagattgagcttgtgaataggcagctaccaaatagctatgatttttatgtttccaataagtctctctgcacccagaatatctccttttattttatagctgtaaatggagatccaacatgaagagaggcttttctcttgcctcaggatgatgattgaaacataggatgtgagtttgaatctaggcttctagcctccacattttattagctctgtgaccttgaggaagtttcttaacttctctgtgcctctgcttcttcaatagtaaaatcagtttgtggcaagcatcaaatgagataatccatataaaactgtatatccagtatcatacataggaaaggctcagtgtatgttaactatttattatcacttgattttcaaaccatatattagccttctattaaaatgtgtcactgagtgtggtggctcacccctataaatcccagtctttgggaggctaaggcaggaggatcagttgagcctaggagtttgagaccagcctaggcaatgtaatgaggcccctgtctctacaaaaaataaaaaataagattatctgggtgtggtggtgcacatctgtggtgccagccactcaggagacagaggtggatcacttgagccaagaggtcaaagctgcagtgagctgtgatcctgcccctggactccagcctaggtgacagagcaaagtgagttcctgtctcaataaaaaaataatttaaatgcctgtgttaagctcttagctcagtgctgctcaatgtgaaagctatgatattttggagttgacagtcctacacattgcagtacatttagcatccttgggtctcacctactaaatgccaacatccacccacaccatatgacaaaaaaaaatccatttccagacaccattaggggtttaacattcttatgtgagaaccacactaattatactttcttgaatgtgacaaagagttgtcacaggcatagaggcagagaacgcctagtaaggggtcggcgatgtgtgcagaaagaagagtggaagaggtgagatgtatagaggagcagcccctgcctcccagctttcctcactcctctatgccttcccagacacacacacactttttttccttccctttagaaaactaggggaagacaagaacaatgagaatttgcatggcccatgtccatttatcaattgccacataacaaactatcccaaaaatctagggcttaagacaacagtcatttattttgttcacaaatctgccatttgggccaggctcagggggaagggtcatctgttccatgcaatgtttctggggcagcacaactgggggctggcaagtcaactatgaagatggttcactcacatggttggcaaaatggtgctattagctgagagttcacttagactgtgggtcctggttcttcttaacgtgggcctctttatgggctgcttgggcttccttacaacttggacatagggttccaagcatgagcattctgcaagagcaaagtagaagcgcatagcatatttgttacctaattcagaagtcacactgcttacttccaccacataggttgaggatcccttatccaaaatgcttggggccagaagtgttttggattttggatattttgggattagcgatacacaacaacctgtactatatttgtcaagacaatcattaaagcctgcccaggattgaagggagagaacacagagggaacactccttaatggaacattgtcaaggttacaggagagtatgtggggtgggaaacattatgaccatctttggaaaacacaacctgctaccacaaataactttcctgttgagaattcacccgtaatatgagagatagtacagttttaaaatgagaatgtagaggatcttcttccagagtccaaaacttccttccctaagagatgcagattaactcagtttataatttatagtctcttcttttcataatttattgtgttgtcttttgaggagattcattgtcaaagagaccatgcctagaataactatcaatggccaaaacaaaacaaggcaaggttcagaaggaatacatgatccatctttagctagagaacaaatattcactaaaaatatgagttgccatgaaaatgtattaaaagtgaaagacaaaactaggctccctttcagtagagtcgcttgtagaatatgtaaacagtgggaagtatgagagttagggacagagaggggctatgaacacattctttgaagtcaggcaagcctgagtttaaatcctggctctgccatttactacctgtgtgatctcaacttactgttgtataactagatattatgaaacccacatgacagagctgttgttataattaaagatctatttcatgccaagtagttacagactttcctgtgcctggcatttagtaagtgctccataagcaattgttattatgtttagggaatgtagtgagtttctatgacacctactgtgtgctagcactgatagaatgctgataagaggatagatgcttgcctttaaatggttttccacttagttgaaaagctaaaacttacacaagttaaactataggaagaatattcacgtgtgagtacataccagacatcactcaagtatgttagtaatgaccaagcgtgatgctcttcataaatcaatcacatattcattgaacactaatgtgtaccttaagctgcagcagtcacaaaaggttaagtcttgacttcagtggtttggaatataacacattgctagaggaaataactaatgaataatatcaaaggtgatataattaagcattataaatgggtgtttctatctcaaaaaaaaaaaaagaaaatcagagatctcattaaaacggcaacataagattttctgtctcatggaaatagaggtatagaaaaggttaggaaagaggaaaaaaaggagagaaaattgccagtgatgacagagaaaggggaagtggtggttggaggaaaaaggataggttcattttgaagaccagattatatgatacccactaccgtgggatgcagcctgttatcgttcaccccttactgctctttgcaatggtgtctccactgaggaaaagctctttgcaattgttcagctgcttaattctttgactattgtgtgatgtaatcagattagttaatcatactggaaaccagaaattacttgggggcaacagtggccaaaataatatcgccctaaataatcatagcatgcatcttgggagagggctttatcaagtatttgacacatatgtctgtttcctagtatcccagtgatatgagtgttgttctcattgatgaggaaaactgagattcagaaatgttatataactttctcagagtcacattactcatatgtgataaggtgatctctccaactgttgtcttaggtggcttattctggcacggaagttagttcctgtcgtggggaaaccagcaaagagtattttgggtgggagggttagtcatggatagggttataacaaggggtgtgtagggaaggagcatgcagagaaggtttgacaagcaatgttcaatagtgcttggtgactgattacaaatgatgaaagagagagaaaattcaaggatgactgactctaaggatttgcacctagaaggctggaagaatgatggcaattctaagaagcgtgatagctggtaacggaacctagattggcagagaaaataattctactttagacatgtgagtttggaaaagagtagtcaacttgtagagagacgtcagtaagtcaggatgcatgtgtgagatcaggcctggatatgtagctcctcatagggcaggaactggggctcatgatgagcaagagaaagaatgtcctggaaagaagggcagcaggtgctgagcagagcaaagcttggccttgcctgttagatgtggctgtattttcaaagcctctagttctgggattctatctattgcttggcagtacacatacaaagactttgtccagcaggcactaaacttataggaagatttccccttccttccatcatagagtttttcttattaggaatctaaataatgaatctcaaaagcttctctaatacatagacatgtagctctgtttcatctctctacctttaccttgtctgaattttgctgatttttataaactttgcataatcatactgattattttagaaagaatttaagaggtggccaagtcatggcccgtaagccaaggtggcatgagagagaaactcagtggcacttggactgccagccaccaacacatttctctgcaattgtggcaagtgaggttgtaccatgtcaccaagtttcccagcccctagtcagcacagggactcaccctcctccctcctgagaatgggaaacagcccatgggcaccctcactccctcctccagtcatagaggaattgggacattgtcacaaacctgtctccagccacttgggaaaagacgagacagaactttggcatctaatttaagcaatggccaaacctcagtcagtttcaaaggcctgaatgagaatttaacgttaaccatgtgctaaaaggtttttcatttaattggctgaaagtttgtttcatggaataggtagaaaaccctgaccaatgcacttgttggtgacttttggtcctggcctcctttctgcacacaaaggagaggacagtttcaatactggcagaggagtgagcatgtgatgggtcaaccctctgcttgtcttttcagagaaatgctggttccattggtctgttctcactgcaccatggtgggacctcccaccctgtgtgggtaagatttgacagactctctgtccccagacaagcccagttggtccatgtgcctggtgacagcattgacgtcagcccttgtggtagaggaaatagttgaagcccaaagggaaaaagaggccaaaaaaagaaaaattcaatccaacaagaccaaagctatttctttttattttgtggttctcagcagctgttaagctttgctggctttcgatagtaagaaagtgtccaagaatagaacagtgcaatgtcagagttaatgggatcacagcaataaaatgtctctactactgagcaatctgatggtattaagttgatgtggaagttgctttgcaccctgcacacagagtggactccctgcttgccctcccattctgagtgttcccccaacacacctattctgagaggaaagcaaccacttctaaagtggtaaatgcattgcaaaagaagtgtcttcaggccgggcacggtggctcacgcctgtaatctcagcactttgggaggctgaggcaggtggattacctgaggtcaggagttcaagaccagtctggccaatatggtgaaaccccgtctctactaaaaatacaaaaaattagccgggtgtgatcgtaggtgcctgtaatcccagctactcgagaggctgaggcaggagaatcgtttgaacccaggaggcagaggttgcggtgagccaagatcgtgccattgcactctccagcctgggcaacaagagcaaaacaccatctcaagaaaaaaaaaaaaaaaaaagaaatgttcttcatctcagccagggaaaaaaggtttaatcaaaggcctagctttgttaggtgtattttattacaatttctttaaaatggccagcttcttgctaacagatggaaaaaggggaagggtgtctgagatctccgaattctctggcctgagccttgccctcatctcaaccccaggttctgggtctctgctgcagattcctttctattcctcatttgaggatgacagaggccatccccctttcctcaatgcactccccatccacagagcaatgaatgaaactacagtggccaccagtgtttcttcaaaaggggcttcccctgcaaatgtaagaacttaaaaaaaaattctatacataaaaacaagaatcaccaccatatttgatgactcagcaaacatttctttctctgtctctctttggatggtgtctttcattcagcattgcaagaagttcctgaaggaaagacaaaatttgagaaaccctggatgcggttaactcaatcattgttcaccgtggaactttgagtgacttgatgttctctcctgaacaacaatgagaacaccaaagatgaacgggagctggtggctgggagcgccagagaagccatccaggattccttacctcctttcctttatgcattctcagcttccatccctccattatcctctacctgcactgttaccatttaccattttccagcaaaaaaatatgtagaatggaggaagggagggggcacattgtgtgtgtgccagtatcctcatggggccacagcctcttgctgggagttccatgtaaccgtcaccacccaaacacagaagcactgagaagcacttagggctgatgggtacacatgtagattctactaaatcggaatttgcaggtttgcttccctatactggtaaactcttttttttttttttttttttttgagacagtcttgctgtgtggcccaggctggagtgcagtggcatgacctcagctcactgcaactaccacttcctgggtttaagtgattctcatgcctcagcctccgcagtagctgggacttcaggcatgcaccaccatgcccagctaatttttgtatttttagtagaggtgggggtttccccatgttgaccaggctggtcttgaacttccaacctcaagtgacctgcccacctcagcctcccaaagtgctggcattacaggcatgagacaccacgcccgacctaaactctttttttaatgagcactcccagttaattgtcagtgtttaagaaccactgcttagagacacccccaaccagagctgcccactctgacccagagcctttgatacaaccctcagataaagctggtttgttgtagatttctctccttagcaatgtctgcagattatctgtttacccggggacatggattaaaatgccaaaatattttagagagaacagaacccacacaattaagtgaaccttacttagcatcgatacatacagcactataccgcatatgcgtagtttgcaacttccccatggattacagcgtgctgggttagtgccaactatcaattcttgctccgcagggcaggatagcaaagtgatcaggcagtcatctccttcctgggtctcccctgtatccctgctcctgtcactgtcttcttctgtatcagactgggccacatcagcttgcttgtatcagagattcaatgcttgttgatgcagttctccctgcctatgatttcaccacttctagactttaaatacagagtcatatcagccatacttcaatggctgtggctggttctatttctctgtactatcaatatccagggaaatgctggagttgtaacactctatttctgtgaaatatttgctgccctcacccaggaaagcctttactctacacagcaggatgtcaagggcaagaggtgcctaatacagacttctctgactcttaactgaatgagcacactctcagcagggtatggctgtgttcgtttgctagggttgccataacaaaatgcaacaaacctccgggcgtggtggctcacacctgtaatcccagcactttgggaggccaaggcgggtggatcacctgagatcaggagttcgagaccagcctgaccaacatggtgaaactccgtctctactaaaaatacaaaaattagccaggcacggtggcgtgcacctgtaatcccagctactagggaggctgaggcaagagaattgcttgaacccaggaggcagaggttgcagtgagctgagatcacaccactgcactccagcctgggcagcagagcaggactctgactcaaaaaaaaaaaaaaatgccacaaaccgagtggcatttatgacaaaaatttatagactcaccgttctggaagttagaagttcaagtcaaggtgtacacaggaccatgctgtctctgaaggtgtcaggaaaggatctgttcctggcctgtcgtagctttgggtagttccttggcttatggctgcataacctcagtcttcacatggcattctccctatgtatatgtcaatgtccaaacttcctttttctataagggtgctagtcgtattgatgtagagcccaccctaatgacctcatcttaatttgatcatctgcaaagaccttaggtccaaataaagttactttcacagctactagaggttagttaggacctcaacatcttttgaggggactcaattcaaccaataacaatggctgactctgaatgtctacatccttcccagcatcacttagaagggcttcgatatttattgcattatcagtgttcctcattccctaacgtcagcacccagaatttaaaactgtaccttggagagaggttccaagatggccggataggaagagctccagtctacagctcccagcgtgagtgatgcagaagatgggtgatttctgcatttccaactgaggtaccaggttcatctcactggggcttgttggacagtgggtgcagcccacagagcagggtggggcatcacctcacccaggaagcactaggggttggggaattccctttcctagccaagggaagccgtgacagatggtacctggaaagtcgggtcactcccaccctaatactgtgcttttccaatggtcttagcaaacggcacaccaggagattatatcctgtgcctggcttggagggtgccatgcccatggagcctcactcactgctagcacagcagtctgagatcaaactgcaaggtggcagggaggctgtgaggaggggcatccaccattgctgaggcttgagtagataaacaaagcagccaggaagctcaaactgggtggagcccactgcagctcaaggaggcctgcctgcctctgtagactccacctctgggggtagggcatagctgaacaaaaggcagcagaaacttcttcagacttgcacatccctgtctgacagcattgaagacagtagtggttctccaagcacggagttggagatctgagtatggagactgcctcctcaagtggttccctgacccctgagtagcctaactgggagacacctccaagtaggggccaactgacacctcatacagccaggtgcccctctgagacgaagcttccagaggaaggatcaggcagcaacatttgccgctctgcaatatttgttgttctgcagcctccgctggtgatacccaggcaaacagggtctggagtggacctccagcaaactccaacagacctgcagctgagggtcctgactgttagaaggaaaactaacaaacagaaaggacctccacaccaaaaccccatctgtacgttaccatcatcaaagaccaaaggtagataaaaccacaaagatggggagaaaccagagcagaaaagctgaaaattctaaaaatcagagcacctcttctcctccaaaggaacgcagctcctcaccagcaatggaacaaagctggatggagaatgactttgacgagttgagagaagaaggcttcagatgattggtaagaacaaacttctccaagctaaaggaggaagttcgaacccatcacaaagaagctaaaaaccttgaaaaaagattagacaaatggctaactagaataaacagcatagagaagacgttaaatgacctgatggagctgaaaaccatggcaagagaactatgtgatgcatacaaaagcttcagtagccaatttgatcaggtggaagaaagggtatcagtgattgaagatcaaatgaatgaaatgaagcgagaagagaagtttagagaaaaaagaataaaaagaaatgaacaagcctccaagaaataagcgactatgtgaaaagaccaaatctacatctgattggtgtgcctgaaagtgacggggagaatggaaccaagttggaaaacactcttcaggatatcagccaggagaacttccccaacctagcaagtcaggccaacattcaaattcaggaaatacagagaacgccacaaagatactccatgagaagagcaactccaagaaacataattgtcagattctccaaagttgaaatgaaggaaaaaatgttaagggcagcaagaaagaaaggtcaggttacccacaaaggaaagcccaccagactaacagctgatctctcagcagaaactctacaagccagaagagagtgggcgccaatattcaacattcttaaagagaagaattttcaacccagaatttcatatccagccaaactaagcttcataagtgaaggagaaataaaatactttacagacaagcaaatgctgagagattttgtcatcaccaggcctgccctaaaagagctcctgaaggaagcactaaacatggaaaggaacaactggtaccagccactgcaaaaacatgccaaactgtaaagaccatcgatgctaggaagaaactgcatcaactaatgaacaaaataaccagctaacatcataatgacaggatcaaattcacacataacaatgttaaatgtaaatgggctaaatgctccaattaaaagacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccacatattctcactcataggtgggaattgaacaatgagaacacttggacacagggtggggaacatcacacactggggcctgtcatggggtgggggaagggggggagggatagcattaggagatatgtaaatgacgagttaacaggtgtagcacaccaacatggcacatgtatacatatgtaacaaacctgcacattgtgcacatgtaccctagaagttaaagtataataaaaaaaaaaaaactgtaccttgtgaaagtttgctatttgcaccattaaggcttaccaagatgtgcacagtagcacataattagtgccctgtcactggaactgacaatacttgctccagccatccagtggaggcacttagactgagaatagcagattcctgggctgcatcgggtctagctttgatcctggaagaaggtcaggatttagggaactctggaggggaagtgaggctatgcgaagtaaaagtagctattttggtggccctaagaatgtagctgtcatgattaggggccaacagataaaccagtttgaccaaaacaaagaaggaactgatgcaggtagtgatggaaaagattggtgagagattacgcagggtcttctgtgctagactacaaaatttatacttgatcttgtgagatctagagagccactaaccaggaggatatctgggagttattgtttttggaagatttatcttttgatccatgaaagatgggaagtgaaggatgggatgtccggagaggattaagattagtatgtcaacaatgaagttgaaaagttacaagcatgcaggttgagaataccccctcctcttaccccaccacctggagtccttccgcttgtcttttagacccagatcagctgccagtccactaggaagcctttcagagttacttaccatttgatgccatagtccttaacatacattgccaccatagtgctcaccattttatattgtgatatgttctgtctccacatgtctccactggactgtgcacttgtgaaaggcacaaatactttttattctaccttgtagcctttatgaacagcaatagaccacgagagatgctcaagaaacatctaatgaagcaacagaaagacagaaagccagtcagctaacagccatttgactgtaatatgagccagtcaagaatgtagacacttggaactagaaagggccttgatggtcatctaacccagttacccagtaaccactgaatcctgggcatgtgataaccccaccttattccatcctggagcagctctggctgtaagaagtgtagagctggaggggaactcagaaactaccatattcaaaagataaagaagtgaagtgattggcccaaggttgctcaaaaactagcagcaaagttggaaaatagaagagaaactaatacgactaactgccaagtccatccagtcctcgccaccatcctacagagtggaagtattaccatgttgaaatttacggtaaaggatgtggaggctaagaggtattgagtggcttgtttggggttgcacagttgataagtggcagagccaggataggaggaaattgatctctttccacttgccaacaccctgtgccatccctgcataagatcacaggcttcctgagaccctggaaaatgctcctgtcatttcctaagcagaccctgctccaggatctcttttgaaatccccccctctttctcacttccatttttcttgcttttcaggagagaagtatgagctccatgcagggactgagtccaccccaagtgtcgtcgtgcacgtgtgcgacagtgacatagaggaagaagaggacccaaagacttccccaaagccaaaaatcatccaaactcggcgtcctggcctgccaccctccgtgtccaactgagctgcctgctccttctcgataatagccgtctcctctttatcatgctttttccccctgttgtttgtcaaaaaaaattgcctttaaattcctgggtgtttggttgtttgagattccttccttgttatcaagcctctcggacaaaagggctaggaaaaggtgatatgtctcctgatcatatcatacccattaagtataacccattatttagaaggttctagggaaaaaagtagtattttcttattaaacaatcagcacagcctatatctttgttctctcatgttgatccaagccagagacatcagtaacaaatagcacctgtgttgtttgtgagctgtttcagtcccagtcctgatgtgtgtgcgttgttctctcctggccacttaaataggaccatatgtaaacttgactttgactgcatgagatatccctatctggtctcactcagtcctctgcatcccaacattcccaggacatgcatgatcaccagcatttattttcatgatttgaggatatcttataactcacagattgtcagcatccagccatgtcctatctagattaggaaaatgatcagaatattccagctcaacaagtctgggtatattcactattgtgagtcaatacaccatagctctgttgaaattcctggaggcaaaattgaccttggccccaaagatattcctcaatagatttcaaacaccactcccctgtagaactctcccagcctcgttggggaggcttgtccagggtgatagagactgatttcagacaaacctatttattacaaaagtttcatggtgtctgaatgattgttttctctctttgtatatttgtacaaatgtttcagctgtgcttttaaaaaatctggatgttttttatttagtgattgttcgacaattagctgcttcaaaacataatgtgcattgcttatgaatgccttcatatactaatacagatactctgataatattacactctaataaggataatgctgaattttgaaaggacacaaaacatctaatgccaatatatacatgattagccaacatctttgctatcaagaccacttgtttttaaataaagatgcaagtgtcagttgtagattattgggatgaagctaaatccccagaatgcagcagcagctgagcatgttaaaatggggaaggatgatagctacatgtatgccggtcctactcacgcgacacccgtgtgctcaaaaaagttatttgtttttgttacgtgtgatttttctatttctctagcccaaagtgcattacagaagatacacctatagaaccattaccttctgctatgtgtgccaggcctcatctactcctgtacattaatgaattactttagatgcaaacgcagattacaatggagtggggaagtactttcattacccaagcctcagaaaaacacacaagaacaataacacagcaaacagattgagggattgttgtggtttttgactaaggtgtatgttagtttcatcagaaacttaaaacatagactgatcactcagaaattaaagtccgttttactgtgaatatagcaatatagtactggacacagtactggtgaaactgaggagagcattgcttgtaaaatcctgagtttccataaggaaaatgaaaactccttttaaaaataaaatctgaggagtgtacaataagcatatgctttgactttcctttgctgtggaggtttttggtttttcattgatgataaacgactacagacttagtagtggagaaatggtgtcctctagtggaagaaatagtaggctccgctattcagatgcagagcactgcagcatccagcctttcaaagctgactcttctcaatcatctgtgggtcatttgacttgattttttaagctaccctgaatttccagaatgcaggttctaaagaaatctagatgagagaaagtatttgaaaatgatttttaaatgttttttaaaagacacatctgacatttttaacaacttagtaaaagttgaaatgaccattctgtgtagtcataaaagaaacacaatgaagtgtatggcctctggagttagtcttagtaaaacttattgctctgtgtcaatgttaacctgtctcagatcaagtaattctttcactaggttgggtttggggaggggggaaaagaggggcttttcctaggagaacgataagaaatggaaagactccttgaagtgttgcaagggaacctcctagcactgtgaaagtcagaatcgcctcagcatttccatgacgcacattatgcaaatctctttagcactattttaagtttgaaaactttaacaatgaaggggaaggggaagatttccaccaactgaatcatttgtgcacgtgtatagctcaaagagcttagacttcaaatatatctggtgaatgactctttgtccatgtggtttaatttctgtgttgtcgacctgagttgaatattcttgaggggtaattgtgggggactgcatttcaacctagagtttttctaagaagtccccaacgtatggggttaacccatatacctaggctcttcctgaaagtgggggaagctggttggcagccctctcttgggggaaggggaatttgagcagggcctggagggcagggttggcctctgataagaggaactgggagagctccctgttttattgccatgtttcaacatcttggtcctaaaagccatttcaagtgtactaaaaacctcttttaatgtcttcccactctattctcttgttaaaagcactataagagacctgagttagcaaaaaaattattattcaggagaaaagcactatcataatctaaatgattaatacattaaatgccattaaaatgaagagcttctgttcatcagatgggtattaggagaatgaaaagggacagcatcagactggaaaaggatatttgagacacatgtagttgtaaaataaattatatccaaaatgtaaaaagaaaaccctacaaataaggaaaacagacaatccatttctttgatcatcaaaaaatttcaaaggcacttcatacaggcaattcacatacacacagacatacacaaaatacccagatgacccattagcattcaaaagatgctcaattttattgcttatcagacaaaagcaaatgataatctcagagctactacacagatctatcagaatgactaaaattaagtctggagaaataaaaagttctggtaaggatatgaaggaaggggaactgtcatgcaccactggtggagtgtcaactggtgctcacttcacagcactgtttggtaatatctgctaaagctaacatgcctctgggagcaattcactccagggcatgcacctagcagatacaagtgcacacatctatcaaaatacttgtacaataatgtccctagcaaagttgttcatcatagccattaactggatacagcccaaatgtccttcaactatagaataaactgtgctatcctcacacaaaggaatgtcacaaagcaataagacacataaactagtggtacatatatgaacatgaatagatcgcaaaatcatattttgagcaaaaaagaaaaactagacatgaaaaaaatacatagtatatgactccttttagcaagctaagaaagtcaaaactggcctatataaatagaaataatagtggctattatgaaaacacttaggactgtaaggtcccccaacaccacccccaaactaaaaaaagtgctaagagtccaaagaaggactcagacctaagtccagcatgaggagtagatgagtttattaggacttacatacggggcactctgggatggcggcaggatagctattgatatgtgcgccacctcccatcccataaactgctgttaagctagtttcctggctctttgcctacgtgtttgaacaatgagactgtttttcttggtagttcctcagaaactctctgggaggtttggcttctcagggacacctgctcctcagctcggcaccagggtcttggctcactgtccggccctcagagttcaggcaacagacttatacccttcggtaacctgttgggggacctgtcacagtacagtggctaccttttgaatggtactgcctgagaggaaccctctcatgtggaagccttccaatgtgccatcaatattctacatctcgatcctgatctccatatggatgtatacccatgtaaaattcagttaaaatgtgtgccatatactacagtaagttatacctcaactaaaacaaaagctgttctccctgaggacagagaagaaggagccattagttgtgatgggggtttagaatgtcctcatactaaaaacgtacgtctcccatctcatgtctgtgagatatttccatattttcaaagccttcatttaaaaatctataaataagtgttcc

SEQ ID NO: 12531 - DNA, 11766 bp, Human
tgtcactacgttgcccaggctggtcttgaacttctggcctcaacggaccctcccgcatcggcctcccacggtgctggctgaagggtgagcccaggctggccacagcgcgttttcatcattgtccgcagcttgcagtcggctggttcagagcttagccgggcacatgggcccctctgaggctcctgttcagggctcagccgtgtctacggggccctccgagctcttcctggaccctcctcggctccttcagttcagggctcagctgggcacgtgggcgcctccttggctcctccggctcaggcctctcctcgagctctgggccctgagtattctgggctccttccttggtttcctttggcctttggccgggaaagttgtgggtgtccgtggcagcctgggccacttcacagccccgcagccaacctgcggctccttcagagcaaagctgtgtggacacaaagggaacgccactcggagctggcctctccctttacctgtgagttcccgcccaagccggctgccttctgtcccctccccagagcccttgggtaactggtttgctacaagagtgtctggaatttttcagttgttctctgcggaagggagtttttaaaaggcccttaatcccttcttgacatttgtaagttgacgcttacacctggcagccttgctgaattctgtgtgcgtgaaggtccgattccaccgcgagtcacgatagaaaacccactctgtggagagaccagagatgaccgccgcgcacacctccgttcagcacacaaacctttgcaggtgttcatagcggaggcagattccgtactggggataagagctcacgacatgctgggaggggtttcaggggcagggagggggcttctgtggccccaggtcaggaggagcagctcttccatcagcagcaggcagccagcccagatgcgtggggaagacagctcccacttcgccaggccagagagcgcccgggggcagctctgttccagtcgaccctgcgagaaaggggtgtgcgtgtgcctggagctgggccccgtcctgcctccctgacctgtgtgctcccacagccctgagacggacggctcacagccttgcgaggcccacactgcactgggggtcaggcttgtgctcccgggagtcctgtctgggctgcgtggccaccatccagagcctgctgacctgcgactgggggggccagtgctccctgggtttcagcacctgagaatcagagtgggatcccgtgaaacctgggcccaggctcccacccacgccccacacccacccagggcagccatgaaacctgggcccgggctcctactcacaccccacccccacccagggcagccgtgaaacctgggccctgggctcccacccacgccccacacccacccagggcagccatgaaacctgggcccgggctcctacacatgccccacacccacccagggcagccgtgaaacctgggcccgggctcccaccctcgcccaccgagggcagctttgccttcctgggcatccctcctcccccaggcctggcccgctgcctgtccaaggctcctgtgcggggtctccacccacacattcctggggcgtgaggcgccaccactccctgctgccccgggcaaagccgtcatttgttccctttgacggcccgggaggctgccaggctctccacccccacttcccaattgaggaaaccgaggcagaggaggctcaggtgtggccaatcaccctgcacatcagagttaccctgggcagggcccactgagacctgggaggggccactcgggacctggagggctgggggctgcccgggcgttaggggtaaagctccctacccaactgcgcagaaggcctcagaggcctgggggctgggcttcccctttcacatcgccctttagaggcccacgtgtgggcattggcccgcgatctgaaaggggctgtcctgttcctcatgggcgctgccagcgccacgcactcctctttctgcctggccggccactcccgtctgctgtgacgcgcggacagagagctaccggtggacccacggtgcctccctccctgggatctgtaagtaacaacctttgagctctttctgttgtggtgtggatggaatctgcaccttccatctggagaactggggccgccccaggccgggcttccagcaccagagcgatggtcaggcttcagctggacgcagatttcaccccgcagggcacacgcagacccatttgtttggaagcggcagtcctaaggcagtgcaggtgcctccacggccccagcccagctctcctgcaggtgtaaaggatgcagattccagggccccccgtggcctgcagaggcccctcagagcaggaagggccgggctctcggggagcccccatcccaggtgctgaggtccttgggtcacatggagctggggtggggagtgcccaggtcccctgtgatccgatggccacgtttccctcctggcttcacgcaccccaagggctgggggtcccactcactgcccattttctggctgtggggggggtctgttttcttccaccttctcaaggtgttcagagcctcaggggcctccccacttcctctggggcctgggggagtagagtctgtcacccggaggctgtgtgcctccccgtgacattccccagtggccgggccgaccaggcaggctctgcctgtggatggggctgctgagcatgagcgtgtgacccccatttctgagctgtgggtggacccaccgggcctgggccaaggttttcaggaggcagctctattctactccgccatggtggcctccctgaaaggggtgagtgtagaagccagttccctcttctgcgagccccacccctaccccaggaggacaattcttgttcagggagggtctccccacccacttccccaccccacagtggcccacaggccccaccctagagagtacaaggggctccccaggctgctcactggcccagccccgccccacctggactgcacctgaaaatgggctcagagaggccaagtggcccaaaaagacgctgctgggtgggaaggggcggtggcctctgtgcccgcagtgcccctcctgcctcaagggtgttgtctgcctggcagagcctggggtgttcacaaagcccaggcacctgcagctgagggcaggggagagggaagggagccacatccaggcgacggggctgctcgtcctcctgtgcgagagtggggagactcaggccagcccaagtgggcggcggccccggttgcttgatctaagctctgctcacactgccctgcccttctgggagaggggtgggcgccaactgactcctgggctgtctgggctggggaccgggatctcagacccagcccctcccctggacaggaggagccagtccaggggacagagggctcagtggctggagggcagggccagggtgcggacacaagctgcaggtaccacagaagtttgctctgggagcccctcctgggcccatgtggccccaggctggcccaggacagaggcgtggggtgggagcagggggtcccatcctgagtcactgccctccacagacacagaccatggccttgccaacggctcgacccctgttggggtcctgtgggacccccgccctcggcagcctcctgttcctgctcttcagcctcggtgcgtacttgatggggctgctggtgaggtggggacggcccaggggccttgggggccaggcccccagcaaggctttgcctgcccctgccttctccctggagtgcctgtggtggccacgtctcagcagcagtctctgcccccagaggtgactggagctggagatccagccagggagtgatggggctcaggacacagtggggatgtctgtgggatgggtggtctgaccggccaagcagccgggtctcagggaaagatgtggaaggccgggctccctggtggagtcccgacccctgtgcctgggggactgtgatgtcacggggtacatgggcctgagccactggcttctctttggggtgtgcacagggctggctgtgggggcggccaggctctgcctccttcctcccctgggtcagggcacagcccagaggcccgccccctcccccaagctgtcccctctgcccctttaggatgggtgcagccctcgaggaccctggctggagagacagggcaggtaaggtcccctctggggaaacaggggagggtcttcaggtcccaggtgggggtgccatgctgtgttctctctgtcacgtatccacggtgcttgccagtttccacggtccttgcttgcaaaggggcacctggacctgcatgtgactggcctgggagcagccaggtccagggagcggcagagctgaaattgcagctgggtctgggaagtagatggatgagaagcagccaagcccatgggtctgagacacagccaggcctgggaagtagctgaactcggggagtacctggcccaggggtagcgggacctgggaactcctgctccagagagctggtctgagccatgttcagcaggccctgtgtccccaggaggctgcgcccctggacggagtcctggccaacccacctaacatttccaggtgggtctggggtcctcacagtcctcaagggtgaggctcgaggggccctcgggactgagggtgggcagggcaccccatcccccagcatcccctcccccttcctcctctgctccacctcagatctgactgggctcaggactgcgggagggactgacacccctcaggtgatggcaactcccggcccttgagggcgtcacctggtcttggggggaggtctgcagggagcaccagggtcctttggggagaggtggggctgtggggcttggggagcactgggtggacattgcaggggaggggcgatcgtgggtgcccagcccgacccttcctgcagcctctcccctcgccaactccttggcttcccgtgtgcggaggtgtccggcctgagcacggagcgtgtccgggagctggctgtggccttggcacagaagaatgtcaagctctcaacagagcaggtcagtctcagttgggctgaggcaggtgggcacagctggggctgaggaattcacaggcagctctgcagtgcccaccttgccaccacggtcccctctgtccctgctgccatctctccccggccagttcttcccagagttcctctggccacccaagctgaccactggggtgcctgtccacgtcaggggctggctccccaggagcaagtctgatatgacgctgtgtgctgggccccctcctggagcgccgtgggcagccctccaggctctgccccaagggtgaatctttttcgggggagtgggtgagatctggggaaggggagcggagccaggcacgggagcccccatcccccagggcagcgctgcaggcggccagagatccacttccacagattctcgtggccagggcaggggtgtgttgtggtgggcagactggccaggcgaccctggcccaccatgtgagtggcggctcgaaacgctctgtgctggactccctgcccctgcagctgcgctgtctggctcaccggctctctgagccccccgaggacctggacgccctcccattggacctgctgctattcctcaagtaggccctgccccctgaacccacccccccggcttttgccgccagccctcagcccccaaccccctgccccttgcctcggatcccaggccacagcagagatgtggaggccggccgggctgcctctcagggtggggacgggtgtgatcagtgcggcctgtccccagcaccctctcttcacagcccagatgcgttctcggggccccaggcctgcacccgtttcttctcccgcatcacgaaggccaatgtggacctgctcccgaggggggctcccgagcgacagcggctgctgcctgcggctctggcctgctgggtaggggctggggccagcgcggggcggagagggctcggcagttccaaaagcgctgaggccagcctctctgcagggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacgggtaagtgaaggtgtctggaacctcgaaggctcacctggcggcgtggtatcagcagcgtgaggacacttgcggccatgcctcaaggcccagggtcagtcacccccgccaccacccctgccaatgcccccagcgtcccctccacagccagggggtacggcctggcctcttccctctctggggctgcacgtggggggtccctgagctgtgtcccgtgtctgcacagccccccgtcgacatggtctgtctccacgatggacgctctgcggggcctgctgcccgtgctgggccagcccatcatccgcagcatcccgcaggtgagaccccgatccccagcccgtggggatgcccggccacccgaggctcagcccaggtcctgctcgtcctcagggcatcgtggccgcgtggcggcaacgctcctctcgggacccatcctggcggcagcctgaacggaccatcctccggccgcggttccggcgggaagtggagagtgagtgccgtgccctgcgcagtctggcaccaggctgggcagcacccctgggggtgggcatcactttagggtctcacctgcccctccctggctctgcagcacatcccattataatcacagagagtggacagaatccctgtttgccagtgggtaaactgaggcacagggagggtcacaaatggcccgaggtctcatctcacaggaggtgtgggaggaagaaggggtcaaacgaactccggccctgacccctgacccctgtgccctgcagagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgaggtagttcatgactcaagttcccaccggcctgctgtgtccaagccatccccagcccctctgggagtgacatgggccctcctggtctcttggcctgcagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtgaccgtccggctcgggggtcatgtggcatgagattgggaagggctgaggggcagagtgggggacaaagcctgaggttgggcgggcctggggtcaggggcacggcctgaggttatgctggtggtggagggatacatctctccttgccacaaggctcctcggcggcccctcccacaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctggtgagtccccagaactctgcccggcaaggtgggtccgtgtgctggcgctcactgtccacccaccgtgtccccagggcggtcaggccccaggacctggacacgtgtgacccaaggcagctggacgtcctctatcccaaggcccgccttgctttccagaacatgaacgggtccgaatacttcgtgaagatccagtccttcctgggtgagccagggagtccctggccagggtgggcaacacaacgggggaagcacagactccactcgggggtgccaggcctttgcctcgccgggccgtctgctgccagggtaactgggtggtcacccgccctctgccccccggggtgtgtatggccttaggggctgtgggttctgaccccagctcggggcgccagccacctccagggtctcccacgcctgggggtcaggcggctaggcaaacccaggccctggaatccctaaggaaaaagggaagccctgtaaggcaagtgggcttcctgcagcctgtggtcaagggcctgggggtgtgaggtgaggcctcagctcgggcccctctcccggcgggcaggtggggcccccacggaggatttgaaggcgctcagtcagcagaatgtgagcatggacttggccacgttcatgaagctgcggacggatgcggtgctggtatggcgagcgggaggaggggcgtgtggaggaggggcccgtggaggaggggcgagtgggaggaggggcgcgtggagggggggcgtgtgggggggtgcgtggaggaggggcgcgtggaggaggggcgcgtggaggggggagcgtggggggcgtggaggaggggcgcgtggaggaggggcgcgtggaggggggagcgtggggggcgtggaggaggggcgcgtggaggggggagtgtgggggggcgtggaggaggaggggcgcatgggggggtgtggaggggggcgcgtggaggaggggcgcgtggaggggggagcgtggggggcgtggaggaggggcgcgtggaggggggcgcgtggggggggcgcatgggggggcgtggaggggggtgcgtggaggaggggcgcgtggaggaggaggggcgcatgggggggtgtggaggggggcgcgtggagggggcacgtggaggggtcgcgtggaggaggggcgcgtggagggggccgtgtgggggggcgtggaggggggcgcgtggaggaggaggggcgcatgggggggtgtggaggggggcgcgtggagggggcgcgtggaggaggggcacatggaggggggggcaagtggagaagccctggtggaggggcgcatggaggaggggccaacggggggtgggagggcgtgtaaggcgggtctgcagtggggcgaggccttaggaagggcagcatcttcccgtgtggtggggcctagggaagggcagccattgagctgaggtcagctggccggagacctccgaagtctggagaggctgcggtgggcatctgtgggtggggcagtttggacacaggagagcctggcagccctctggcggcgctgagggaaggagaccctccttgatggctgcccggggtctctggcagccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaaggtgggcggggcggccaggccagggctgggggcagagctgggggcgtggaggtgggcgctctgagtcacccctctctctgtagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgtcttgtggcctccgaggactttctgtgaccccaccagcgtggcccctctccctctggtcttgcgcccccaggccaggtgggggcccttggaggtcttcctgaccctgctgccactgtgctgagggccaggccagcactcagggtggccccaggagccggtggtgggagtcctgtgcccctgtccccacaggcttggccccggctaggacattcccgggcccccctgctcaggccctgagcacagacacaggcaggaccacgaccgtggactttattcatgtccagcagtgaagtctgtggccccggccccggccccggccccggccccagccccaaccccaaccccaaccccggccccggccccggccccggccccagccccagccccagccccagccccagccctccgcagggcccgggcagcgtcttccgtggcccgcctgggcctgtggttgtgcgggaggcaccttcttagggcctggtcctcagtccagctcccagggcctggaggcggggatgggtgggacggtctaggaggtggggcttgggtaggttggcctggcctagagctggcccgtcagcccaagtgggcgtccagctgaatctaacacctctgtttttcctgcacctgacccctgtgaacccagccaccctgaggcaacgctgtccacagaaaccaggatgcaagtcccccagtgcagcaggcacaggaggctgcaaggcagggccatcgccaggggcaggtaccccaggggggcccacaggctgcctgtagatggaacagggaggccaccatcagtcccaccagacgctacccccatatccaccccctagagccagacaggcctgggcagtccctccctctggctggggagggtggggacagccagcgaggacacccacctgcggctgctctcctgggacccaacaaaggtctcaaagtttcccctgctcccactttctgctggtcagtgggttttaggagaggcagctgtatctctaactcagtggtcaatgaagggtgaagcagggttggccagcctcatcccaggaggcaatggacaaagctggtggacaggcctgtgggagtggccacgaggcggggacgggtctgagagggccctgggcagagggggccaagccggaggggtgcgggggccatacctgaggtggaggcctgggcatcgttcgtgggcaggcccgaggtgtggaccagatggagcacttggtgggtggtgctggggggccccctggtgccgtgggctgggccagtggggctggtggggctggcgtccaggccgagctggcccagggtggagctgttgaggctgcgcagccaggccctgacggtggggtggctgcgggccttctgaaggtctcccacgttgtggcccagcagcgcagtcacgttgccaacatccaggctctgcggagaggggtggggcagaggggccgtggggccaacttctgggccaggggaagacccacagggtagggccagacccaggatggggcagatggcgggagtgaggcccagaaacggcctggaggagggaagtgggggtatgctggctgtgacctgtgacctaggggctcccctgcctgggacagccctgcacccccacccccacccccacccccacccccacggggtagcccagccccacctgcagctcgagggggttcaggctggtgaaggtgtcgatgtccatggagatgttggcgtgggccaggtgccgcagctcctccaccggggcgccgcctggggggacgggtgaggggggctgggctccaccaggggagccgcctggggggacggggtgagggggggctgggctccaccatgggagccgcctggggggatggggtgaggggggctgggctccaccagggaagctgcctggggggacggggtgaggggggtggggcttctgggggaggggtgcccacccatggacagggctcaccgaggtaggggcgcatgaggcggtagtaggcagc

SEQ ID NO: 12532 - DNA, 49407 bp, Human
  misc_feature (1)...(49407): n = A,T,C or G
atttaatagccagccttcatcaatactaattttcagctatggaatcaaacatatatggccctactctgggacacacctctaccagatttaatagacattcctcattaacactttcagctatggaattgcagacagttgatgatgaagcaatgatatcataaatgaatatcaagtcagggaagcagaatgatgcccaagggtggatgttctaaaacgtgacaagaattttctctcagtgatgacatggcagagaaataagctaggaaaaaatgataagataaagtttctctaaccaagacctcaaagctggactacagtgatggagggaaggaattgagagagcaagccaccaagcggaagctgctcttcaccctgggggggtgggcaatggacagcagaaggactcagacacagatgcttccagccagcccagtctctgttgtggtactgcaaggttgatacactccctgaagcaccacggcatgaaatggaggttcctacagccaagaagaaagagaagcaggttctgagcagaagacgattaagaaggagcctgtcatccagaagtccagcctgctatttggcatggggctatcagggatccaagccagctacctcatctctgaacaccagcaggtgactcttcccatgcagatgacagccaaggagtctgaaaacagcccagaggacaaaacaccaaatcacccctcccagtctacagtgtgttggaagggaatagctaactctgcctcaaaaaacaaagataaagggaacaagacaaacaaacaagcagagacctttctgcactgagctgccatctgaagggatatccaggacttcaaagggttcattagtgagtggatggacatcaacaccaaggtcttcacaggctggacagtgccgcatgtaacatgtaacaagggatattacacggttgcaaagcagccactggccccaggtacagaggtgaacactaagggcctggtgaacactacgcctttgcagaacaccaccaacaacaggcatgacaagattggcaacttcccttggcccttcacacgtctgctctgtcctgatgtctgggtcattctgtagcttcgtgttcccctatcctagctagtctcatggtgctgggcatgaggaagtaagtttttgcctccctaacctcaaagaccggctgtcccctctatctgcccccagctttctcaccttggatcagtacctgaacagcctctcacagtattcacaacaagcaccatctaaaaaaaaaggcttacatccatgagacatgcaggtctggttgtgttttatcaggtgaaggattacaccaagtggaaggaggcctgcaggagttgctgctggtccctgtcgttgtcactgtgggactgttagacctgcaaggcagatccatccaagtctggaatgaagtaataccattccacaggtatagccagtgcataggatgatagaatcaagaatcaaaaaatgacgattataaccagctcagaagcagtgagcactaagacaactcagccttcatggagaagtggctgtttccaggtctgaagcaaagaatgacatgatgtacccaaaaccctctgtcttgctggaaaggagggctggaactcacaggtggggagggtcttaagtaatcaccacagctctgtgaagagccccctggccataggcagtatagttggagtgtggtaaggacaaggccaaggggacaaatgaggccacatctgcttgcatccatcatactcctttatggcaagtcatgcctggctattgtgggagatgctggaatccacagtgcctagggtgtaaaaaacagttgcaaaaatgacaagtcactgtgggggatggaggggactctgaattaaagatttctgtgacaatcagggaaacctgaactgattacatatttgatgttaaaaaaatcctattaaatttttaggtaagataatggcattatggtttgttttgtttgttttttttaagggcccttccagagaaatgtactgaaaaagtctacgcaatgtctgggatttgctaaacaatacctggaaagcagacaggtatgagtggaatggcactggctgtgggctgacaggtgacgcaactggggcagggggcatcctttgagtttttatatttttgtaattatcacttttaaactttttattattgagaatgtcaaagaccctggaaacatggtgaggtaagcaagaaaatggtccccaagtgcttacatcacgaccccagaagctatgggtatatgaccacacataggagattatccaggattatctgggctggcccagggtaaccacatgagtccttgcagtttaagagcttttcctggctgagccacacagataccaaaagaagcagaaaacattagagcctgagggccctcctcaggcttcttctggtatctggctttgctggccttggagtagggggccaaggaatgtggtggcctcttaggggctgggaacaggaacctcagtcccgctcctgccagcaccttgaccttagcccagttagggaggcagattttggacctctgacttccagaactgtagcctaagattgcagtgatttgttgtaagttgcaatagaaaactcatacacataaaaactctgtgtggattaaacaatataaaatataatatactaaataaaaatagattatgtgtgtgacaagactctatatcaagctttattacagattcttttaatgcactaatctcagactgaaataaagttgaaattaaatttaatatttgtacttgagttatgtgtatcactgtcctggtgtatgaaacacagtttgctgatgatgaacagctggacagcgctctggaaatgtcaccatgggtgttcctgccactaatattaccacctttatgcttgtgaagtcaagcaaggaagatactatcttatattataatgtaaatgaaaatgaaaaataaaccagcttacagaaacttggaaaaagaagaaaatgtataaaaagagacaaagaaggtcattatgtaatgataaaggggttaattcatcaagaggatataataattataaatatatgcacccaacactggagcccctagatataaaaagcaaatattagagctaaagcaagagataaatcccaagacaataatagcttcaacaccccactttcagtattggacagattatccagacagaaatcagcgaagaatcattggatttaatctgcactatcacataaattgacctaatagatatttacagaacatttcatccaatggcagcagaatacacattcttctcctcggcacatgcatcattctcaaggataaaccataagttatgccacaaataagtctttaaatattcaaaaaaattgaaataatatcaaatatcttttctgaccacaatggaataaaactagaaatcaataacaagaggaatttcggaaactatacaaatgtatggaaattaaacaatatgctcctgaatgaccaatgggtcaatgaataaattaagaaggaaattaaaattttattgaaataaaaatggaaatacaacatagcaaaacctatgggatacagtgaaagcagtagtaagaggaaagtttatagcagtaaacacctacatcaaaaaagtagaaaaacttcaaataaacaacctaatgatgcatctcaaagaactaaaaaagcagaagcaaaccaaacccattcttaataaaagaaaagacataacagagagcagaaataaagaaattgaaatgaaggaaaacaatacaaaagttcaatgaaaccaaaagttggttttttgaaaagataaagttgaaaaaccattagccagactaagaaaacaagagaagactcaaataaataaaatcagataaaaaaaaggaggcattacacctgatactgcagaaattcaaaggatcattagagactactacgagcaactatatggcaataaattggaaaacttagaagaaacagataaattcctagatgcatacaatccactaaaattgaaccagaaaggaactcaaaacctgaatagaccaataataagtaatgagatcaaagccataataaaaagcttcctgcaaagaaaagcccaggacctaatggcttcactgctgaattctaccaaacacttaaagaacaactaataccaatgctactcaaactattcaaaaaaatagagcagtagggaacacttccaaactctgtctatgagaccattattacccagacacaaaaaccaaagacatcaaaaaaagaaaactacaggccaatatccctgatgaatattgatgcaaaaatcctcaacaaacagcaaatcaaactcaacaacacattaaaaagataattcatcatgaccaagtgagatttatcccagagatgcatggatggttcaacatacgcaaatcaatcaatgtgatacatcgtataaacagaatgaaggacaaaaaccatatgatcatttcgactgatgttgaaaaagcatttaattctgtgaagaatgtcaatggtagtttaatgggaatagcattgaatctataaattactttgggcagtatggccattttcatgatattgattcttcctatccatgagcatgaatatttttgcatttgtttgtgtcctctgtgatttccttgagcagtggtttgtagttctcctcgaagaggtccttcacttcccttcttagctgtattcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgtgcaaacaaagacaatttgacttcctctctttctgtttgaatacggtttatttctttctcttgcctgattgccccggccagaacttccatactatgttgaataggagtggtgagagagggcatccttgtcttgtgctggttttcaaggggaaggcttccagcttttgcccatttagtatgatgttggctgtgggtttgtcataagtggcttttattattttgaggtatgttccttcaatacctagtttattaagagttattaagagaattcagctgtaaatccatctggtccttggtttgtttttgtgtttatttgtttgtttgtttgtttgtttgcttgttttggttggtaggctcattgcagcactattcacaacagcaaagacatggaatcaacccaaatgcccatcaatgatagactggataaagaaaatgtggtacatatacaccatggaatactatgcagccataaaaagtaacaagatcatgttccttgcagggacatggatggagctggatgccattatcctgagcaaactaatgcaggaacagaaaaccaagcactgcatgttctcacttataagtgagagctgaacaatgggaacacacagacacagggaggggaactacacacaccagggcctgtcagggagtgaggttgggggagggagagcattgggaaaaatagataatgcatgctgggcttaattactaggtgatgggttgataggtgcagcaaaccaccatggcacatgtttacttatgtaacaaacctgcacatcctgcacatgtaccccagaacttaaaaattaaaattaagaaaaaaaaagaaataaaaataaacaatgtgatgttggtcactgactcaaaaataaagcacttactaaaatacaatatctcttgatgataaaaaaaaaaaactctcaacaaactaggcatagaaggaacatatctcaacataagaaaggccatatatgacatacccatagctgatatcatactgaatggggaaaaaatgaaagccttttctctaatatctggaacacaccaaggatgcctactttcaccactgttattcaacatagtactggaagccctagttagagcaatcagacaagggagagaaatagaagacatccaaattggaaaggaagaagtcaaattatccttgtttgaagactatataatcttatacttggaaaaacctaaagacttctccaaaaacctattagaattgataagcaaattcagtaaagttgcaggatccaaaaatcaacacacaaaaatagtagcatttctatatgccaacagcaaacaatctgaaaaagaaattaagaaagtaattccacttacaataactacaaataaaaaaaaatctgggaataaacttaaccaaagaggcaaaagaactctacaatgaaaactataaaacaatgatgcaaaaaattgaagagttcacaaaaaatgagaagatattccatagtcacggattgggagaatcaatattgttaaaatgtccatactacccaaagcaatctacagattcaatgcaatccctatcaaaataccaatgacattctccacagaaatagaaaaatgatcctacaatttatatggaaacacaaaagacctagagtagccaaagccatactgagcaaaaagagcacaactggaggaatcatattatctgacatcaaattatgccacacagctataataaccaaaacagcatggcactggaagaaaaagagacaaatacaccaaagaaacaaaatagagaacccagaaacaaatctacacatctacattaaactcattttcaacaaaggtagcaagaacatatattggggaaaaagatagtcttttcaataaatggtgctgggaaaactaaatatctatatgctgaagaatgaaaccagactctgtctcttgccatgtgcaaaaaacaaatcaaaatggattaaaaacttaaatctaagatctcaaaccatgaaaccactgtaagaaaacattaaggaagctctccaggacattggtctaggcaaagatttcttgagcagtaccccaaaaacacaggaaaacagagcaaaaatccaccaatgggatcacatcaagttaaaaagcttctgcatagcaaagaaaagaatcaacaaagtgaagagacaacccacaaaatgggagaaaatatctgcaatctatccatctgacaagggattagtaaccagaatatgtaaggagctcaaacaaatctataggaaaaaaatctaataatctgattaaagaatgggcaacagttctgaatagacatttctcaatagacatacaaatggcaaacaagtatatgaaaaggtgctcaacatcattggtcatcaaagaaatgcaaattaaaactacaatgagatatcgtctcaccccaagttaaaatgacttttatccaaaagacagggaataacaaatgctagtgagggatgtggagaaaaggaaactcttgtacactgttggtgggaatgtaaattagtacaaccgttatggaaaacagtttggagtttcctcaaaaaaatataaatagaactaccatataatccagcaatcccactgctagataaacccaaaagaatgcaattcagtatgtcaaagacatacctgtactaccacgtttgttgcagcactattcacaatagccaagatttggaagcaacttaagtgtccatcaacagatgaatagataaagaaaatgtggtacatatacacaatgaagtactattcagccataaaaaaatagatcctgtcatttattccaacatagatagaacttgaggtcattatattacgtgaaataagccaggcacagaaagacaaagttcgcatggtctcactcatttgtggaagctaaaagttaaaacaattgaactcatggagatagaaagtagaaggatggttaccagaggctgggaaggaaagtcaggaatggagggagaaaatgagaatggttaatgggtacaaaatatagttgatagaatgaataagatctagtatttaatagcacaacagggtgactgcagtctacaataatttattgcacattttaaaataactaaaagagtaataattggatggtttgtaacacgatgaaatgataaatgctcaaggtgatggataccgcatttactctgacatgattgttacccattgtatgcctgtatcaaaataactcatgtaccccatactatatgcaatactatgcacccataaaaattaaaaagaaagaaagaaaagaagtctgcaataaaaatccaaagaatgtattctctcttatttcattcttctcaaaagacaatagtgttctgcaatgcactcttcttttcctctacaactgggcagtaagcagggctattcattcaatcttctaggcatcaaattgggagagaaaagtatttttcattcttgttatgaagcatcaagagactattcagtagtacttgccagttcccaaaattatactgacatttaaggggtagttagagaaataagaatccacaaaagaaatggaaggagcagctagataagaagaaggaaagctaagaggtcattgtcctctaagtcaaggttgcaaagcatttacaacatttctctttatagtagaaggaaatgagcaacagtatcaaattcagcaagctgagagcttaagtaaatgtggagagacaactattatatatacctgctgggaagtcatagcaaccttagaagagagctggtctggtgtagtacaaatgttgatttgttattctgactcttccatggactgcactccttagaagcaggtctgaatgttttggtccccacagtacctaggacagtgcctggaatgtaagaggcacttaataaatgtttggcaaatgaatgaactaaaacaaagtaaagtatgtagttgatttggagggaaaagatcccaatgacatttaaaactgcttgtaataagatgcaccaatatttccttaattaaatccctaagtctaaaattatcaccatatatttggcttcttccccaaaggccctgaagccaaaacaactcagttcctaaggagaatatataatctgccacctacaaagataaagtctcaaacataagaagcaaccctaaatttctgtgcttagagtgaccttttgagttgccagagtgatgtcattagtgttacagttttctgcaaggttaggcatataagtatgtgttaaatagttccatgggctcctgcttgctcatttaataaagaagagttcattaagagtatcccaaatgcgtagctcagggccactgacactagaaaactgcaaccactttgttctttccctgccccgtatctcacttgtccttgcagctgtcaccttgaggcctcagcactggtaggaagtgagaagacactgagaagtggcacccagtagaagcttctagaaacagaaagagtatccataaataattaaacttatgaaatcagaacctgagaggttatagtcatgtttctcggctgcccatcataattacctggacagcttccaaaaatacattaatgccagaggcccactcccagagattctcactggcctggagtgagatccaggcaccagtattttttaaaattcttccagataattctaatgtgtgaccagcattcagaggcactatctttatgtctttatatctcagaatgggtatcagaacttaatgctaatgagaaagtacttcagattttatcaccctatgtctcagaaaaccactttcctctattgagtgccactgacccataagaaaaaagatcaatagtctaaatgtacaagtacaaagtgacttaatcgaatttttttacaaaaagagaaaattcaatccatttgtttttaagtttaataacggggtgaaaaaagagtaaactattggttagtgtgtgccactaaccaattattatgttattatgtttcatggtctactttaaacacttttacatgtattgttttacttagtctcccaagcaacccagaaaggcaaatattattattcccatttttacagttgaggaaacaaaaactcagagacggtaaattgacttgtccaaagtcacagagttggcatatggtgatgccaggaggcaaacaaacaaatggccccatctgctgctctcacttatcttttcatcaggccatgttgccctatctaaagaaaatcttagtgaatgatacttcaccaagcaacagaaattttctgtccaagccaatgaaagggatagatggagctggacaattgaaagaaggaaagagaagaagtagagagtaagaagaatgaaagacagtgcaagctaagggaagggtcagaaaggaaacatcaactgcacccagcagatgagtcacagtgcatgaggccaaagtcatactaatggccacatttcccaatacatacttagatggtcaaggcagcaaatacagccagtgtgttactatgtgtcctggattgtgctgtaagggtgcatgagacacagtcctgccctacagatgcttataacctagcatgggaggcagatttgcacgcaaacaggatagattttgccttgccttagcagaagtaagtaccgagaactgggagcagagatgaagaaactgttcatatgggtcagagaagacctcacagaagagggtcatctgagatggctttgaaacagggtaactcattcaccatgaaggcagaaggaatggccgaactgaatcatggaaacagaaactagcaaggtgtgtgcttgagaaatggaaagggccctttataaatttctgagacggggaaattatcacattctcactgactccctccttttactcagggctgagattatatctttaagctttgaattttcacatcatactcatctgcagttacataggaatggttctgccaggttcactccagttcctagatcatttaatggtggaattagattcaggtttcctctcctcactgcccacagctctgttcagccactatacaacgcagatctctgttttacgtgaggattccaaattacaaaattgtgtaaagtactttcttttttggtctctatatccctatcctgatcacaattcaaatgaaaagtttcttgtcctataaaatgagcaaaattgaattaatatcttaaggagttcaggggggctgtctttgagctgggaaagaacctctaagccagcttccattaacatatttggaattctaggtgtttctttgaagcctggaaatttttttaacctgcacagaacctttgtactgttgcctttaaagcagctactcccttttattttaattaacaatgacttcagcaggttttaaataatggtttgtctttatgaaagaaaactagggtggaaacactccaaatccacttattggaataaactgaggagtcactaagtcctttccaacaagatttagacagttcattagaataaatatatatttaatctccctctttctatatcatcttgaaacagagcaaagatacaatgctggaataatgacacacagtctgaaaaatattctaaatgtattgaaatcactgcagctcctttcactttgtatagtttcaaaacatttataatttgtatgatgtgtctattaaatgctgcctaatagccaggaacaggacagcactcaggaatttattggtttagctagactcaaattgtgcccaaaccctgtgaaggaatgactaaagcaatcagaggattccaccagagtccaagttgaaataacttcttgaaagtttaagccaatcctcattcttatgaagtaattcattcaatttagatgaaaagtattcttatttcctgaaagttaactggttttaataatggatgtagtccctattctatttgatattttagagatgttcaaaaagaaacaaataactttaaacaaccaggcctaagccatttaaagagatagcagatttaatttctacgtctttctaaatctagtgtctagggcatccattcaggtgaatcctttgattcctgccattatcctagaacaagagtagatgtatgaattcttgcatctgtactggttactaaactctcagcctctgttctacctcccacagtctctgttcctcatagctctgatgctgacccaagggttatagaaggagatcaactcccaaacctaatcccagaaagtaaatacacaacgatatagtatatgcttagatccattcttcagtttattgaatcacaaaatattggcgctgagaggaatcttagaagccaacagtttcaaactctccgtggtacagactaagccctaaagatgttaagtgactttctcaaggtcacacagctagttagtgacaaaacagggcctataaccaatcacttattatgagtgcatgctctgatcctttgctgctcgctgttgtttgcagaccagcaatatcagcatcgcttgagagcttgttacaaaggcaggctctcagactccacccaagaccctctaaagcagaatttgaattgtaacaaatctttttctttttttttttaaacagggggtgtcactgtgtcatccaggctggagtggtgcagtgacacaaccacggctcactgcagcctggtactcccaggctaaagctatcctcccaccttagcctcccgagtagctggaactacaggcacacactaccacacgtggctaattttttttatttttaattttatgtagagacgggatcttgctatgttgccaggtctggtctcaaattcctggactcaagcgatcctccctactaagcctctcaaattgctgggattataggcataagccaccacaactggcccaaatctttaggtcattcatatgcacattacagagctgaagctaagccaggcacattggcacgcaccggtagtcccaactactggggaagctgaggaggtaggatttcttgaacccaggagtttgaggctgcagtgagctatgactgcgcatgtgaatagccactgcattcctgcctgggaaatgtagcaagttctcatctctaaagaatatatttttcatttaaaaactaaaagaatggaaggcaagtagatactggtttgaagcatgggtctacctcttctaaatgtaagcaaaaatctcaaccttctgaaagcatcatttagaacctggaaataatatcactacccaccttgcagagttttcattgtataagcataacacagatatatgcatgttcatttcatgaaatacgtatgtgcataaataatacattcaaagtgtgtggcatatagtagataatatggtatatagtagctaatgttatttcccatctcatgcttatcattaatattgtgcttaaccaaactgaaagccactaatgactatgcatccatgaaggaatcaccagtcttccttcctttgttctaatgtgttaaatatcattttaacttttatatatgattaaggcttttttatttaatgttcctaactctcaagaaaattattattatgtggaaaacaataatagctaactacttttagtgctgtgcttagagaggaaagaacttctcccaaagccaagtcataataataataataataataataataacccacaacattcttaaaatatcttgactctagagcctataaacctggcttctccagaagccagtgagtatcagctgccactgatgctgtaattttcttaggcagagactcaactgccatgggcagatgccacaacattggcaaaagtggggcacagttaaagatgacgtttcatcaccaacatgtcacacttgtcagcactttaaagaaaaaaacagattgaagaggaaagaagaagttgagttttagtatccaaatttgaactaaaattttggaaaaatacagcatagtacagagtatgaaaccataccaaagtgatattttgaaggagatacttttgggaaaatgtgattttaacatcaattagaaaaccacgttctcctaaggcagtaattctcaatcccggcagtatgttacaatcagctaaggaagatttaaaaagattgaatgcaaatttctgagagaggaccaggctctagtgttttcttaaaaattcccagtcaattttaatatgcagccgggattgaaaaccactgcccctatggaatcaaaaccctgttgttatgtaagagtcaatccactgagagctatttgttgctgttaacttcattgtgtacctcttctaggtctttttgccattcctccaggacatccaccataaggaaaggagaccctggaccaacattctctaagatgtttatatggaccagtggccggacctcttcatcttatagacatgatgaaaaaaggtaaatgcactgggattctgggcacttttcagaagcatttaacctgactctccaaagaggatactgacaggaaagtagtaggcaactgagccttatgctttgcaatgtggggacagactctacagtacaggagtagggtttcagacactttggccttccttctccttgcactttacatgttcgctttcagcacatagctttgcaaaagttgttccctgtcagaaattcccatgtcacaagctctttgcttagctaactccagctctgctttcagatatcaataagaaccaccactcccatcatcttctttaaccaaacagactatgttgttgaatttccagcacctagcactgtacctggcacatggcgctcaataaatactgagcaccaaatgtattaataataatttattaactgaattaattttattaacaacaaaaaataataaaaatataatataattaataaaataataaatactgagaactactggcaattcagtttcttcttctgaagtgatgaaaactgcatttctgggcactggacatatggcagggaaggaaaacagaaagtatgagaggaggaaaagaggacatacaaatccattgagcccttaaaatccttggaagaatagcctgggaggaagggaaaaatgagggaataagaagaaagataaagggcaaaggcagcattaatgaaagacaagatgacctttgtgcaactcaatccagtcctctcacttgggtttagggagtaaatgtattcataaaattctctagtcatttttaaatatttagtcttcctctttctcattgaccttgcactattatctgggttaagtgaagctaaattttaagtataattgcctttaccagcatattgcaatgtaagcaagttgcgcatcaggcagaatctgatagaagtcaggattgatttggttgaaggaaatttgtgaaaaaataataataaaataaaaattaaaaactacaattgataaatggtgctgggcacaaggagaagaacctgaaggaggtttgcctgaatactgttttcagagctgatacttttattttccttctaaaacctgaattgcctcacagataaaaattcttttaaaaatttcaaaagcaaagttgttcttcacaataattatatattatagcaaaaattgggaagcaacttgaaaattcacaatagaaaatgtgctaaataaatcactgaatgtaatataccacttagcactttaaaatgctttgacacaatattaactgaaaaaagcaagttgaaaatttgcatgcaaactacgattgcagccacaaaaaatatatataggcaaaagtctggaagaaatagcatggtttttactgctctgctttccaaatgctttgtaacatattgttaccttaattatggaaaaaataattatatgatatttaagtaaaattatagcccagaaggcaaataatgttgccttgtcagcatttaaaaaacaagtcccagtgctcatcatgacaccaagcagattaactgaaaatttactttacttgatcatctctaggttttcactgctttttctcaaggcttaatcaaattatttttcatttgctttcaagttgaatcatctttcagcaagatcttttctgtaacactataaaatttcatatgtcatttcaaattctatatttgaaagtgcagaaagacagaggtttggtcctgcaactttcatgccaggaccaaatccaagagttttgttgccctacaggaatattgtaactgtcaacagccagctgtcctgaaattctgaaggctttattagagcaagcgaagtgtaatatatttctttcaccttctatttactctcagcaaataatttaatatattttgctactttttatgaacaaaggaattaacatttaagaagcaattactgtgtactgtaggttttaattgtgttctcttaagatagatattattatgctggcttcacagatgaggaaactgaggctttttaaataactgagtgattttcaataacttccaaaggcccaacaactagccagtgatggaatcaggatttgaacccagctgatgctctctccctgtaccccagtacctgcccaggctcttgtcaaacttgaaatatttggagtgatagtgaacagccaagcccacaaggggaaaagtatgttaaaatagagttggatattgcatatcaaagaagataataaacatgtgactgacgtattggtaatatttgtggagtttgaaaggtgtgaacaattagcttagtattctgcatcagtaagattctatgaaactgaaattactgttttaattttttatttttaaagtatgatttcagaactatgggatttataataattaaaatattgactatgaagaaatcatttttcagctttatttatgggatggggatgcaaaagcttattaaataagtctgcatggccaaaaaatacaagcaatagaatctgccattaagcaatagaatctgccattccttagtttaatgttggaagttaatttgtctgtgcttttttttgaccacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctcgtgatccgcccacctcagcctcccaagtgctggggattacaggcgtgggccaccacacccggcccgatccctaaatttcaagcagcaaacaaacagaataattaatttagaaattaaagaagagagaggtttttaagctaagggcattacagactgtttatcaaatattctttaaattgtttttttaaatattgaagtgatacaaatgaatatttattacatatgttaatatacaaagtgatattataaacatccaggtacccatcattcagtttaaaaaacaaaacaatcagaatttttgaagcccttgaggatgctttcccaatactattctactccccatcaatcaatatcaatcaatatcctgaattttgggcatatcattccccgattttttttcatgagtttatcacatttggatctttaaacaatatattgtttccatccaaatgtttggagacttcatgtaaatggaatcatgccatatttattctgcaacttgtttttttcaccaaacattatgttgttatgatttaccaatgctggcgtgagtcgctgcagttcattttatctgctatgtagtctcccactacatgaacatactaccatttattcatccagtctactgctgagcaacatttgcattatttccagttcttttgtcattgccaacaatgatgctattcttctacatgtctctttgtgcacatgtatgaacatttcttaagatttatacctaacatgggaatggttggttcaaaagtacacgcagctttaattttaccaagtaatgccatggttttccaaaggagccatacatgagattcccattgctcaacagccttgtttagagttttcggatttctaattttcagtaatcaagagggtattattattttaattttcatttctcagattattaatgagattgagtatatttccttagtcgttttttctgagttgactgtttaaatatttgccccaattaggtcaaatacttgactgtttaaataatttgcaattatttcattagatttatatttaagtaacattttgcagcaattataatcatacctcttaccatttttctactggattgtttgtcttttacttgacttgcaggaattctttataaaagtccatattaattatttatctgctatatgtatgtaaatagcttctcccagtttgtggtttggcttttcactttctttttcatgtcttttgataaatatattaatatgttcttaatttttttattattatacttttaagttttagggtacatgtgcacaacgtgcaggtttgttacatatgtatacaggtgccatgatggtgtgctgcacccattaactcgtcatttagcattaggtatatctcctaatgctatccctcccccctccccccaccccacaacagtccctggtgtgtgatgttccccttcctgtgtccatgtgttctcattgttcaattcccacctatgagtgagaacatgcggtgtttggtaattttaatatattctaaattaacaatttttggaacactttgaaatcccgtcctactccagtttcaaatagacatcctcctgcacagttttctaaatttcatgtagcattatctttcacaattacgtatttaatcatctggaactgatacccaatatccagtttttatatggataaccaattgccccagcatcatttattggagagtttctcctttccccattgatctaaaaatcacttgtcatatattacatttccatatatacatggatatgtttttgaatctctattctgttctagcggccagttttgtccacctcagacaaacacctcacaacagtttacaaattttagcattatgcctgtaatacatcttgatatttgataggaccagtcacccatcttgttattttgtagtcagaagtgtatttactattcttagccacttgcacttccaagtaagttttaaaatcaggttggcaagtcacacctatcgcacttcccaaaaaaaactctagggatttttattagaattttataaaatttattaattaatttgtgataaatttacatctttatgtcaccaagtctttctctgaatgaatacgattaacctctacattggtttgtcttccctagtatctcctaataaagttttgcatttaaaaaaagtgtacatcatttattagatttattcctaagtactacctttgtattgaaatggcattgaatttattgactaactgaattgttttaaatattgagtctccacatcccggaatataattccttatttattcatgaattatatcatgaattatcatgattgcagtatcaatcatgatatcattttgcaattatttcattagatttatatttaagcaacattttgtggcaattataatcatacctcttatgttatatatgtgtttttactgctgatgtgtagaaatgctactgcttttgtagttactgatttttttctatcaatcaaccttgtagaactcagtatgcttttaaatagttgctgatagatttgttttgatttccctatttgtattttctacaaataacaatgtttctttgtttccaatccttacggttttttctcatgtgttacactcttactctattggcaggaactttcaggataatattgtagagcaaatcaattatgattactaatatatttgggctgccttttccaaactcaagttactttttaactcatcatttgtttgtgtaattttggtctgtttaattcagccaaactaattaagtctttaaaattgtattctattttctcccatttggaaatttggatatttcatttatgtttttagataattacattttcatatgtgtgcatgaattgaccaatatgaagataattaatgctttcattatcctgccaaaaaagaaacttgaacgacccctactctcataacttcactacgttgttgttgttgttgttgttgttgttgttgttgttgttgctgctgctgttgtttttctaatcgtagactcaggaggtacatgtgcaagatttgttatatgggcatattgagtaatactgaagtttgggcctctattgaacccatcaaccaaatagtgaaactagtacccaataggtagtttttcaactcttttttcctccctccctgcccccttttggagtccccagtgtctactgtttccagttttatgtccacatgtacccattgtttaactcccatgtgttaagtgagaacatgcagtatttggttttcggtttctgcgttaattcacttagggtaacagcctcccgctgcaaatgacatgatttcattcttttttatggctgtgcaatatttgatggtgtatatgtaccacatttgatgaacacttaggttgattctatgactttactattatgaatagtgctttgataaacatatgagtgcagatattctttgatagaatgatttcttttcctttgggtagatacccactccagtaatggtatcaattatggttgctgggtcaaatggtagttccattttcagtaatttgagaaatctccacactgcttttcatagaggttgaactaagttacatttccaccaatagtgcctaagtgttcccttttcctctcagcctcaccaagatttgttatttttggctttttaataatagccatcctgcatggtctcattgtggtcttaatttgcatttctctaatgattagtaatgttgagtactttttcatgtttattggcttgcatatatgtgtcttttttttgagaagtgtctgttcacgtcctttgtccacttttcaatgggttatttgttttctccttgttgatttgtttaacttcctgatagattctggatattagtcctttgtcaggtgcagagcttgcaaatattttctcccattctgtaggtagtctgtttactctgttaattatttattttgctgtgcagaagctctttagtttaattaagtcccatttgtcaatttttggttttgttccatttacttttgagcactgtctttttttgtaatgtttaaattacaccatttttgctaatatataaaaaggcaattgactattgcatatcactttggtttcagcaactatactagtttttgtttgttttttgttttgttttgttttttgcaaaagggtctcgctctgtcacactggctggagtacagtagcacaatcgtgattcactgcagccttgaaatcctgggctcaagcaatcctcccacctcggccccccatgcagctgaaactacaggcatgcaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttcagtaaactggctttttgggaattagccattgagaaactgatcctttagcaagttggcccttggcgtatcagtttgcttctcctgtacacacctatctaatcagtctcattgccatacactgcaatgactgacatctcactcagctcccttgggactctaagtcttatttatttggtatcgccagaacttagcacattgtgtttcatctgatgaagacttagaaatgttgactaatgaataagcaaattaattcataagtggcctttatgctgccttaacctgaatacttttctccttctctttataggatagctaccaagggaatctgaatttaaatgggtgtgacagccaaggaggaaaaactttctttcacattttgctctttatatccatatttgtatgtgcatggcctcaaaaataatttgtttatgaattatgggctgacccccaatatcaaacttcaagaaactacataaaaggagctcaaaataaaattttactaggttgactaatgcttggcgtaaaattgattgaagccttactaaacaattgaaaatattttgtttacaagatatttatcacaaacacttttgttatacttggatttgccctgtagatttattaataacttctattctccaaaggctttgaacagaatgttccctatatatagtaaagactgcacatatctactatttgttattgtcaacatgtggttcaccctgaagccaagactatctcaacagaccttaaatatggtgctttgccaggacacaccaaggctagatcagcttcaaacttataaagtcaaattcctgctctacacccactgttgggcagcacacttagtcaaaactgaatttgtagtcataccccagactcattcttcctcctgagctctccacatcagtgaattgtccctcattccattattcttagcactaccacccccaccctcaattcctctcaggtagattcataaagaatagacagaaagaaccaaaaggtgataagctatcagccttgttaatacttacatggtaactcacacattacaaggcttcctagtatggaagaggatacatagggctgtggcccaaaatatggcatcatgctccttccaactagcactgaagacaacatggtgtagaaggggccaactaatgcaccctgtctcaggctgtgaacaccctctttcccaactgagacttactacctttactacttggacatgcaaaaaaccaaagcctgaacaaaagcaagtccaaatgataattttttttttacaaaaattatgccacacataagcaatgacccaaaaaacagaggtggccctctgactggcctatctcaccattgagattagtcactcctctgcctgtgcttaggacactaaacttgtgtgtactataaatgtacaatcactttcttcctctttagcaaggtcagcagaagtcacctctttggatcctggaagagtagggaaatacggaagcaagaatctcaccttaccactctccatgatttctccagtcatccacatcaagtactagagcataaatctaaactatatcctttttcttacttcctcatcatcccctgtattctatcagccaccaaatcctgaagttctgtctcatagatatttctccatgtatcgtttcttctttatacatcctaccttgatcctagatccagccctcactgtcctttgccaacactacagtaacaatccccccattcctctctctgatttaagccttatcctgtttcttaaactctgcacagaagccagagtgatcattttgaaactcaatcgtgtcaccctctgacagattcctattcactacagaataaaggccaagctctttagaatgacttacaaaacccttcatggcctacctacctttgcaaactcatctgcctctttttccctgtcccataggcatctcagtaatattaaaacagttgtagtttctgatattcaccatgcaattgcaagtctccatccctttgttcatgtgagtctttctgtctaaaatacctttgactctttgtctcatttggttaactctgattcaatcttgaagattttgtttaaggtgtttctccttcaggaacctttccctaaattcaaccctggctctctgtcctgctccctcaagctggggtatccttccctcttctctattcccataacactctgtgaattgctccatcattaagtttttcaccccacgctgatatttatatacatgtctgttttcctttggggcaggggccatatccccaataacaagagattaccagcattcaggagaagtgtgtgaacctaaactgaactctttgctcttccaaatcatttattcatttcttttattttccattaattctataatcatttactaatgaattccatgggtatggcccactccactcacccactttcattttgctgggtagtatcctgatttctcagatatttttgggctgtatgaaaatcattcacttttcccctctctatacattccagagcatatcaaaaacatttgttaaccactttcaaattgtgatttgtttttgaattacacgtttgaatcatttttatatgcttcttgttctgatgacactgattacacttcttctcttttatgggtataggctgacataagtgatgctgtgtgacagtctaataccctggaattgtgagattatgctccctccttgctgtcttctatctgcaggaaattcagatctctatggcagccatcagagttaaatacatgttgataaataatataagtgaagtaacagcagattattattttacagcaggtctttgaagctactcagactcagcctgtctcttcctgattcagaaaagctttcagcccactggctttagctgctaacggacactgattttttaaaatttgagttcctaaagggtgaagttttaaaagctttgatgtaaatcctagaatttccaaacaaaatctcaaaaaagaatgaagaaacacagagggtgggtggttgccagtctgtggaagtcaaaaacagggcaggccagctaatccagaggcattgggattgggagctggggaacaatgaaagatatgggctctccaggcctctggcaatgaccatgagcagccaagagcaagtgagagtgggaagaagccaggaaagacaaggccgtgaaatgatgataaacaaaggcctgtatttagctctgactctcctactacaatgggctcacttctcaaggaaagagtaagatttatacaaaccacctcaaaaagagaactttaaaataataataagaagaagctaatcagttaattttgcacaaccaatacttagattaataaatactcggccctacaacctcatggaaatatattaagtacatacacactccatcacctctataaggaatcaaaatgtttagcaaccagcccagaagggatcagccaatcagaacagatactggccataaacaccagtcaggccatcctggagcacaaagctaaatataagccctgaataaacacacaactgcgcaaacaacaggcatatcttccctcccccgcaaagttccactttagagtcaactctggttcctctcccaagcaacaagagcgattagccataaaaatttgaatgaaaaatctgaagttattcttgtgcatattggctttttgcctgaagctaaaaaaaaatgacttcagtttctttttccattttcagcattttatttgtcctccttgctgtttctaggctctaaaggccagcgattttcccatttccactgccctgcaatccaaagctcccttctcaaaatagacattgaaaaatcatgagctgtttcttggtcacaggccttgcaggaattcctgagcattgccttcctactcaagcttctcatcatctccccaagcacccagcacttccgcatttcttttctaccttctcctccagacctggtttcaaatccaatcctccatccccaagctttatacactactcattttcttgccattttgtccattaaaaattctctggagaatagtagcaattttaggatgttctgatgtccgtgtcattgagctgtagctccccaccccatttttgaatgggagcatttattactaatctcttgtcactcattgtcttttttttttcgagatggagactcgctctttcacccaggctggagtgcagtggcatgatcttggctcactgcaagctccgcctcccaggttcacgccattctcttgcctcagcctcccgagtagctgggactacaggcgcccgccaccacgcccggctaattttttgtattttttttttttagtagagacggggtttcaccatgttagccaggatgatctcaatcgtctgatcttgtgatccgcccgcctcggcctccgaaagtgctgggattacaggcatgagccaccacacccggccaaatctcatgtcagtcattctcttaaataatttgcgtgtatcatgtcacttagccattaaaatgcatttaaacattattttcactttgcaggcgactggggatcagaaagactaaggcacttgttattgatcacacagctaacaagcagtgaaatcagtctgaactcaggagacagttgatttcaatttcttgttctttcttaccctacattgctgctctaaaataaaaaacaaaaatactaataaaattgtccaaagttatagggcctgggctcgatttgaatgacacttttctaactcaatcgaaagttttcacatataagaatagctgggtcaccactctacatcttcacactgcttatcaatctcaagccaacaaagccctaagcagctctcagcttgagaaaaatgttaaccaaaataacttctacctatcactactgaagaaaaatgaaagattaatttgatatattcctagtatatgttgccatttatttgaatcaatgctccattaggtattccaaaattatctaaaaatcaataatgatcagatttgggttaaatggtaaagtcaacaaacccaaagcattattttgagggttgaggggattggtttctttctttagaattagatagaaggaaaattaatttgcagttaagacattggccccagagtaaagaaggagggcttatttctgctcaggactggtacacatacaagcgtgcatgtgcttgtgagtgtgtgtacatgcatgtgtgtgcttgtgtgggaggtagtggacacacactgaggtccagctgcactgaagcaggtttggagggccctaggaaggcatgggcagaaactgacctgctctctaggggcatgctgattaactaaacttaatgtaagaccatattgtttttaacctcagaaatatttaccagaaaatcagggaccatgacctcctgggacaaaaggaaaacagtcacagcactgaaggcaggagaggaccgagctattctcctgggactggctatgatggtgtgctccatcatgatgtattttctgctgggaatcacactcctgcgctcatacatgcagaggtaataccactgggtgggtgggaccctgctgtttgtctcctgctccatcctcccccatcacttaggcaaccctaaggtcatcttcctcaccttctttcctgataagaactttgagaagttcctggtaaataatacttttcaataatgttatctaataataatgatacatatagctctacgtataatctggatagcaggtgtcaaagacttctacttctttaattatcacaattactctataaggtaagtataaatatactcactataaaaacggcaaaactgaggctcaagagagatatgatttccccagtgtcatacagctcttgcttgtggcagagctaagattcaagcccacatctcgcttattccaaagtcactgttcctgccacttcacacttctgtccgttccccaccctcctcccttttccaccccaaccaacccctccctcaccttccacgtgagtggttctcaactgtatattccaatttccccagaaactcttaaaaatgctaatgcccagcccccatcatcatcaacccagaaggtcagatttaattggtccggagtgggacccagtcaccagtatctattaaagctccccaggttgttctaatgggccttctaggctgagaaacactgctatgcatcaacttttaaaaataacagattttgaatcttttcatttcaatatttgctgtaggtgtattgaatggatagggaggcaaataaattgtgggacagcaagtgtactcctgtcctcagtaagccacgtagtaaatcccaccagcatctctagctaactgttgtccataaattggacactctaaacataggcgagcccagccctgatgtatcgaatgaagtctcacagcagttcagcttaaagaaacaagaccttttcaaatgaaaaattgaggtttcaatccaaaagaaaatgaaaccattttgtggcatttgtttctccatctaaattaatactttcattttagaagcaaaatctagctgaaatacagtaatttgctgaaattaaggcatcatctttcacatttgtggctgctctgctctgtttctatgacggccttcagctgtgctcattttctatgaaagtgctgatgcctcaggccccaagtggtcgttgattccaaaatgctttcagctcttcacatctggttagaaccatcagagactttttcctcagtatataagcaaaatgtgaccacccatgttccaggaaaatacagtttgccacaccaagggaggggatcaggtctagtatcctgcttctggaataaaacttcacacatgcaaaggggcaggaagctgtggatgcctgtccaacaaaaggaaagcgtattaatctgcaaagaaaacatgttttcccattgctatggtgatcagcttatacccaaaaccaaaccatcaattgctggtgtgttaattcctaattacaaatgttaatcttgataataaaattaaaggtatttttaaatgaccagttgaccaatgggcagctggaatccttccaggtgagaggtaacagggcacccttattcatccattagtctgcataaaagggtttcttttccattgtgtttgtggggagacagcaaaacacaatagaatgagcctgggccttagagaattacaagattggatcacaatttccaacacttactgcccatatgtccttgcatatgtcataggatttctcagttcactcacttttaagaagaaattactacccaacttgcacagctgttgagagaacaaaagaaggtaatgtatgtaaattaccaattagggtgaaaggaatgtgcagtaagtgattgctcatgacataatgaaagggttgagttatcttttttcccttattagaaagaccttaaggcattctgtcactgtccttccatctctgtcaagctggaccacatgaccctccactcctttgccatctctcccctccttctccctcacaccttctgtgcctacaaactgggctggggagggagctgggatgcagaaagtacaaagtaaaacatacagaggtaggggctggagcacgtcaagaagctgcctacaatgtagaaatacagggtgaggacaggtgatgattttaaaatatgcctcatgttaccagtgagttccataagggaaaaaagaacttaagtcaagcactggagaataccatatccaatggaagtcattgaaaacgttctcacgtgtccaagtttgtctatgttatacggtagtttgcttaaagctgttctattcgaaggcctaaactttacacagatagatcatattagagatttagaaaagatttttcagcttcaggagatgagaaataattccctcggactatacctttctcactattagctcttgggcctgtgtttactctcactcctttctctgcagcgtgtggaccgaagagtctcaatgcaccttgctgaatgcgtccatcacggaaacatttaactgctccttcagctgtggtccagactgctggaaactttctcagtacccctgcctccaggtgtacgttaacctgacttcttccggggaaaagctcctcctctaccacacagaagagacaataaaaatcaatcagaaggtaggaacttggcgtactgcatttcagttaccccacagagcttcacaccaggctctctgcctctgaagttcccctttgccagcatttcaaaggaaaatacttccaggaagcagagcctgcctcttccattcagagaacttgctatgtgactcttgcctagaaaatatttattttctgtgcaagttgtggacaaatcattcctacatttgtggtagtgcagatttagctttcacttccatttgaaagggtaaatattaatatatctttacacaaatagactgagtctttcaaagcaagtatgcaacttagagatgtacaagacaaaatcatgtgtttgtcctgtacctgggaaccatcaggtaaaggtgtattctgtttgtccatggtcaatgtcatttagttctgtgacctcagggatataacaacctttctgatcctcagcttccttttctctaaaaagtaacaaatggccaccttgcaaggtccttatgaagatgagtcctgagcatgtacaatgttaagcagagcatgctactttcaacccatggtcactgtgagtgtgtgtgtgtgtgtgtgtgtgtgtgtgtgtgttcttcacatatgttatattcatagaggctgaattttccagtccactaagatattcaagtccacatggtagatattcaacgaatgtgtattttattaaagctttacataaaatttacatttataaggtctgggatgaccaggaaggtgtcagcagaaccaacttgccattacaattttaagttaaatatattgagttttggatttgtggtaacaattcgatatgcagaataatctcatatgccaagacaactcgatgccactcttggctcttattaccaggataaacccttctgacctctaatctttcttgtaaaagcttttcttttcattaagttgtcagcacttaaatgatataacttatagttattgaaaaaaatgcagtagattcaaggttcaatactagcacatagagagtgaatgggatttgtttctgataaacccaccttgaacttttgttacaataacttaaaggaattcttgcaaatatctctgaggactcaacataataaatatttcagagaatgttgtttgaaaatgctggctctgattttctttcatttgtagtagccacaaataataccagtcccagcgctgtgctgcagtatgtaaagcctagctctctcacaaagtgcttgtctttcaagatcttcccttaagtcagatcttaaaatcaaagctgaccagtaatgacaaatgcctataaaactcttaaacctgaataggcatcaaaaagtgggacatattttcatttcctcattttgacaatttatcactacagccctgtgaatgcattatttaggctataaacggagagggaagctaccaataaatgtcccagatatgtattcaggactggtaccttatttgctctcagcataatactaggtcatcatttgttttattggccccactatcttgttttttaaagtaaattataacatacagaactgtgcatgaaatgaaaaagtacagctcaagtatgacaaacagattcgtaaccaccgtgtaaccaccttaagggtaaagaaatacaacattttctgtaacccaaaaacaccctacatgccccctctcaataactacaggctctgcctccaccaaagacaactatcctgactgtttatggcaattattttcttacttttctttgtacttttatcacctaaggatatatccttaaacatacatattttgttaatagttttgcctcatttttaagcattatataaatggaatcacatagaatactttcctttctgtctggttttcttcacatagtgttatgtttgttagatttattccatttggttacagttcattcattttcattactgtatcatattccattgtatgagtatgtctgtttgtttactcattctactgctgatggacattttgaattgtctatagtttgggactactacaagtaattctaccatgaatattctcatatatgtctctggtgcacaagcacacacacttccatcgggtataaacctgggaatggaatatttaaatcatagagtatccatatcttaaagttaagtagataatgccaagtagttttccaaaatgtatatgcaaatatacattctcaccaaccctatgggtatgagagttcttactgctccaaatatttgccaacatttggtaatatctgtaattttaatttagctaatgtagtgatatttcctcatgattctgatgactaatgttatcaagtgccttttcatttatttattggccatttgggtatccattttgggcagtgtccgtgcaagttgtttgcccatttttctgtggaattgtttcttctttacattcaatataggaatcatttaaatatgaacctctgttggttatatgtgttgtaaatatcttctcgcattatgtggccttttcactctctgaatgtctttcagtggaagaaacttctaatttcagtgtaaccagattttgtcaatctttttctttctgttcagtgcttttgctgttctgtttaagtcttatgtccaccctaatatcataaagtcattctcctaaatgtcattctaggtgtactattgttttccctttcatgtatacagtaaaatctgactggaattaatttttatatatggatcaagtttcttttttgtttgtttgttttttcatatggacacccacgtgctccagtccatttttgaagagatcacacttttcctcattgaattatttttagaatctcatttcttcctctgttttatcagaagttatctattctgttactattctttttaaagtcagaaaataacagataatggtgaggttgcaaagaaaaaggaacgcctatccacttttggtgggaaagtaaactggttcagccattgtgttcagagaacacaaagcagaactatcattcatcccagcaatcccagtattgggtatataccctgaacaatacaaattgttctgccacaaagacacatgtacatgtatgttcatggcagcagttctcacaatagcaaagatatggaatcaacctaaatgcccatcaacagtggacaggataaagaaaatgtggtacatatacaccatggaataatactacacagtcatgaaaaagaatgagatcatgtcctttgcagcaaccatggatggagctggaggtcatcatgctaagtaaactaacacaggaacagaaaaccaaataccacatattctcacttaaaagtggtagctaaacattgagtacacatggacataatgaatgaaaaagcacacaccaaagcctgcttgagtgtggagggaggaaggagggtgagaatttaaaactacatagggtactatgcttattacctgggtggtgaaataaactgtacaccacgcccctgtgacatgcaatttacctatgtaacaaacctgcacctaaacctaaaataaaacttcacaacttgcaatcttgactaatcaaagacattgaaacattttaactccacttttttattcttttcccaacttatatattatcatttttatgttatgtatacttgaagctcatgtagacattactattgttgttgtatatagtcaatgttaatttacatggatccacatttttccatttttattattcgtattcctttatctctgttcttctatctaggatcatctttactagtatttattttagtgcaatgacacccctaaaaaatgttctcatttttcatttgtctgaaagcatttttcattttattttgcttctggaaggacacattcactgagtataaaattctaagttggctattttttttccattgtcttctggtgagcattgttactattcagaaatcagccctcagtctaactgctgcttctttgaaggtaatcttggccattcaggatcacctcattctgacttcataaactgtgatattcaaatctgaactgaagtccctatgaggacctatctatttcaggctgactattctcccaggatgcagcccttcagaatcccaacccaaagtgaataggggaattatcaagaccccagcttgataggcccacaatcataattcctgctcatagctctgcaaggctgtcaaaaatgccagttagcctcctgggctctcacccctcttccacaatcagcaaatgctcccagggaaaaaaggcaccaaacatttggctcactttcctggcccagtgattctttactttctagaaagctagcctctgcttttaatctgaaatatacacactgaaaatacacaattatctccatgtcaaaaggtcattaaaccatcttcatgcaaaatgaggaatattcaagataattctggcaaaaacataaacaattttcaacgtcaactcccctttcctgttatccttcccaagnnnnnnnnnnnnnnnnnnnntattatgtgccaatacatgcaattatttttatttagcctacttagcattagcatttcccagggcttctttccctgctccttaatattctttgtcaattttagaaaattctgtcattatctcatcaacattgtctgtagtcattctctgcctcttcacctctgggactccagttggccacatacgaggttttctcattgtatcccctacatgtcttatgctcccttttgtttttctccctccttttgtctctctttacttctttctggatacattcctatcttctaattcagcaattctttcctctgctctgcagatcaactgttaaacccatccattgagtccttaatttctcttactgtattttcaattctagaatatccaactgagtcttgttttatcatttctagttctctgcaatattttaattattgtcttttaaatctttcaacataaaaagtaaaattatagtcattataaagtctattttgatatcttcactatttgaagcccatatatacctgttctgtttttgttttctgcttgtttgctttcatgttgtcttataatatctggctatgttttattaggtttctgatattatatttgcaaaatttttataaaaaataacttcaatactaggataatgttacaatgtcatcttttccaaaaattatttccacttacttctgccaggtacaagccattcaggatcacctcattctgacttcataaactgtgatattcaaatctgaactgaagtccctatgaggacctatctatttcaggctgactattctcccaggatgcagcccttcagaatcccaacccaaagtgaataggggaattatcaagaccccagcttgataggcccacaatcataattcctgctcatagctctgcaggctgtcaaaaatgccagttagcctcctgggctctcacccctcttccacaatcagcaaatgctcccagggaaaaaaggcaccaaacatttggctcactttcctggcccagtgattctttactttctagaaagctagcctctgcttttaatctgaaatatacacactgaaaatacacaattatctccatgtcaaaaggtcattaaaccatcttcatgcaaaatgaggaatattcaagataattctggcaaaaacataaacaattttcaacgtcaactccccttcctgttatccttcccaagctcaccaaaaataatggtctccctcacagttaccaagaaatgggcatggttgtattgagatacatcaggcgctactgataataactgtcctaagacaataggaggcgaaaggatattagtcaatctgtctgcaacttggtagaaagcattttatttttacatttttaccctctctcacatagtttttctttagcctttaaacccagtgcccaacctcttgtcaacattatgaccgaagctgcttaagctgataaactgtcatgctctcctggagccactggctgactaatgggctctgggagctacaagagggctcaagggtccctgcctcccttggctacaaggctgtcactagcatcataaaaaacagcagctgagtattaattcactgtggttgttgcttttgaatacctcaatgcccatctccttcaggagtttaaaacctcttttactcaccaggaattcccaaaacatgcccctatgatttgaggttagattaaaaatgtagtttggtgcaaaaaaaggaagctatacccattttttggtatatggcataatactatatatctgttctgatgatgtagaaaaatccaaattcagtttctcctactatactctcacaacacactgctaactctgggtgtgtgtggggcttttccccacacataatgaaggtgagctcagaataataaaataattttcccagagttacacattcactaactaattatgtctgaattaaaatctaagtatttttacttcatcatgcttgctcttaaaagagtaaaacattagagcatccccttgagagaataaagacaagagttctgaaaaatccaaattctatgaattatttatccttctgatagatattttggtgaacaggtgagaatctacaccattccatcctattccaagaggcacttaggatcaagtaagaaacaatgagcaaggaatagaattatctgtgatccataggtaagattaggactgtatattcagcaccagtttatgtagagtggatattaaacagatagaagcttaccctgaaaggggctaaaaaaaaagtgggggcgtggaggaggggaatatgccctgaaatttggcatttgacatcccataattagcatcttaaatgtgagatatttcttagacatttgctgaaactgcctgtagaccatagattcagaaacactttgtgactgacaaagtttagtcactccttaccaaagttgaatctgggacagctgaagagggcacctttgtgtataagtaaaagaaagaatgtgccagaaaaaagctgatactgagcatcaagaagaaaagcgggggaaggaacctagtgcttttcaattgccaagacagagggccatggtgaagattcaaggtcagattagatatcagcctcactttaggactaattggatacatcagaatcctagggattccatggtttaagctctctggatattgtctaatcccaaagcgccgagaagattctatctccttagtcaatttcctaggtctttcaagtttcttctctactccaaatcaagcagaagtgccataatagatatgagatctgtgggcaaatacaggaaaggaaaatctctctgtagtgggacctttgtctcaatactgaaagaaacagtcatgcatagcagtgtgaattctgttttccttttcactactaaatacttggaacggtccacttgccaaaatcaagcagatactagaagttcaaactaaacaagtctaaggtaaatgttgtaggatccactttttaaaaaagtgacagtaaagagcatgaagtctcaaaaggagtgggaagaaatgaagtctcaatttactttctcgactcacctgtttatcactaatgttcaaaaaattcaaaagttcaaaatatatttgtgaatccaaggctaccagctggggaactatacattctttgaacatttgagctatgtcccattctcaagcatagaatgcaaagtctggtacattatatatgcttaataaatatgtgcacaatattcattgtttgggaacactagaaaaagttccattgactttggaactaataatatttatgtttcacatgagcaatgtttttttttccatttttggtttttgtttgtttgtttgtttgtttacttcatggacattgtagactaggacctggttactaaggagtttttacagtacatgtgtggcccacctctatgatggtacagtctttactgaaaggctttttagccacattctcaattcatttcatcacccatctgtgtttttttctgtttcgctatacattctatattgtttatgtttttgtcacctatatataacatgctacatggtatattggagccaacaaatatcgcatggattttatcaaatttctaaccccatttcaagaataagacaattccctctttataaaaaggcaaatgaagaacacacctttcccttgaagtgatctgagaaatggatagctcccttcctaccatcacaaggaaaaggaggctgacagtgaggttattcagccaaaaacactttcttactgcctcctcccttccccacatcttttatttttaagatgaaggcatgtcactcttcgcttcacacaagcctagtgaggcatgtctgaaaaaaagcccaacaggtaattctcaaaacttctgtccatcatgacaataaaaataactgttctgaaagattctggaagagaggctaaggaaaaaaaaatttagtcagttccccaaaaattggagagaagatgcaattgctggaccttcattgcccatgtaagggaaaggatgatcagaagacattgacaggacccaaggtttttcagctgggaaaggaaagagcgtgatcatgggtccatccctgtggttttcagtactaaagagaagtttctgtctgtcaagaatctaaggattgggaaaagcagtaagattttattaacaaaactcagtattaagagagatgtaagtctaaatcttccactgaatggctgcttcagaggtttgatagatttatatagtcacatgttaaagcacaaaagaaagaatgacctatagccatggtaaaatattaacatattttttatcagtactaaaatatattgtatatataaaattattactcatatattctttctgttaaatatcatacagattctaaaagctaaatcttccctttcccacacctcccaccaaaaaagagagatctaaaaatgatggatgtttattttttctatctaaattacattttccaactaagtgtatatctcacttagtaaagttttgtttattgaaatgcattctatgtattcaaaaccaaagacataaaaataccctctgaacacatgataaaatcataagataactaaatcttcactctaaattcacacctgcctaagaaacatactcatggctatcatttgagccacagaaacaaaaacctaggctcctagtgtagaattcagcacaatgcaaatctcctaagacaaaaaggcaagggacatgagatgacagccattaaacaggactgcttctgtgaaaaccatgcagctagtaattttctcatcttagagatttcatagtttattatgtgatgcttgattgacgacttttagatgatcatgtggacaaatgtgaaattccaatagaaaaacatgttaatgaaaatttattgaggctttatgtatattcatcacttaatcctcacaaaaaaaaccctgccatgaaggctctattaaccccattatatagattcaaaaaaattgattctgagaggccacataacttgcctacagtcacacagtaaccagatctcctgagcacaagttaggagcttgttatactactcatatattcatgatcaccaaaggacttatcaataataaaagtacatgactgattgacaaatagtagaattttcattttcagggacagttaatggtctagtgacagctggtttatatgtatgttgaaaaatgacaagatgagaaagagctaaaaacaccagggcagaggaccttttctccactggtatctgtctgttgctcatatgtgtaccattggccctgaggtcccacaatcaatcaagtatggaccatgcctcatccatccagcccacatgcatgcaatgaaagcccaatggctttcaactttaattaccagctcctgtattacagttctgccagatgttctcagtggtcgtttatatgaagaatcttacctagtgacagaattattgccatttttctgacaaatgtttctttaaaaatctatatttttaagctgaatcaattcacaaaagcataagaaaaggaaaaacttcactttcaatggaatgccatttttactgagatcatttcaataacttagcactgttcaccactgaaattgctactataaactatcttggcacaaaaatatacagatacctgaagcattcataatctaaattggcttggtttaaattcaaccagaaatggtttgtctgttattttttaaatgctttggttcaaaaaacatctctaaaaatgttaaagaaatgatcagggcatctttgaagatgtccatttttgaaggacaaaaataaaggtattcccacactgccttacacccttttgatccagaggcatctaactggtaggaaatttgcttcatggcagtcaaagtccagttttcatactaaattataactgattgaaaaattctgctttcttggtgataactttcacccccttaatgccttgctagtaccaggggattctctgctctactcacctatacaaatgtattcacatttattcttagctggttaaattttaaggtgtcaaccagaccttgctacaagaacagcacattaaacgtggtttacgataaatgccagcatgctcatcctccattcttaactaatcaaagaaacttcctgctgtttatagtcaaataattcaatgactacagctcagccaaaaaaaaaaaaagcaaggtgcctgtgtgcccactgataaagtcatgggaaagagtaattcaaatatatttcattagccaaaactctttgttttttaaatactttgttcctgggaaatctactggtctaaatttttctgaaatttcaggcttctaccccaaaacctatatcaatgtacctcaaagttcacccgcttccttatctgtgtctctgcatatagtcatggaggttgtgcattgcacagaggtaccaatcacattgtaaaagtcatatatgtgaatatttatagttacaatgcaaaaattggtaaatgacagtaagacgtgagttttataaaaaaaataagtttattaggataattttccaactgaaaattataatgttttgaagaaggagcacagtgtttcaactcacactaaaacactgtatagataagcagtgattctgtcagaaaccaatttaattctgataaatcagataagttaatcatttgattacataaggggcaggacagtaaaaagtctattgagaggttcttaccaatagagaagagagttaaccaaaaacccaaacatctcccagaaaagtgatttaaatcacttttttccaaacttaaaaaaaaaaaaccctcattattatatcagttttgtcatggcacatttataaaccaaggaaaataagtcacagagatttcctcagagatagcttttttacttaaaaatgtgtccaactatatctaacataaaataaaaagaaaaactacaaaaaagtgatttaattccatctgtatctagataagaaagaggagaaagggaagtgtgaacaggaagaggaacagagagaaagatttaaagccaggtgggggttgagggaagggcaaggaaggaggagatacaaaagaaaacaaaatccaaagatacaagtgtgtattaatctgttttcacactgctagaaagaacaactgagactgggtaatttataaaagtaaaaggtttagttgactcatggttctgcatggctggggaggcatcaggaagcttacaatcatgatggaaggcaaaggggaagcaaggcatgtcttttcatactggcaggagagacagcatgagggccagggggctgccagacacttttaaaccatcacatctcatgagaactcactcattatcatgagaacagcatggggaagccacctccatgatccagtcacctcccaccaggtccttccctgacacgtggaaattacgatttgagatgagacttgggtggagacacagagccaaaccatatcattctgccccggctcttcccaaatctcatgtcctttatacatttcaaaaccaatcatgccttcccaacagtcccccaaagtcttaaatcattccagcattaactcaaaattccaagtccaaagtctcatctgagataaggtaaatcccttccgcctataagcctgtaaaatcaaaagcaagttagttacttccaagatacaatgggggtacaggcaatgggtaaacagacccattccaagtgggagaaattggctaaaacaaagggaccacaggccccatacaagtccaaaacctggacaggcagtcattaaatcttaaagttccaaaataatctcctttgactccatgtctcacattcggggcacactgatgcaagagatgggttcccaaggccttgggcagcttcaccctgtggtgtggttctgcaggatacagcccctgcagttgctttcccgggctggctctgagtgcctgcagcttttctaggcacacagtgcaagctgtcggtggatctatccttctggggtctgaaggacagcggccctcttctcacagctccactaggcagtgccccagtggggattctgtgtgggaactccaaccccatatttcccttctgcattgccctagcagaggttctccatgaggtctccacccctacatcagaattctgcctggacacccaggcatttctatctatcctctgaaatctaggtggaagttccaaaaccttaactcttttgcacacctgcagtcccaacaacacctggaagctgccaaggcttggggcttgcaccctctgaagcaatggcctgagctgtacattgaccccttatagccacagctggagcagctggaaaacagggcaccaagtctcaaggctgcacagagcagcagggccctaggccatttttccctccaatgcctccaggcctgtgatgggaagagctgctacaaaaatctctgacatacctagagacattttccccattgtgttggctattaacattcagctcctccttacttatgccaatttctgcaggaagcttgaatttctccccagaaaatgggtttttcttttctaccaacatggtcaggctgcacattttccaaatttttatgcttttaaacataagctccaatttcaaatcatctctttgtgaatgcatgtaactgcacatttcaagaaaagccaggtcacctcttgaatgctttgctggttagaaatttcttctgtcagatatcctaattcatttctctcaagttcaaagttccacatatttctatggcagggacaaaatgctgctaatctctttgctaaagcatggtaagtgcaacctttgctccagttcccagtaagttactcatctccatctgaaactacctcattccagacttctttctccatatcactatcatcattttgctcaaaaccattcaacaaatctctaggaagttccaaattatccttcatcttcctgtcctcttctgagtgctccaaactgttccaacttctgcctgttacccagttccaaagtggcttccacattttcaagttatctttatagcaattccccactggcctggtaccaattctctgtattagcctattttcacactgttataaagatactacctgagactgggtaatttataaatgaaaaaggtttaattaactcacagttccacatggatgggaaggcctcagggaacttacagtcatggcagaaaatgaaggagaagcaaggcacatcttctcatggtggcaagcaagagagagaacatgagagaagaactgtcaaacagttttaaaccatcaaatctcatgagaacttactcactgtcataagaaaagcatgggggaaactgcccccatgatccaatcacctcccaccaggtccctctcctgatacatggtattacaattcaagtgagatttgggtggagacacagagccaaaccatatcaaagtgtgtagaaatacagagcggagagacatgtaaaagaggtagccaaagaaaagagaggtgaaaagatcaaaagaaaggtagcataagttctcaggtgagtggtgattaaagaactgttttattcttccttggcttataggaaaagctgttttatttttccttggcttataggaaaagctactttggcacactaaatgggtctgacccactcatctcagctctttattcaatattcctacatattacagatttctttttcagtaattcaacagaagtgtagctgtttttttatgacagttgcaaagtaaccaaataaaatgaagccaagataaaaagataagagtatactactttccctgagagaactggtaagtttttatgttatgtggacagatgtggacagacaaaatgatggcagagttgacattctgattccataaagaagtatgttcaatagaaaataattaaaacctaccatacctagctatggcaaaaagaatcctgggaatcatttaatttattttacgcatgcaacatggaatgattaaatcaagctaattaacatatctatcattttatttcaatcaataaataatatatgggtgagcaatcaagggacatcttggtcagataccttaaaacattgttttaatcaatgtgttatttattagggtttccaaaggcaccagtttgaatatgaaaagaataaccaccatggttatttcacagatcactaatttggacacaatactccaccccctcctagagtctcaaacacacatagtatcttctagtaacagtttatcttattctccacagtgctcctatatacctaaatgtggaaaaaattttgaagaatccatgtccctggtgaatgttgtcatggaaaacttcaggaagtatcaacacttctcctgctattctgacccagaaggaaaccagaaagagtgttatcctaaccaaactctacagttcccaacgtgctgttccattcactcttctggccaacctgtatgatggctggggggtgtggcaattgttgccatggtgaaacttacacagtacctctccctactatgtgagaggatccaacgggatcaataggataaatgcaaaaatggataaaataatttttgttaaagctcaaatactgttttctttcattcttcaccaaagaaccttaagtttgtaacgtgcagtctgttatgagttccctaatatattcttatatgtagagcaataatgcaaaatctgttctatatgcaaacatgatgtctttattattcaggagaataaataactgttttgtgttggttggtggttttcataatcttatttctgtactggaactagtactttcttctctcattccgccaaaacagggctcagttattcatttgccaagcttcgtggaggaatgtaggtgacatcaatgtgataaagtctgtgttctgagttgtcagatctcttgaagacaatatttttcatcacttattgtttactaaagctacagccaaaaatatttttttttcttattctaaactgagccctatagcaagtgaagggaccagatttcctaattaaaggaagttaggtacttttcttgtattttttaccatatcactgtaaagaagaggggaaacccagccagctactttttttcatcactttttattcataacttcagatttgtaaaactaatttccaaaatataagctgttttcattagccagttctataatatcttcctgtgatttatgtagaaaatgaacacaccccttttccatttaagaccctgctactgtgtgaagagatgatacttacaaggagtgtcattacctgtgagctgactgaatgttggtaggtgctccattacaatccaggaaagtctgtgttactgatatttgtgtggaaatctttatttcacttcaatttaaccattagatggtaaaattaagatgctacttgttggtaaaaattggtggactggtttcaatgggtaaatgtgttgtggcaaattaatgtgttggaatattgctctttgtgaatttgtgcttaagtcaatgaatgtgtagtatctccttctgacaagcattccctattgggattttaaagctatgtgcacagaatattagtctcttctacatgttttatttttctatttataattcccttttttgttgttatattttatacacagaatagatcttttttctaacacatatttgaactgaataacagacttaaagaaagcctttgttcacattgctatttacttttgtgtttgggggaaaatacgagggattgattttaaataaaaaacattccatctttcatttaatatcaatatcaaaagaagaagacaaacatctatctttctcatctatatttaagtacctttttgtaatgtagtatcaaagttttttaggtaatgcaaaattttacaaatcatttgtggaatgaatggtaaaactaatctgatgaaatggaaaattattctgcaatattgtaattcatagtttgacttttcataagcaaataaatccctaggatgtaatcaggacttcaaatgtgtaattaaattttttttaaaaaaatctattaaattgcaagatttgaatacttcttgcattctgagctgacaagcccatggtagtccaaaaatttgtatttcaatacctttaaaaatattttgagtgattacaaagaaagtttctttttttaacacccaaacacatacacataatgctgtgaccatttgaaaaataggatgaaaaactcttttatttctactctactttaaaacatataattctgaagatactaaagaaatatttgagactatagagctgaaaatgtgcagtctttaatgttccttaggcttcccttcgagtgatccaagggtgaaatatatgtgagtgaaattatcagatgggttactttatttttacttaattctgaattttcattaaaaattcccaaataatgtttaagataacaatgtagaaatttttaaataatgacaccaaaaagagattaactgctgccttctagaatcccaacatagcaacagccccttcaagaaatttagatatatatacaattaatgctcattattaaaagagaaagatctgggactaataatgttttaaatgctttgcacatgttaactaatttcattatttaacaactctgttgggcgaggtattattattatctcatcctacagatgagaatgttgaagctcagagatgttaaataatttccccaaggctatgcacatactaagatggtgaagagctaaaaacacagt

SEQ ID NO: 12533 - DNA, 45275 bp, Human
  misc_feature (1)...(45275): n = A,T,C or G
agcccaggccggagtggccaagccacggcggggtcaggtcttggccaaggtcacactgtccagcccccgcacatcctcagtgagaacacagggtcccatccctgccccactccccaatcccgggagagtcccgggggaatgccagaggccaaggccaggtcgagacggcggggtgtcccccgtcagtgagaacacagggtcctgtgcctgccccactccccaagccggggagattcccgggggaaatgccagaggccaaggccaggtcgagacggcggggtgtcccccctcagtgagaacacagggtcccgtccctgccctgctccccaagccggggagattcccgggggaaatgccagaggccaaggccaggtcgagacggcggggtgtcccccctcagtgagaatacagggtcccgtccctgccctgctccccaagccggggagattcccgggggaaatgccagaggccaaggccaggtcaagacggcggggtgtcccccctcagtgccactaaggcagaacttggcccctggccactggctgctgggggacacaggctgggcagctaaggtggaggaaagggtacaggtgtgtcttctgtgggcacagatctcactcaggccagagaaggggctgtgccgtggggctgctggacacgtccgtttccacctgcggggtgggcaatgccggcacagcgagtggccagacacaggcatgcccagcagacacccaaccgctctccaccacctcaaccttctgtattttcctgaaagcatttaccactccttgaagttatagattaatttgtctctgcattttgttgtccaaaccaggagctcggtgagggtgtgatggggtctgccttggtcaccgtggcaccccagcaccccgcagggtccctctggccaaaagagatgttcactgatgccctagaagcaggaacagaggggctcccctgcgctcgccaagggcgcctgacaaatctggaggcccccatgacagaatcagctccagagtaggaaatgtgtctggctgcacgaaagccccctcgggcgcagcgcctccaggcccacgcagatgtcgctgtcatacattgttggaaacgcctctgctggaaacagtgtttgctgaatcttggagggagaggaaaaaacctagtaaacattcttgttgaggtgatctgggggaatgtctgcaaaggcttggagggctgatggggcagagctgcccaggggcccaggacaaaggccaggcgtgcgcgcgcacacacacacacacacacacacacacacgcagtggcctccctgggggccgtggctgggcgaggcctgctgttgtccgagatgctggaaggagctgtgtctctgggtctgtcccggccgcaccccgttctgtcccacacccaaccactccccacccacaggccggctccagcggccaggtggacgggtgcgcggcccgcgctgtgagcagggaaccatatccagctgaggttttgggtgtgtggggcgggtcgggaacaaggaggccgggttggggggctcagaccacacttggaccatgaaagtgaccacatgcaaatcacagaaacgggatgcagggatccacagacgtgctcctcttgggtccccgttacctcaccgccacccctgaaactgaagacccccaaacccactttaattcctggagacggcccctcgatccacccaaaaggctgccaccacctcgaacccacacccctgtcccggttccgccctgggtccagccacatctccccaaatgcattctctggctccggaaggggacccgggcgctcgcccccaactgccccccgcagcggccgggcccggcgcctgcccaccccgcgcgggacacggcctcgcccccgccactcccgcgccgcgccccgccccgcgccccgccccgcccgcggcccgcgggacctttatagggagcgccggccgcgcgctgggaagtcggtgccgctgccgtctctgcgttcgccatgcgtcccggggcgccagggccactctggcctctgccctggggggccctggcttgggccgtgggcttcgtgagctccatgggctcggggaaccccgcgcccggtgagtggggcggccagaggggcgggcggggcgggccacccacgtggggctgcgcggaatgcggccggggggacgtcggggggcgcggcggcggcggcgggggcgagggcggtgtccggcgcaagctggagccgggaaggtctgaaggagggtcaccaagaggtcagcagagcagaggtttctaatcacaatgaccgctgacatttattgagcgcttagtgtctacctctcccctccctgaacctgtgccatcccgatagtgccggagctctcttcatctccgtcttccagatggggaaactgaggctcagggtcacacagcctgtagcaggcaaagccagggttctagccgcgaccgtccgggtcggtcctggtgccgagaggtagtgctgggtgtcgggagccaggccctccagctggggctgagagctttcccgggtcctgggtagacggggcatggagtctcacacctgggacttgccgggaggtgccaggcaggagacggccccactcctggcctcagtttcccctcctatgatgggtgccaaggtgctgcgttccacaagctggtccctggcagtgtctgtgaaccagcaagcgctctgggatgggggctgtggccgttcctgcccccagggacgggggaagaaatggggggctctctggctccccaccccccatccctgcagccccaccccaccccagccctgcgccaaagggagagcagagccccctccccgaaggccacgtccctggggagacagtgagctcatgcaaggggaatgttcccaagttggagtgagtaagaggcgggccaggcggtgggggggctgccaggcgcggggctccgcgtgccctcgccctcgggtgctgtctagacagagggcagaggcgggagaagcggctccagggcctgctgaccctgacatgcccagtgcctggtgtttggtggtgtttgaggggttgggcagggtgccagcccctggcctgggggcttggagggtacgggaagggacctcctggggtgggtgggggttggtggtgaggctgtgggggggggcacgtggagctcagaggggaggagacatttccagggttctggagccagggtggggacacccatgtggttttctgccccttcttcctgggtgggggtagatcattccgtgcgtaactactcagcaccacctgcatgcatctgtgggcgggccagaagctgggtgtcaggagtggcccaggagagcaccccgttccccggcccgcaggtggtgtttgctggctccagcagggccaggaggccacctgcagcctggtgctccagactgatgtcacccgggccgagtgctgtgcctccggcaacattgacaccgcctggtccaacctcacccacccggggaacaagatcaacctcctcggcttcttgggccttgtccactgccttccctgcaaaggtgagacctcaggccagaagcagggcagacgtctcagctcaggaccagccacaaacagtcatggtggtcgagggccgaacgtccagggactgagcccgtcacaggggtatgtaggaggctgcagggggatcccagcctcagagagggactggggggacttcccggttcccaggctccagcctcttgcagctcaggactcaggaagagaccacgtggctccagcctttgctggggctgagctctctgcctgggtggctcttcccacctggtcgataaatgtctggcttgcacctagctcctgggaaggtgggtttgccattctggcctgtgaccccaaatgtccacaccagggaccttcactgcagactccagggtctgcggtggggttacagctgcatgtttaacaagcatttgcctcgggaccctgttttgagaggatgcctcccacatcagactaggggctcttggttggcgagtggcacagaacgaatgaataagattctccgcactggaggatgatggttttttttttttttttttttttttttcctgagatggagcctcgctctgtcacccaggctggagtgcagtggtgcgattttggctcactgcaacttcggcctccgaggttcaggtgattctctttcctcggcctccccaggggctgggactgcaggcgcgcgccaccacacctggctaatttttatgtttttggtagagacagggtttcaccacattggccaggctggtctcaaactcctgacctcaagtgatctgccagccttggcctcccaaagtgctgggattacaggcgtgagccaccatgcctggcctgttggggcacatcttgaaggaggtgggcattagagctggggtgttgggggatgtctaggagtttgccagatggggccggtatgggagagtggatcaggagagaacatggcttgaggttaggtcctggtgggtggggtcaggcagaggagccaaggggaggctgaagctgagggctgcagacccgaaggccaggctgaggaactctgctggcctctgagatgtgattaatcccagatcagcctggctgggtggtcctgaactcactgccacatacccctgctccctccagacccccctctggcttctgggagaaggacagtcttcaaaaagtgcctggcctgggcatgagacggcccaggaccccccacccccaacctcatctggccctggggacggaactcaggcccccttccgttctcgctcgcataaaagccaccctggccgagcatttccagatgtgcctgtgagccgctgtgccggggccgcccaggtgcggcccacatgccctgcaagggctgcgtggcgggcgctggccatcccctaaggagtgccgcactgccttggaagtggggctccctcgtcagccccactttacacacagagaaactgaggctggcacataaactcaacagctgtgttcagaggccctaccagacccccagataacagaaagggggttggtcatctgggtcctggctgcagctttcaaactgaggtgcttgggcccctgcactcatagctgcgacccggcctcagtttccccatctgtaaaatgatgacttgggaagatgcgataagcctaggaggcgatgagcattcacattgaaagcgggggcggggaccccagagagagcttccctagcaggacctcaatatccctgtctgagcagcggggctgcggggcagctcctggttcagaggcctagggctgtggggggccccctcccctggaatcgctccccaggccaggagggccgtccagcgccccgccctccccgacgcctcctgggggaaggtcctggcagccccagactcgcgcctggcaagggcggaacaccccaggctgacgcagctggggcccctccggccttcccagaagagcgcgtgcatcgggagcagacgtcagccagctgcaaggaggagcggcccggggctgcgtagctccgctggaccccgattccgggcagagacccccccccgccccggcccgcgcgcaccgagcccagcccccgccccccagcgcaggcgcagcgcggacctcggccccaccggtcccgcgcccggaccctgagccctgcccctgggaacccgagggccccgactccgactgaccctgacctgggacggcgcccccgcctccgccctgcagaaggggcgcagggaggggccccgaggccttcgcgcggccccacgcccgggaccctcccgcgcccggccccacgcgcgtgtcctctgtccgcagattcgtgcgacggcgtggagtgcggcccgggcaaggcgtgccgcatgctggggggccgcccgcgctgcgagtgcgcgcccgactgctcggggctcccggcgcggctgcaggtctgcggctcagacggcgccacctaccgcgacgagtgcgagctgcgcgccgcgcgctgccgcggccacccggacctgagcgtcatgtaccggggccgctgccgcagtacgtgggggcgtggtctgtggaggggcggggcgggacctaccggacctgcgcgtcatgtatcgaggctgctgccgcagtaggcgggggcggggcctggggcgggaccacccggacctgagcgtgacgtatcggggctgctaccgcaatgcgtgagggccaggcctgcgggggcggggcctgctggaggggcggggcctgctggaggggcggggccgctgccgcagtgcgtaggggcggggcctccagcccaggacaggtcacatgggtggcggtggggcctgagtaagggcgtctttatacttccgagggagtatcacggggtagggtcttttgtagggttgggatttggaaaatagtgggcctctgggggctcacactgggcaagaggtatgtggcatggtcagagcgggagcgtgactcagagaggggcttgtgggtgtaaccagaggggcatgatggaaccaggggggtgagactgggtcatgtaaggggcggggctcttggctggggcgtggttcctgggtggagatgggcggggatttgtgggtggagtttgggtgggcggccccgcagtcgcggaggggcggggctttgggtagcataaggggcaggagctcacgaaagaggtgtggctcctgggtacaatgggaagggcagggcttgtgggtggagcctgaggggtggaatggagaggggggctcacgggggggcgggggggtgcttgtgtctcctaccagagggttttcgcatcttgggggttaagggtgggtcttggggccaagagccctgcggggttctcagcgagatgtcccctgaacttcccctggcacccggcctgcagagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggtgcagacgcagggcgggggcacaggcctgtcctgggggccggagaaccccctgccctgcgccctcaatgctcttatcgacccttgcaggcacccctgaggagccgccaggtggtgagtctgcagaagaggaagagaacttcgtgtgagcctgcaggacaggcctgggcctggtgcccgaggccccccatcatcccctgttatttattgccacagcagagtctaatttatatgccacggacactccttagagcccggattcggaccacttggggatcccagaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctgggcattctctgctggtaattcctgaagaggcatgactgcttttctcagccccaagcctctagtctgggtgtgtacggagggtctagcctgggtgtgtacggagggtctagcctgggtgagtacggagggtctagcctgggtgagtacggagggtctagcctgggtgagtacggagagtctagcctgggtgtgtatggaggatctagcctgggtgagtatggagggtctagcctgggtgagtatggagggtctagcctgggtgtgtatggagggtctagcctgggtgagtatggagggtctagcctgggtgtgtatggagggtctagcctgggtgagtatggagggtctagcctgggtgtgtacggagggtctagtctgagtgcgtgtggggacctcagaacactgtgaccttagcccagcaagccaggcccttcatgaaggccaagaaggctgccaccattccctgccagcccaagaactccagcttccccactgcctctgtgtgcccctttgcgtcctgtgaaggccattgagaaatgcccagtgtgccccctgggaaagggcacggcctgtgctcctgacacgggctgtgcttggccacagaaccacccagcgtctcccctgctgctgtccacgtcagttcatgaggcaacgtcgcgtggtctcagacgtggagcagccagcggcagctcagagcagggcactgtgtccggcggagccaagtccactctgggggagctctggcggggaccacgggccactgctcacccactggccccgaggggggtgtagacgccaagactcacgcatgtgtgacatccggagtcctggagccgggtgtcccagtggcaccactaggtgcctgctgcctccacagtggggttcacacccagggctccttggtcccccacaacctgccccggccaggcctgcagacccagactccagccagacctgcctcacccaccaatgcagccggggctggcgacaccagccaggtgctggtcttgggccagttctcccacgacggctcaccctcccctccatctgcgttgatgctcagaatcgcctacctgtgcctgcgtgtaaaccacagcctcagaccagctatggggagaggacaacacggaggatatccagcttccccggtctggggtgaggagtgtggggagcttgggcatcctcctccagcctcctccagcccccaggcagtgccttacctgtggtgcccagaaaagtgcccctaggttggtgggtctacaggagcctcagccaggcagcccaccccaccctggggccctgcctcaccaaggaaataaagactcaaagaagccattttggggtgtccaggcctcagtttgtctcctctctcaaggcttcaggccgcccccacggctgtgggatgggcagcctggggcctggggtgccgcatgggtgctctggaggcacgggaagagagacccagcattagtccttgggcagcctctggccgcctctgggcctcagtgcctctccaggcagtggacaagcccgggaggggctgaggcagagcgggaggggagggagagaaaggaggtcttttgggagggcacacaggatagacaagatggcttagggcagccctaagacaccagctggcttgggacccagaaatggaggcccggccttgaatgacttgggtgtaacgatagcagtaataaaaataacaggattagggcccgggtggggtagctcacccctataatctcggcgctttgggaggccaaggcgggcgggtcacttgaggccaggagttccagaccagcctgggcaacatagtgagaccctcatctctacaaaaaaaaaaaaaaaaaaaaagacccaggcatggtggcatgctcctgtggtcccagctactcaggaggcggaggtgggaagatggcttgagcccaggatgtcaaggctgcagtgagctgtgttggcaccactgcactccagcctgggtgacagagtgagactgtttctaaaataataataatagcataattggccgggcgtggtggttcatgcctgtaatcccagcactttgggaggccgaggcaggtgaatcatgaggtcaggagttcgagaccgacctggccaacatggtgaaactccgatctcggtgagccgagatcgtgccactaaactccagcctgggggacagagcaagaccccatctcaaaaaaaaaaaaaaaaaaattagccaggtgtggtgtcatgcacctgtagtcccagctacttgggagggtgaggcaggagaatcgcttgaacctgggaggcagaggttgcagtgagccgagatcgcaccactggactccagcctgggtgacggagtgagactctgtctcaaaataataataataataataataataacaacaacaacaacaaaaaggcccagcgcggtggctcacccgcgcctgtaatcccagcactttaggaggccaaggctagcggatcacgaggtcaagagatcgagaccatcctggccaacatggtgaaaccccatctctactaaaaatacaaaaaattagccgggtgtggtggtacatgcctgtagtcccagctagttgggaggctgaggcaggagaatggcttgaacccaggggcagaggttgcaatgagccgagattgcgccactgcactccagcctggtgacagagtgagacgtcatcttaaaaaaaataataggccgggcgcggtggctcacgcctgtaatcccagcactctgggaagccgaggtgggtggatcacgagatcaggagatcgagaccatcctggctgacacggtgaaaccccgtttctactaaaaatacaaagaattagccgggtgtggtggcgggcgcctgtagtcccagctacttgggaggctgaagcgggagaatggtgtgaacccgggaggcggaacttgcagtgagccgagatcgcaccactgcactccagcctgggggacagagcgagactccatccaaaataaaaataagtaaagataaaaaaataaaataataataaagaaaataaaatctaaaaataaaaaaataataacacaataacaaactgtgacaataacatcacctgggacttgctgtgcaccccgcgctattctctggttttcagaggatgaccacgaggcttgatgtgtggccagaccctcttgggactcctcggcgcggccggtgcaagcccgccctggtgtccagcagcccccacgccctgcacagggagctcagggcttcctggcctccgtttcccagcggactcgcctgcggtgtggttaggcggctggagggaggtggaggaacggcattccaggtgggaggctgcaggagtgtgggttgcaggggcgcaggggtagacccagaggggttcacggtggggggcatgggaaggtggaaaggggctgtggaccgagccgcgacacgaatgctggtggaccctgcagctgaccgcccacgggtgaggctggaagtcagttaacattttactgggtttgcttctgccctttgcatgtggaatgggtgtgccccaccgctgcccgtcccaccccaaccctgaacatcaggcttcccgtggggcccagccacggaacattccaggcctggagcggccatctcatttgcatgccgcaaggttgtggctcaggcggcttctcctgggggcctggtggtcccaggcagggggccgggctggggactgctccgccgaaccacgtcccagatccaggccacaaaggcggacacctgcgtgtacacgtcgggggtcttggggtcgccgcaccagaggcccgagaaggaaacgaggccgtgagcccggttcctgcacaccaggggccctccggagtcggcctggagtgaaaggagaggtgaggtcagggcctctgggagctgctgcaggcacatctcaccacggccctccctgcctcagaaccctctgtggctccctactgctctccaaggaaaaagtaaattcatttctcccctccaggccctgaggacccagcccccacccacttctctgccctccccgctgagcctcctcagtgctccacggcctttgtatagcctggagacctgttcctgccctgtgctggatgctgcctgtgtaaacattcgagtctgcagtgttttgggcagtgcacaacctacacagctgtacgtggcagccctctactaacaggtctctctgccttgcgtgtgtttcctcagatcttctaaggattccttcaagtctcagctcaaaggtgctctccttggagagggctccccgaatactcaccctaaaatccctcatcctaccctcctgccatctagaatccgctctgataccatcaactggatactaatagtgtagcagttttacagatggagaaaaagaggcccagagaaatcaagtgacttttccaaggtcacgcatcgggaaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaggcgtgagccacggtgcccagcccccaacttaatattatgataataaattaataattatgtttattatttttcctacctccaatatagaattaactgcaatagttgtggtattaatttgaatcattattataaaaacatatttagaatgaagataatacttattatatttattataagttctatttcaattataatattaactacagtaatttcaatattctcctttttttatttctttaatttttttttttgagacggagtctcgctctgtcacccaggcaagattgcagtggtgcaatcttggctctctgcaagctccacctcccgggttcacgccattctcctgcctcagcctcctgaatagctgggactacaggcgcccgccaccatatccggctaattttttgtatttttttttagtagagacagggtttcaccgtgttagccaggacagtctcgatctcctgacctcgtgatccgcctgcctcggcctcccaaagtgccgggattacaggcgtgagccaccgcacccggccttttttttttttttttttttgagacaaggtctcactctgtcacccaggccgcagtggtgtgatcacagctcactgcagcctcgacctcccaggctcaagcgatcctcccacagcagcctttcaagtagctgggaccacagaagcacagctccggtgcggaggactctgcggggaggagggggtgggtgagatgggggtgacggctgcccgtctgggcctcagttcactcatctatgaaacggaggcccagtaatccatttaatgctcacgccggccccgtgataatattaggttggtgcaaaagtaattgcacgaaaaaaattaaatggcaaaaaccacaattaacttttttttttccgacagaatctcactctttcccctaggctggagtgcagtggtgccatctcggctcactgccacctccacctcctgggttcaagtgattctcctacctcagcctcccgagtagctggggatacgtacagccacttgctaccatgcccaactaattttcgtattttttttttgagacagagtctcgctctgtcccccaggctggagtgcagtggcgcgatctcggctcactgaaagcgccgcctaccgggttcacgccattctcctgcctcagcctcctgggtagctgggactacaggcgcctgccaccacatccggctaatttttttgtatttttagtagagatggggtttcactgtattagccaggatggtctcgatctcctgacctcgtgatcctcctgcctcggcctcccaaagtgctgggattacaggcatgagccaccgcacccagcctaattttcgtatttttagtagagacagagtttcaccatgttggccaggctggtctcatactcctgacctcaaacaatccaccgtgtcccaacgtgagggggactgcaggctggcgggggagctggggacactgcagcccaggaccaacctatcccgtgcctggtgggggctcctgcaggaggggacccacccaccctggccccaatatacattttaatagttattataacaatatgtttaaaacgaggcagggcatggcggctcacacctgcaatcccagcactttgggaggcagaggcgggtggatcatttgaagtcaggagttcgagaccagcctggccaacatggtgaaatccagtctctactaaaaatgcaaaaattagccaggtgtggtggtgggcgcctgtgatcccagctactcgggaagctgaggcaggagaatcgcttgagcccgggaggtggaggttgcagtgagccgagattgcaccgttgcactccagcctggggaaccgagactgcctcaaaaaaaaaaaagaacatagtgacagttacagtaacagaatatgtacttgttgcgcctgttgcttcttctgtgcttcttttgcctccctgccttatcctcctgttttccctttgttgccctttaaatccagcccctgctgagactccccctcctgcaggagccacggcgcccccagctcccccaccagcctggagtccccctcatgtcgggatacggtgtccagaaagaaggggcccgacaggtgagctcacctgtggctgaagcagtgggcggccgagaccacccagcgggctcgcagcaggaagcctccgcagtgatgttggcccccgaagcgcacggatgccatgtagggcctggagtggggggtcacctcgtggcccccgatgatctgggccccccaggagcctgctggagggacggcctgagtcagggacgaggcgggaggaacggatgacggggctggggtcagggcagggggagaagtagcggccaagacagagacagggggtgagattagagacggagagacccagagagctggagacagagcccagacaagccccccagatgcgctgggaggggctcccgagcccgggagatccagggctgggctgggcagagaccccggccggatttccatccatttccagcagaggcagccacgggggctcggcagatggagcaggtggagctctccccagggttctcccgggactgggggttcccgggtgtggcccccgtacggggacttggcgggggcctgggtggggatcccggggggctcctcaccggggggcttcacgggcagcatcagggcggtggccacagtcagcagaggacgtccccagcccctcaacccgagccccatggcagacgcaggctggcgtctccccgcagaggtcttcgggccgtggctcccaccctcagccaacggccggaaagggggagcctggctgtggcctgtggtcgggaggccccaccagcaacgcctggagcccaggcgggcgtttctgagaaatcgatggtctcaggtggtggctggtaataatcatgttgataataatcattgtcccctagtccggaaacagggagaggaggagacagctctggggctgcaagtgacctcgggaaggcaattgacccttctgtgcctcagtttacccagcctccacgtggcccagcatgtgtggggagctttccgaggaaccgaggtcacagcggcactcgagacccgcagctcgcctccggcccccaccccgcaaaccccagtcttcccatctccaaacccagggccgacctcagggctgtggggacagcgaggaaggccggtctcctgggaagctctgatgatttctgcctttattttattttatttttataggtggggttttgctatgttgcccaggctggtctcgaactcctgggctccagcgatcctnnnnnnnnnnnnnnnnnnnnccctcctcggccttccaaagtgctgagatcacagaaagcacagccactgcacctggcagatttctgcctttattcagcagttattgagtgcctagtgtataccagacctcatgctaggaggtgaggatgaggcagtgaccgcaccccagcctgtagcactgacgttctgtgggatccggagtccagtgggacatggctgtacatgggggtcttcaccttttttttcttttctttttttttttgagatggagtcttgctcttgttgcccaggctagagtggaatggcaccatctcggctcaccgcaacctctacctcccgggttcgagtgattctcgttcctcagcctcccgagtaactggaactacaggcgcccgccaccacagccggctaattttgtttctgtatttttagtagagacggggtttcaccatattagccaggatggtctcgatctcctgacctcatgatccgcccgcctcggcctcccaaagtgctgggattacaggcatgagccacggtgcccggcctttttttttttttttttttgagaaggaatcttgctcttgttgcccaggctagagtgcagtggcgcgatcttggctcaccgcaacctctgtctcctgagttcaagggattctccttcctcagcctcctgagtaactgggattacaggtgcccaccaccacgccccgctaaatttgtgtgtttagtagagacggagtttctccatgttggtcaggctggtctcgaactcccgacctcaggtgatccacctgcctcagcctcccaaagtgctgggatgacaggcctgagccaccgcgcccagcccggctaggtcttcacctttcagtgggagcgttcttagtggcaaagttcaggtcgtaaattgcagctcacacagccgggtgatggcgttcacggcagtggctagcagtggggtgctcgtcagcgcttaataatgaacaggctggggccgggtgcagtggctcacgcctataatcctagcactttgggaggccgaggcaggtggatcacctgaggtcaggagttcaagaccagcctggccaacatagtgaaaccccgtctctacttaaagtaccaaaattagtcaggcgtggtggcaggtgcctgtaatcccagctacttgggaggctgaggcaggagaatcgcttgaaccgggaggtggaggtggcagtgagccaagattgcaccattgcactccagcctgggtgacagagcgagacaccatctcaaaaaaaaaaaaaaaaaaaaagtcatcattgaacgctccagacctgtgttttaccaaatgtaaagtgttctcaataaagaatgaagtgaaatgaagcaacaggaaatgcgtggaaaggaaggtatgaaaaggccccacaacgaactcgggctctgcgagatgcgggcggcctctggaagctaaaaaacggcaggaaacgaattttctcctggagcctccgggaaaagccagccctaccgatgccctgacgttagcccagaagggcctgcaggggcttctgacctccagcactgccagagaataaattggtgccatttcgtttattattattattattatattttcttgagatggagtctcgctctttcgcccaggccagactgcagtggtgcgatctcggctcactgcaagctccgcctcctgggttcatgccattctccttcctcagcctcccaagtagctgggactacaggtgcccgccaccacgcccggctgatattttgtatttttagtagagatggggtttcaccacgttagccaggatggtctcaatctcctgacctcgtgatctgcctgcctcagcctttcaaagtgctgggattacaggtgtgagccaccgcgcccagcctcatttattatgtatatatttattttgagacagggagacagggtcttgctctgccgcccacgctggagtgcagcagtgcaatcaaagctcactgcagcctcgacctcctaggctcaagccatcctcccacctcagcctcccaagtagctgggaccacaggcacctgccaccaccaggcccggctcattatttcattttttgtggagacggggttttgccatgttgcccaggctggtcttgaactcctggcctcgagcaatcctccagcctcggcttcccggagtgctgggattacaggtgtgagccaccatgtctggcccaagttggtatcattttaaaccactacgtttctgggaattcgttacagcagctgcaggaaagattttgggaaatggaaagctgtttccagggcctggggacaggtgggaccccagctcagggtccgtgtacttggggaccatttcctgctctgctgtggtctactggaccgtctggcatcgctgtgaccgcatgggccgtgctccatcaatattgtttttttgtgtgtgggtgtttttttttttttttttaagatggagtctcgatctgtcgccaggctggagtgcagtggcgtgatctcagctcactgcaacctcagtgtcccgggttcaagcgattctcctgcctcagcctccccagtagctgggactacaggcgtctgcccccacgcccggccaattttttgtatttttagtggagatggggtttcaccatgttggccaggctggtcttgaactcctgacctcgtgatccgcccgccttggcctccgaaaatgctgggattacaggcatgagccaccgcgcccggccctgtttttatcttttagagacagggtctccttctgtcgcccaggctggagtgcagtggtttgatctcggctcactgcatcctctgcctcctgagttcaagcgatcctactgccttagcctcccaagtaggtgggattacaggtgcctgccaccacgcccggctaatttttgtgtttttttgttttgttttgttttatttgtttggtagagatgggttttgccatattgcccaggctggtctcaaactcctgagctcaagtgatcggcctgccttggcctcccaaagtgctgggattacaggcgtgagccatcgcacccggctgtccgtcaatattgtcaaacgactggacagcaggcactctggtctccacggtcgtcacgtcagcacgagtgggtcccctggacttgctcctacctcccctgctgccctccgtcgcggagcactgaggcagagacctggaaaacgtccccagctccacgggcgttagaaggagaattgcccgaagctgcaggcgtgtggaactttgttccctcacgatgctgtccctgtcccggtcgctgatggggacacagtagggagagggtaagcgccttagccctgccacacagtgaggagccagggggccggggctgctgcctcagaggagctcccactgcctctcgggaccgattctatccagagctgggccatttccttcccttttggtgaacagttgtgaaataaacaaccgtcctccagcgtctcagaaaaccgagctcctggcagccctgaggagggggctgagtgggggtcactgttcccacttcccaaactgaggcccagagaggggagccgatttgtctggggccacacagcacagggtcttgacccatgagccgctggactgcgattctcctggagggtctctccatggcagatctgagcggctcttcaggagctcagacaccagccactgcagggagtcaacagcaatggtgacaacagcttcctttattgtatttaattttacatttttattttatttattttgtttttttgagacggagtctcgctctgtcacccaggctgcagtgcagtggcaccatctcagctcactgcaagctctgcctcccgggttcaagtgattctcctgtctcagcctcccgagtagctgggattacaggcgcccaccaccacgcccagctaattttttgtatttttagtagagatggggtttcaccatgttggccaggctggtcttgaacttctgatggcaggtgatccacccgcctgggcctcccaaagtgatgggatgacaggcgtgagccaccgcgcccggcccctcccctgcgaaaaattgtttttcaagacgagatgttgcctggtggctgagactgcaatcacagctcactgcagcctctgcctcctggctccgccttccctgtagctgggaccacaggctcacaaaaccaccagggtaattaaaaaaaaaaaaaaagctagacacggtggctcacgcctgtcatcccagcactttgggaggctgaggcggatggatcacgaggtcaggagatcgagaccatcctggctaacacggtgaaaccccatctctactaaaaatacaaaaaattagccgggcacggtggcgggcgtctgtagtcccagctactcgggaggctgaggcaggagaatggcgagaacccgggaggcggagcttgcagtgagccgagatcgcgccactgcactccagcctgggcgacagagtgagactccgtctcaagaaaaaaaaaaaaagtttttttgtagagatggggtctcactatgccgcccaggctggcctcaaactgacctcgactgatcctcccaccttggcttcccaaagtgctggtgtaataggcatgagccactgagcctggcctcactttatttttatttttttgagacagatgctttgtcacccaggctggagtacagtggtgtgatctctgcttactgcaacctctgcctcccaggttgaagcgattctcctacctcagcctcccaagtaggtgggactacaggtgtgtgccaccacacctggctaatttgttttgtatttttagtacggacaggatttcactgtgttagccaggatcgtctcgatctcctgaccttgtgatctacctgcctcggcctcccaaagtgctgggattacaggcatgagcttctgtgcccagcctcactttattttttaaccccaataaatgtatatccacaggacattgcttcttcttttttttttttttttttgttgttgttgttgagagggagtctcgctctgtcacccacgctggagagcagtggcgcgatcttggctctcagcaaccttttcctcctgagttcaagagattctcctacctcagtctcccaggtagctgggattacaggcatgcgccaccacgcccagctaatttttttttttttttgagatggagtttcgctcttgttgcccaggctggagtgcagtggtatgatctcagctcactgcaaactctgcctctcgggttcaagcgattctcctgcctcagcctcctgagtggctggaattacaggcgcccaccaccacccccagctaattttgtatttttagtagagatggggtttcgccatgttggtcaggctggtcttgaactcccaacctcaggtgatctgcctgccttggcctctcaaagtgctaggattacaggcgttgccaacgcgcctgatctttttttgtatttttagcagagacaggttttgccctgttagccaggctgctctcgaactcctgacctcagaggatccacccgcctcagcctcccagaatgttaggattacaggcgtgagtccccgtgcccggacctgcttcctatttcttgaaatggaagatagctgccttaagaatacacattgcactggctggacgcagtggcttgcgcctgtaatcccagcactttgggagactgaggcaggcggatcccctgaggtcaagagttccagaccagcctggctaacatggcaaaaccccatctctactaaaaatacaaaacttagctgggtgcggtggtgtgtgcctgtaatcccagctactcgggaggctgaggcaggaggatcacttgaacctgggaggaggaggttacagtgagccaagattgcaccgttgcactccagcctgggcgacagagtgagactccatctcaaaaaaaaaaaaaaaaaaaaaaagaatacacatagcacaacccaacactacctgccttccagccagactggagagggctggcttggccgctactgggggtccctgagctgtccaaaggccctgctccccggagctctctggcctcagttttcccatctagggaatgggttgccctggggcaatgccgagagtgctgatgagaattcagcaaggttggctgggcacagtggctcacgcctgtaatcccaggactttgggaagttgaggcaggcgggtcacctggggtcaggagttcgagaccagcctggccaacatggtgaaaccccgtctctactaaaaatgcaaaaattagctgggggtggtggcgggcacctgtaattccagctacccggaaggctgaggcaggagaactgtttgaacccaggagatgcaggttgcagtgagctgagatcgcgccactgcactccagcctgggtgacaagaacgagactccgttggaaaaaaaaaaaaacagcaaggtactggatgcggcatgctggtggggactggggccctggcgccccttgtaaagcgcctgtttgcccatccgtaagctggatcctgccccgtccttcccatggaagccatcacagtcagagaagagggtagaagacaggaaaccatccattcattcactcaactcattccgtgagcatttattgagcacctactgtgtacagacagtgttgtgggccttggggactcagcagtgaagaagacaggcaagttcctgcccttgtggggctgacattcagcagagaggcaggaaggaaacgctgaacacaacatgtaaatgacattgtctgtcagaagaatttagtgggaaagagagtgtggacagacaagaggaatagcaaacgccaggcacggtggctcacgcctgtaatcccagcactttgggaggtcgaggcaggtgaatcacctaaggtcaggagctccagaccagtctggccaacacggtgaaacctcgtctctactaaaaatacaaaaattagccaggcatgatggtgggcacctgtaatcccagctactcaggaggctaaggtggaaggatggcttgaacccaggaggtggaggttgcagtgagctgaggttgcgccattgccctccagcctgggcaacagagcaagactctgtctcaaaaaaaaaaaattagccacgtgtggtggtgcacacctgtagtcccagatactcaggaggctgaggtgggaggattacctgatgggggaggtcgaggctgcagtgagccaagatcacatcactgcactccagcctgggtggcagagtgagaccctatcttattcaaaaaaataaaaacaacaagggtaccgagggcacccagtgacaatggggaagctggggaagttctcccagaggaacacacaaggcgtctaacagcaggtgtctggatggctgaagcccaagctggttgtggggcaaggagaggtgagcagggaagagacaggattgtctgggctcagctttgccttgtggggctgcagggcactggggaaccatagatggtgtttgagctggggcaggccagggcatatttctctggtgaaagagtggagtagggagaggaggtggggagacccggaggcgacatggctcagggttggggtgggggccataaggcctcagctaaagtcatggctggggagaggcgaggggggtctctgactcagggacaggggaggagtgaggttttgggacccacctatagcttccggtcgtccaaggctccagagggtggccagatctgcaaggagtggtggggcgtgctgggcggagccccggggtagagctctacggaagtaggaagggcaggggcgccctcagggaaacctcactcctcccctgtccctgagtccaggaaggggtcaggccaacgtcgctctggaagcctggaggcggggccgaggtgcaggggcggggccgacattgcctgggaggcggggctgaggtgcaggggcggggcctacattgcctgggaggcggggctgaggttcaggggcggggccgacattgcctgggaggcgaggccgaggcacagggggcggggccaatgtgcaggggcggggccgacattgcctgggatgcagggaggtggggccgatgtcgggggcggggccatggtgcagggggcggggtcggggcggggccgagatggcctaggctgctgggaggcgggactagggtgcagggtgcgaggctagcggggtgatgcgggggccgagattgcccaggaggcgggtccgaggttcagggggcggggctagggcgcagggggcggggccgacattgcttcggaagctgggagtggggaccgaggtgcaggaggcagagcctcagtgcagtgactgctccccacaggacgcggatgggcgctgcagtgcctgtgggtgggtgagcgcagtgaggcggtggaagtgagggtgtgaagggcaactcgaggcagcttctctccggtccactacacaccccaccttgtcccacctccacacctttgccaggccgttccggccacctggaacgtctccctccaccgtttgcccggcccatttccccggttcaagtggcatcacctccaggcctgtgtgtgctggagtcgggaggtgtgggcggcgcgagtttttcgtgcagggccttgagagtggcaggaggactttagcttttgctcggagggaggtgtgagtcctggaggtttagagctggggcggtgggagaaatgatcccagcagtcccttaccctccccacggcctcctcacttcctcctatttttacacaaaatgcctccaccacccttcaaaccctgaatcttttattttattttatttttgagatagggtctggctctgtcacccaggctggagtgcagtggtgtcttcacagctcaccgtagcctcgatctcctgggtccaactgatcctcctacctcagcctgtgagtaactggaactacagatgcatgatacctcacctagctaattttttaaaaaaaaatttgtaggctgtgtgcggtggctcacacctgtaatcccagcactttgggaggccgaggcaggcggatcaagaggtcaggagatcgagaccatcctggctaacacggtgaaaccccatctctactaaaaatacaaaaaataagccgggcgtggtgtcaggagcctgtagtcccagctactcgggaggctgagacaggagaatggcgtgaacctgggaggtggaaattgcagtgagccgagatcaccccactgcactccagcctgggcgacagagtgagactctgtctcaaaaagaaaaattacatttaaaaatgtatatatggctaatgactgctgtaccgaacaaaccagtccccaaaagcaaatgaaataacagctgccaccaagtaccacggtcacacctaaaaaccaattaacacctcgacagctcctcacgcaggttccgtttactcgggagtaggagccggccacccgatgcagggtcactatgaccccccaagcccgtgcctcgccctgtctcttcttcctccttataattaaaatcttgaaggaccccgatggcagcctgtcccaccgccctgcctgggtctggcccctgcagcttgtgatgcttctcagacccattcccagccctccggggagtcacagaggggtgagatcagacagaggtttgaatccgggggtggcctttccttggatggagcagtatttaaaaaaaaaattgggccaggtgcggtggctcatgcctgtaatcccagcactttgggaggcccagctactcgggaggctgaggcaggagaatggcatgaacccgggaggcagagcttgcagtgagccgagatcgcaccattgcactccagcctgggtgacagcgagactccgtctcaaaaaaaaaaaaaaatttgtagagatggggtctttctgtgttgcccagactggtctcaaactcctgggctcaagtgatcctcccttctcagcctcccaaagtgctgggattacaggtgtgagccactgtgtctggccctgaatcatttattttattttgagccaggttctggctctgttgcccaggctggagtgcagtggcatgatcacggctcactgtagcctcaacctcccaggctcatgcgatcctcccaccttagcctcccaagtaactgggaccacaggcacacaccaccgtgcccagctaatttttattttttattttttattttttttgagatggagtttcgctcttgttgcccaggctggagtgcaattgtgcgatctcggcccactgcaacctccgccttccaggttcaagtgattctcctgcctcagcctctggagtagctgggattacaggcatgcaccaccacgcccgcctaattttgtatttttagtagagacggggtttctccatgttgctcaggctgatctcgaactccagagctcaggtgatctgcccacctcagcctcccaaagtgctgggattacaggcgtgagtcactgtgcccggcccaatttttaattttttgtagaaatggaagtctcactaggtagcccagggtcttcacctcctggattcaagtgatcctcctgcttcagtctcctgaagtgttgggattacatgtaacagtcacttcattcaccctgaatcatttatgtaggggacaaaaatcaccgtctctccaaggacagaacttcttttttgttttgttttgttttgttttgttgagatggagtcttgttctgtcacccaggctggagtgcagtggcgcgatctctgctcactgcaacttctgcctcccgggttccagccattctcctgcctcagcctccccagtagctgggattacaggcgcgcaccaccatgcccagctaagttttgtatttttagtagagaaggagtttcactggccgagcgtggtggctcacacctgtaatcccagctactagggaggctgaggcaggagaattgcttgaacctggtagacggaggttgcagtgagccgagatcgcgccattgcactccagcctgggcaacaagagcgaaactccgtccaccccagccaaaaaaagaagtggttttgccatgttggccaggctggtctctaacttttgacctcatgatccaccagcctcagcctcccaaagtgctgggattacaggcgtgagccaccgcgcccggcctggtctcaaacttttgacctcgtgatccaccagcctcagcctcccaaagtgctgggattataggcgtgagccacggcgcctggccgcaaaaatggaacttctgcatcacaggtgactaacggtgccaggcacacagtaggtgttcaataaatcactttggactaaaagaacacagaggccaaggggaagtgaagaaacgactcacaggtcagttttattgggtgcctagtgcaggggtcagtacactacggccctcggatcagctctggccctctgcctgtttttgtaaataaagttttattgggtgcctagtgcaggggtcagtacactacggccctgggataagctctggcccactgcctgtttttgtaaataaagttttatgggcacagagccatgcccatggttttacatattgtctctggctactttcactctgcgatggcagagcagagtcattgccgcagagactgtggcctgcaatgctgaaaatatttactctctggccctttacagaaaaagtttgccaaaccctgagctagtgtgtgctgggccctgtgccaagccctttgtgtgtgctcactcagttaaccctcccacagccttaagggtgggggcaggggggtgggggggaataaggctccgagaggttgagaaacagacccagggtcacacagcttggagatgggtgagctgggaatcagacagacccgggacccctgatattctttaggatcttagctttgttaacctttgctaatttatcttattgtcttaaatgctaaaatgaatacacattcattgtaaaaagggaggaataaagaaaaggtgttgacggccttcttcagcctggggtacatcctgccgtatctttctccacagctcatccggggctactttcctttaaatctacagccattcagcaaacatcggcagaggagaaccgttttataagaaaactaagaagtttggaagaatctttccttcctgcccaccctggacccccatgagtaggtgtgctggggctggtctgcagtgttctcacgggaaaccaggaagctgggcccaaggcctacatgttggggaagacaggtcctgcctgtctcctgctgtggctccccagtgctctgaggacaaagcctgagctctccctgattctccaccgtccctctcactcactctggtcgtctggtcgctgggcctttagtgagtgtgccatgggggccctggggccgattaaattccagccccggggaccaggctcagctcccagccagggcacagacagatcagcacctgcggttgtctccaccccaacccccggcctttgcaggcacagcgccctccaccagatactccggcaaaggaggcctggggaccctgcgagcggggccgggggtgcagggagctgtcagctcctcgcagcggcctccccaggacccccctatcccctcgctcgccctgaaatgtgtgtccctctcggcgtctgggctctcgagaaaggcctttgcttgtctgacttcgcgagggtcccggctctggcccaggagctggggaggggcgggacttggtgacagccgggtcccagcaccgcgcccagacctaggcccttctcaggggtgccccggggcggggcgcgcggggcggggggcggcggcggcgcagccggcaggaggcgcagcgcccgctcgcagcgcggggaggtgggaggggagcggggcggggagcggggcgggcgggagggagaggggagcgcgccggagacgcgcgcgcccagcccaccccccgcgcccgccgccgcccggacaataaacagcagctttgcgcggggcgatgcccgagccggtgccgccgcccccgcgccgcgcagccccggccgccaggccttagcccgccccggcccccgccaggccgcgtccccctcccctcccctcccccgcgcgccacccgcgcccgcccccgcccggcaccgcggacccacccggacctcggcggggagatggagtgagtaggcgcgctcgggccgcggggctgggggcccggagctccgggagccggggaggggggaggccccctctctcgcgccccattgggggcgtcgctgcccccgcgaggagcaggaggcggcgcggggctgctggggccgcagcgcagccgggaagagactcgggctgggccgcgcctgccgggaggcctccccgctcccggaccccggctgcccacccaccggcgcgtggggacccgggcagcggcggctcgggccagtccaggacgcggggagggggaggctcgcgtctccgcccgcgccccgcccgcgtctccagggcgagcctcggctctcggccacctgtgggtggccccggggagatggagcgacccctccccagattgcaccggtccggcctcgcgctcacgcacccttcccccgccccagtctgagcgcacggctcctggcgccctggacgcgcgcgcgggccggtgccccccacccccgcccttcccaagggcctccaggggtgtcctgagccccccgccactgcgcaggtcccgagttaccgctggagggagaggggctgccctcggcttcccgggtctctggggtgtgtgagaagggagaggaaccggcgttttccagcggggcgcctgggtgggataccctctcggggaagtgtctcggagctggggctccactggtgtagctacaggagtgggctggccctgggctgggatccctggacccccgcatggctgcgcctgtgtgtgtggggggggggtggccagtggaggcaccgagcgagggcgcgtggtcatttcggacaccggtcccctcctcccggtgctcgggtgcccctctgcccctcactcccacaggtgggcactgcacgggcaggggtcaggaggctcctcctggggtcacccacctgcccacttcaggacaggggagccagctgccctgctgaggcccgggtccccaccccagcccgaggaccgaagaccggatctggaggccgcctgtggccccctgcccttcccactgggcgtgttttctaagccgccaactttccccggggattcacccgtgacccgccacgcccgcggctgggtgggggccgctgcctccctccctccctgggaaagcgagacacccagtgtcctctgcttttgaaaacccagacaaaggcctgacccctctccccgtcaccccgccccgggagctcagccaggggctcaggggagccagggcccagacttgcctgctccacacccccaccccccagccttgtttatctgccctgctcgccaggccccggaggagcctctgggcctctgacagccaggcctgggcagggtgtggctgtggggagggggctgcctaggaggacgacggagatctccctcccagaggaggggtgtcagcgaacactccgggtcgggcccattgtttccttcctgccaccccttcctttcccacgggggatactgaggcccagagaggagctgctgccccccccccaccccccctccatcacacagcacctggggccggggggcctcggtgcctcctgctctgctccacggtttctccgtcctgggtcagagggtggcccacaggtcccccattgggtcatcattgcttttggggatgcagacatgggacaggcacccagtgttaaccggctgctgtgagccgccattcgaggacgcctctctccccggttcccgggctgacaatgggtggggacaggcccatctggtgccgcccggccttggacacctgccccctcgttcttctccccggcgggcttcaggcacgaaggccccgtccgctagaacgtgatcgcttgcctcctcccgtttccacagattttccagtcgaagacacgggagctggctgtggtttgtggtggtgcccgtctcgctggaaagtttcacaaatgaatttaagaatttaaagaattttaaatgtcattcaagaacaggttattttttgttaatgtgaggatttaaggagaactagcgggttgctaaccacagggccgatgctgccaaggtgaggagaacgtccaggaaggagctggggagaatctctgcttcggagagaatctctgtgctctgggagggtttgtgtggcccctgcgtgacacatggtctggctggtaaaataaagatattttggcctggagcagccattctccagcacccacagccctgtcctgggtacaggcaaggctcaaacccccgggatagggaggagaacagacttgggcctggacagatggtcaagaccggcccagactcctccctgctcgcagacctggaaattttcaataggaaagtctccgttgggtgctaactgggtccttaacgctccttcacacttgctaatccccctttttaatgagaggcagagcctgttaaaaggcaacagtacctagtgataattgaatttaataacaagcttttacttccgttgtatctgtttcttcctccatgtttccgctgtcttgtttgtggcggtggcttctggtttgcccagtgttgatcacaatataatgtttctttctaaaacaaggcgatttgatttacactggagtggttttgaaggcaaggaatagacagatactgtccaggaggtggcggaacatgggaaggtggtttctttcttttttccatgttgcccaggccagtctcgaactcctgggctcaagcgacttccctgcctcagcctcccaagtagctgggacgacagcattgcatgggaaggtggtttgagaagtgcaggcgtaatttattcactcggcaaccattaagtgggtacctgccttttccacggccctgttttgagtgctctgtatgtgtgtgaattcctctgatgcttttttttttcttttggagacagagtatctctctgttgtccacactggagtgcagtgctgcgatctccactcactgcaacctccgcctcccgggttcaagcaattctcctacctcagcctcctgagtagctatgactacaggtgcccgccaccacgcccggctaatttttgtatttttagtagcgacagggtttcaccaggttgcccaggctggtcttgaactcctgacctcaggtgatccgcctgcctcggcctccccaaagtgttgggatgaaaggcgtgagccacgtgcctggctgacacttgccttttccatggccctgttccgaatgctttatgtgtgagaactcccttgacccttgatccttctttttttttttgagacagagtcttgctccatcacccaggcagtgcagtggtgtgatcccggctcactgcaacctctgcctcctgggttcaagcggttctcctgcctcagcctcccgagtagctgggactgcaggcgcccaccatcacgcccggctaattttttgtgtttttggtagagacagggtttcacagtgttagccaggatggtctcaatctcctgaccttgtgatccacctgccttggcctcccaaagtgctgggattacaggtgtgagccgccatgcctggtttttttttattggagacagagtctctctctgtcacccagactggagtgcagtggcgcgatctcggctcactgcaacctctgcctcctgggttcaagcgattctcctgcctcagcctcccgagtagctgggattacaggtgcctgccaccacgcccagctaatttttgtatttttagtagagacaaggtttcgccatgttgggcaggctggtctcaaactcctgacctcaggtgatccgcccagctgggcctcccaaaatgctggcattacaggtgtgaggcaccgtgcacggcccactcccttgatccttacagaagccctgcgagagagggaaactgaggtacagggtggtccagtggcacatgtaaggacacacagctgcagaggcatgggtggggggtttgctgctgggtgggccgagcatgctctctctaagccgccggggacaggggagggtttttggtacctgtgtctgggggttgtggtcttgtggggcgtggtggtctggatatcagacatcctggtgtcggctttcaatcctggtgtgtttattgagaaacacagacggtggccttgtcggtggtcttggctcctggggcatctgccctgcctctgtgcccatccacgccgttctgtgatttgggagaggagtgtggagagggggtcctgactccccgtcacaccttagcatgtcagtctcctccgggcctcactgttctcatctggcgagtggggatgtgactgccatcattaggggagataggggtagaggaagggcaggtgctttatgggcctggaccctctgagcaccacccagtgggggcatctctgcctctacccattagccaggttcatccttaagggcctcagattttgaccctaggaaattggcttatgttctttttgtttgtttgtttgagacacagtctcgctgtcacccaggctggagcacagcggtgtgatctcggcttatagcaacctctgcctcctgggttcacgcgattctcatgcctcagcctcccaagccgctgggactacaggcatgcgccactgcgcctggctaattttttgtatatttttagtagagacggggtttcaccatgttggccaggctggtctcgaactcctggcctcaagtgatccgcctgcctcagcttcccaaagtgctgggattacaagaatgagccaccatgcccagcctatgttctttttttctttctttctttcttttttttttttttgagacagagtctcgctctgtcacccaggctggagtgcagtggggtgatctcggctcactgcaacctctgcctcctgggttcaagccattcccctgtctcagcctcccgagtagctgggactacaggtacccgccaccacacccagctaatttttttgtattttcagtagagatgcggtttcactgtgttagccaggatggtcttgatctcctgaccttgtgatctaccctcctcggcctcccaaagtgctgggattacaggcgtgagccaccgcgcccggcttgttgtatattttttagtagagacagagtttcaccatgttggccaggctggtcttgaacttctggcctaaagtgatccgcccacctcggcttcccaaagtgctgggattacacgcatgagccaccgcgcccagcctacgttctttttttctttcttttttttttttttttttcagatggagtctctctctgtcgcccaggctggagtgcagtggcgagatctcggctcactgcaagctctgcctcccaggttcatgccattctcctgcctcagcctcccgagtagctgggactacaggcgcccgccaccacgcccggctaattttttgtatttttagtagagatggggtttcaccatgttaaccaggatggtctcgatctcctgacctcgtgatccgcccacctcggcctcccaaagtgctgggattacaggcgtgagccaccgcgcccagccttcttttttttagactgggtcttactgtgttgctcaggctggagtgcagaggtgtgatcatagctcactgcagcctccacgccccgggctcacgggatcctccacccagcctcttgagtagctgggactacaggtgccaccaccacaccctgctaattattatgttttgttttgtttttgtagagacggggtctccctgtgttgcccaggccggtctcaaactcctgggctcaagcatcctcccacctcagcctcccaaagcgctgggagtacacacatgtgagccactgcacccagcctgatgttctttaaaagcatcatatgggccgggtgcagtggcttatgcctgtaatcccagttctttggaaggccgaggcaggaggatcacctcaggtcaggagttcgagaccagcctggccaacatagtgaaaccccatctctactaaaaatacaaaaattagccgggcgggcgtggtggcgggtgcctataatcccagctactcgggaggctgaggcaggagaatcgcttgaacctgggaggcggagctttcagtgagccgagattgcaccactgcactccagcctgggtgacagacagagcgagactccgtctcaaaaaaaaaaagcattatatcacctttttctgagtgtgggcccctgtttcctctcatcctttcttgatctaggaaacctgtcatttgtttattgaacaaataaatgctccctcctcaccatcctcgtgctgtgcgggatcagcagggtctggaaagctatgcagcatcttctctgaggtgtgagaaaggcttcctcatccagtccatcatgaaccttttctgagaaggatgtttcagggttcatccaggcaggcagaaggatgcaccttgtggaaggactggcatgtgcaaagggctagaggtgggaaagcattggaagaagagaatgctctttggtgtttgttcctgctaggccttgagtgccaggatggggagtcatggatagtgtgtgagcaggggaggagcagtggctgacctggtcatcaaaaaaggcgctggcagctgaggagtgagcccagggaggagcaagtcatggccaagccttgattgtggctgcaggggcagcatggagagaaatggcagagccagagggggcaggaccccacgtctaggagggcaaacacaggattccagaactgcgtgtggtcagtgatgcccacagggacggggctccctggctggggagaagtagcctggtccctggatacatgagggggtggagggcgtcctctaggaggatggctgcgtggacgtcttggtgtctgaggagtgtaaaatcaggccagagtggctgtctcccgccccagggtttcaagcagaaattcagggacagtcagagccagtcaccaggacagagcctggactgggtgggaagagggaaggggagctaggccttgggatggggaagacttagattagggctgggcatggtggctcacgcctgtaatcccagcactttgggaggccgaggcgggcagatcacctgagttcaggagttcgagaccagcctggtcaacatggtgaaacccccgtctctaccaaaaatacaaaaattagccaggcatggtggcaggtgcctgtaatcccagctactcgggaggctgaggcaggagaatcgcttgaacccaggaggaggttgcagtgagccgagattgcgccactgccctccagcctgggtgacagagcgagactctttctctcaaaaaaaaaaaaaaagaaagtttagattaggaccagagtgaggccagctgagtgggaggcgctgcatggtcaacagactggtggtgggacagggccaggcctgggagcccctcctgggtgggcagaggctgtgggcaatggaggcagagatgcgggaccctgaaggccggggagggacagaggcccagggttcttcagtaacccctgtcagggagcgagaagctgatgtcctcatcagtttgtattcaaacgcttccagccatggaaagtctcagggcagggccagcaggggtttcagcactccatgggggttgggaaggaccccagcccctggcctggctcttgttgagaaggctggcattcccattacacatgcacgtatacacacacgtacacaggtatgtatacacacgtctgtatgtatatcattcttaacagcttcattaaaatacatttcacacgctacacagtctggctgcttaaagtgtacagctcaggcgtttttagtacactgacagggtgtactttttttttttttgagacagagtctctctgtcacataggctggagtgcagtgacgtaatcccggctcactgcaacctccgcctcccgggttcaagtggttctcctgcctcagcctcctgagcagcggagattacaggcacgtgccaccacgcccggctaatttttgtgtttttagtagagacggggtttcaccatattgaccaggatggtctcgatctcttgaccttgtgatccacctgccttggcctcccaaagtgctgggattacaggtgtgagccaccgcgcccagcagagttgtgtatctttcaccacaattgtagaacattttcatcacccccaaaacaagccctgtccccattaggcatcccctcccgtccccctccccccagccctcggggagccagtccccttcctgtctctggatcggcaggtcctggacatttcgtagacatgggatcacacgctgcgtggccttctgtgtctggcgtctctcactgagcgtgatgtcctcaaggtgcatccgcgccgtggcctgggtcagagcctcgctcctgttcacggctgagtcatgtcccagtgcgtggacggccacattgcgtttacccacacatctgtggatggacacccgggttggtttatctgtgaatctgtagttaccccccgagatggttggagcttgtgctctgttcacactgaggagtccgggtcctactttacataagtgtaagtcgtgacagtgagtttctttaaaaagaagaggcagtgatcagatgacaggtggccctgggagtggcgggagtgtgagaagagggggccgggattggggggacctctgggtgggggcttcctctgaagatggaaagaccctaatcgactccctggggcagcaagcatttattgagcacctgctgtatgcctggtgccagggacatggcagggacaaaaatgacacagttgctgtcctagtgggaagacaagatcacgcctgtaatcccagcactttgggaggctgaggcgggcgaaccacctgaggtcaggagttcgagaccagcctggccaacatggtgaaaccccgtctctactaaaaatacgaaaattagccgggcgtggtggcatgtgcctgtaatcccagctactcaggaggctgaggcaggagaatcacttgaacccaggaggcggaggttgcagcgagccgagatcgcgccaccgcactccagcctgggcaacagagggagactccatctcaaaaaaaaagaaaagaaaaagataagtaaagtgatccgggtggtgacagctgcaggggtgcctggggctgaaaattaggacagaagaggcctaaatgaggaggtgacgtctgcagaaaggccttgggcctgaggcccggggaggtctgggtgaccgtgcaccaggcagcaatgcagccagcacaatggccctgcagtgggagctctgtgggacgtctcaggagtgtggctggagtgcagtcgcgtggggagggaccatggggcctctgcagcagggtttgccctgagaccctgctgaaagccagggaaggccccgttcacgcctcactgccccgtcttcccctgagggcccgggcagggtcccttcccaccccaggttaataggcaacaggtttgcttctctgcatctgtggcctgctttgacctccgtcttctcctctcccccggggtgatgcctctctgccgtaacccgtttagggttctcggtgccccagagactgggatggccctgggggcctccgtgctgcatcctgggagggctgggaggaggttccttcctggaaggctgcctggaggaggtggctgtgcttgagctgatcttggcggtggagaagggaaaggggaagctgggagctgatgaagggtgaggggctgacattggggcttggactccggggcttggagcagggcagggcggtggaggaagcagggccgggggtgccagcgctcaggggagacacaggctctgaggaccgaggatcaccgggac

SEQ ID NO: 12534 - DNA, 9279 bp, Human
aaaaaatttttttttacccaaaccaaaaatggtcaatatagtcttcagttgtttaaaggcattatttttactcattttctacaccccttcctttttatattactttagtcatgtcaaagaatttttagaaaaagttgcttcttctgttatttttaaatgatgtcttatttttcagtgataattttaatataattttaaattatatatcctcctggattctcatcaaaattattttgtcaagtatgccacaattgtcagaagcacaaaatacaaatagttatgctccatagacataaagaatagacctgctagttttatgatctggcattcttcatttcagtaactgtgtgagtcacctactggtatgcctccatttttctagcgataaaattagaataatgcaatttttgtaaagtttcaaaatccttgaataagtgatgtgtttgctatattattatttaaaagcaataacatgtagaatcataactatttcttctcgatttgtatatatctttcctttaagttaataaattactgtttgagagaggatctaatttatctatgaatcccagtgtttatgtagtaaatggaaatattcctaaaatctgttagtaatagctcaaactgagtatgtgccaggcactgtttcaagccatattattcatttaatcttcacaacaacttcataagagaagtgctacttttagccccattttatagatgagaaaactgatgccaagggtgtgccctagcaagtggtagagccgggatttgtgcccagtcagatttcagagcctgggtgctcttttaactcctccctgccttggcttcaatatttttcagcccattccagtgtcagacatgttgattgaaaggttgtattttctaacggaagtagttaagaatgaaatgatacaatgtctgagatttgctttaaaacatttaagtagggacaaaaatgaaacaaattgttataccagacactgtggaggcccctcgatagacacatgggatccattatgccattctccactttcatgtatgttcgaaaattttcataacaataaggctttttttttaaaaaaaaaaaaagttattccctgcattaaactgaaaagttcattagattttaggatgtaatttccttgtttgaattttaattttttcccctattggaaatatttgactggcctttcttacacacttattttttgaaaagttactgctactcaatagagttcttattgttttgacaatgaagaacaactcttactttcatgtttctgtattttataatgtacaaaaattgttttgtgagagggctttactttgtccaagtttgtatgaaatcattgcacctagacatatatttagtgtcatctggtttgtttttataggagccaagcaataaaagagttcgacctctggctcgtgtcacgtccttggcaaatttaatctctcctgtaagaaatggagctgtcagacgttttggtcaaacaatacaggtaaaaagagaggaggaagagtaatgtagtcagcggactttatagaagcctggaatttgtagttgtctttgagctgtacaaacaagtttgcattattatatttaaacatagttttctttttggaatatgctagtaaggaatattgttccagaacaatgtgtagcctcattatattaatttgcatcttatattaatttgcatcttataatgcatagtcttggctagtttttattcccaaaaatgtaattttagctgataaatatttaagattggtaggtggaaacttggataaattattgttttctgcattgagaaattctcagaactttgtctttcttcactttaaaaaaaaagaaaatgggaataattctatttcttccaaatcttattttctcttttgttcaccttttcttttttaagtcatttacccttcgtggtgaccacagatccccagcctctgcccagaagttttctagcaggtcaacagtcccaacacccgccaagagaaggagcagtgcactgtggtcagagatgctggacatcaccatgaaggagtctctcaccaccagggagatcagacggcaggaggtatgctggcactcagtgtacatgttttcccaaaagaacagcaaattgatgccgatggcaaaattaacttggatttttgtgtttgagcaacaattcctaatacatggtgaacaaaacctaatgatgggtggtggtcaaattaaacaactctaatagggtaaacttaccaaacatacggcaaccttgtatttgagattccattctgaattacaattttcagactgagttactttttaaaatgccgttcaaaacatcaaataatgtaattatcagttgtatataattttcctttctcgaaggaatgacctctgatgtttgctggatgtttttaggcaatatatgaaatgtcccgaggtgaacaggatttaattgaggatctcaaacttgcaagaaaggtcagtaaataactttttatcagatgccctagtttttaaaaattacatttcacaaaatctaaaggatagttttcttaacctttagaagtagaagaatagaaaatatctactggtgaatacattttttttaggtgaggtctagacacatcctcaaatacaagtattagtaagagagtttatttggggattaatacatactaatttattttatgtgtagcaaacagaatccacgctagcttttatgtaattaattctctttgtttccaagtatagatccctcatgttttcctcacatgatctctctgtgacacatttctcccctctgacaggcctaccatgaccccatgttaaagttgtccatcatgtcagaagaggaactcacacatatatttggtgatctggactcttacatacctctgcatgaaggttagatgtgccacttaattgtcattaaatctaaagagcagcggtgcatgtaattttcagtctaaacttctaatgtagtgctgacctattttttaaataaacctgttaatggtgtttatgcttttttatcacttcagatttgttgacaagaataggagaagcaaccaagcctgatggaacagtggagcagattggtcacattctcgtgagctgggtatgtagtgagttgttgaccccagatacagtttcttacagatgtgccatgttgcagtttctgatgaatatgagacagatttgatcccacaactctgttctacaaacacataaggcgttaaaactgaacaaatttacagtgacataagaagttacagtctgtttaaaaaaaaaaaaaaacaccttcattaatgctataggttcatttgtgttacaaatacgttcctgcttggatagaattcccacatcatgtgtgattatccgttgcattctgtcatgtatgtttaagcgcatgccaaatgcggggcactgtttgaggaggagtcgctgggagtcagtgatgaaaggcagtctctgcctttatagcctagtgaaggaatagccaagcacataaacagtctcagggctggtggcaaatggaggacactcaagtgtcctgggagcacagactgccagtgtctgaggttggaggggagtagaagtcatgaatcttcacttggatttagccaaattatgaaaatttgaagagcattttgatgattgctaaaatgctattcagcttccattattatctgccagaaaatgtccacagcttgttaaaactctcaagaatagctgtacattttgtgtttcatgtttgcaggcttgttaatgcactcggtcataacaggaacacatcataccttttcttttattactcttcagttaccgcgcttgaatgcctacagaggttactgtagtaaccagctggcagccaaagctcttcttgatcaaaagaaacaggatccaagagtccaagacttcctccagcgatgtctcgagtctcccttcagtcgaaaactagatctttggagtttcctagatatccctcgaagtcgcctagtcaaataccctttactgttaaaagaaattcttaaacacactccaaaagagcaccctgatgttcagcttctggaggatgctgtaagtagtcccttaagtgattgttttgttttttaagtttatacattaggctgctttagaacgttatcttctgaagatgctgattcacatcagcatagtgaattgttttgttgttttaagtacccagtgcgttagtacgctgtgcactaagcaataaggagctgtgtatgctggacttcgcacattttgtatcttaagggacaggattctcctctgatctcaccttgtcacctttgaacaaatcactcaatttggctaggactgtttcttgatctataaaatgaacagactggcagaattaactgatttctagagtcccttcaagctttaaagttcttccattccatatgacatttttgctctgcaggaagcagaatgagttaataaactgaagctgctctgtcaattttatttatcattttcagatattgataatacagggagtcctctctgatatcaacttgaagaaaggtgaatccgagtgccagtattacatcgacaagctggagtacctggatgaaaagcagagggaccccagaatcgaagcgagcaaagtgctgctgtgccatggggagctgcggagcaagagtggacatgtaggtgacttttgctgccgtggcagagcagccttccctcctgcctctttaacttttacacgtttgttatgaagcaggcttgtaaagggaaagtcatgacatagtaaaagaaggttgccaattttaattttatattaccagcttgataaagccaacaaagaagataccttaaatgtctcagtggagaatcagtaatactttattttttagtttcgaagcataaatcaacttgttaggccaggggttcctgtctaaatacagtattagttccataatgcttaataaaaaagcatccttcaaaaaaaacttctaagagtttatcttatgcttatgaaagtggtttttcgcactacataacaaatttctgaagcagattgaatgaatgcaaatgtattttttaaatgctaattataaaagtacctgctagaactaagtgcagtcacggaatggtatttttgtttcatcatgcattttcaaaagcccaatttataagttggagttttgtttaaaaaaatttgaaatctgacatctttgatttttccctcacgaggggaaaatttataaaggtataaatttgtgtgggacaaaatagaaccattaacattttaccagcttgcatttttaatccctccttcgtgttagaaaactgtggtatacaacgctagtgtttcaagtcatgttgctactaataggtctttgtgatgcagagcattcacttagctgctgcttaatctgatattacataccaataagaaacattttatttattctgagattggaaaaactttccaaatagaacatgcttagccttgaaattgccatctttatggattactagatttgtcacttagagagatcttcgaaaaataaatctgatgaaattaataatgtcgagttattttagcaatatatttcagtcacttaaaaacacaagtttcctatttagcgtttgtttcccatttctccagaaactttacattttcctgtttcaagacatcttggttctgactcggcccgtcacacggaacgaacggcactcttaccaggtttaccggcagccaatcccagtccaagagctagtcctagaagacctgcaggatggagatgtgagaatgggaggctcctttcgaggagctttcagtaactcagagaaaggtaaaatgcagtccttcaataatttaaagaaatagaagctcagaactgaagtgaatttagttttgcctttaagaattctagagatgaaatggctccattgtcctatacttgttacatccattgagttgtccaggccttcccagctcgaacacccgcaggtgtatctaagaaataatgcataggcttaatgtattcacattgacataaataaattgccataaattgacagtcacgttaagattgtatgaccactttgtctagaataaacctttttttagcctgatttcttttttttttccaattttttttttcagctaaaaatatctttagaattcgcttccatgacccctctccagcccagtctcacactctgcaagccaatgacgtgttccacaagcagcagtggttcaactgtattcgagcggccattgcccccttccagtcggcaggcagtccacctgagctgcagggcctgccggagctgcacgaagagtgtgaggggaaccacccctctgcgaggaaactcacagcccagaggagggcatccacagtttccagtgttactcaggtagaagttgatgaaaacgcttacagatgtggctctggcatgcagatggcagaggacagcaagagcttaaagacacaccagacacagcccggcatccgaagagcgagggacaaagccctttctggtggcaaacggaaagagactttggtgtagagaaggctctgtgtgttaactgatgggagagactgtttgtttataaatgtgtacagttttgttttctcgtaaggggagcatcatagggttactttataccagttgtaacattttcattgtttttggttgttcttttttctttttttaatggcagctaaagatatacagattactgttaaattgcagtccttttttttttaaagatattttcttgagttatttagaacatggtaagcctggtattttttaatcaaacaaaatatttatgaaatgggttttctcttaattctggattcatcatggctttctaataccaattgtaatatttacaatattcaccaaaacttagaattttgcaaatgctggaattctgccagtgtttctttgctaagccttgcatgcaaaatttgaaattttaacattggcacccaaaacctacatggaatgtatgtctggagtatttcaaactttacattgaaacataatttccttggaaaacaaaccataagcctgaggaggtttttatcaactggaatgctttatattagtttgtttttcactgtacattcctcattttacattcatttaacctgccgattatttaatttttttattgtaaagtagtttttagcatttgcttttatttttttactttgatgccttttcaaattggcatgtctttaaagtatttttcttcctgattaaaaatgtgtgtgtatgtgtgtgtgtgtgtgtatatatatatatttttttaaatcacattaattttaccaagtgaaaccaagccatactgtttttgagccaattaagaaaattgccatttttaaagtgtagcatttcagggtaaagacccatgaaatggcttgatgtattctagactactgaaagaaaaccacttcaaagattttgttgaaagttttagtgttgtctgaaatgcaagagggaaggtgattggtagtgagttaaaagaaaaagagaggaaaagagagtagttttgtcttcaagtaaaatgtctggttgtgccagacatttcacaagtgtgaaaggagataggagaagctcaacttgagggcgtgtagtaagttgtagaaggctcgaggggacgtggacttatttgccttggtttgcaatacctgcaaataatgagtttgaaaagaaacaatgaaatgtgttaaaaatttgaccatattagataaattttggtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagaaaagactgtaaatagatccatccaaatgatttctctgtacaaatgaatgatactattaaaaaaaaaaaaagcacacacataatcaccttgaaggtttcttgcctggtggctatgttgggggcatttggcaaaatatgctggtgtggcaaaggaggtagtggtaagcctcataaaagttagtaaaaattgtagttcaacctttgaaatcattgatgaatcagcgaaaggtaggtaagtcttgtgttaggaaatcttttaagaacatggtgtaatcagacacagcaattgtattgaaaataactgaacacctgttactttctggataggatagtaagggtagtagtggcaaaggatcctgattaatttcagattttaatgtaagtacctcaggttcttgtctttggaaattcacattcataagtgtatattacaccaatgattgtgatctgcaacaccagaaagcaagatttctaatcatttccagaggtgttgtatagaatagttattccagagttaccttgatcagcttctgaagtttaagaagcaagtaatagttcaagtgttgttaatggaattatgttttatttaaaaccgtatcttcttttggttccctcaaaggtaaaaataagacccagaatctgagtaaatctattaaatgaatgttcttcagaaatagcacctgtgtttgagagcattcagtgatttagcacattagttctcaaacttctttgggtatcacaatcactagaggtgctttaaaaaaaaaaaaagtaactgggcctcaccccctaacatacccgctgcaaccccatatacaccatgttactgaatccagattgtggggcgtcagggtagagggctgattgtttctgttcgcaagcatccctcctagcaattccagtgctgtgaattccttggatcagcattgagtattcactcatctattatatatcagccccctttgggtaactgctatataataagtcaacatgtatccaccatattcctagtttttgccttaacctgttccgagtcagagctgaagagaaatttccctgcctttttacctttctccagtgggtgtgcttacatattttcagcaaagaatagtctctgccctgaaaatcttcttaaacttcatggtccgtctcaggatgtgtgtatgcacagtggtaagggaaaccaggtcatcttattagccatccgtggatcacaggtaaatcaccctgggatctatcaggacacaactgacccatcagatgtgttcagcgacttttgtggtagctgggtctactttgtatttaatgcttttctcagtatgcagacagca

SEQ ID NO: 12535 - DNA, 29067 bp, Human
  misc_feature (1)...(29067): n = A,T,C or G
ggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcctctggccaccctctcgcctttgcttcctctgtcctactggggaggagcccctggaaggcagtggggaagggagaggctgggagcaggttcacaagtagtggctgggagtagtagtgaacagtgccctgtggatttcttgggctgagggtgaagatcatcctcaccacagtgtattcctcaatggtggtggtggtgggggtcctctgaactctagaaatccatgtgagtagtgggtcttgggctgcatttggaccaaggaatactccctgggctgagagctcaagtaagggctgctgtttttgactcctgttgaccgaggagccttactcttgatttaggcatagagctggaatctacctgggccagccagcgcaaggacagaccctgctcatagccaaagatagcttccctgagctagggagagggtgtagggtgagcaatgcacaaagattctatgctgctctgtgttgattccttctttctgtgaacacctgtgctttccacctatgccccaaatgaaatctcactctgggtctatttcagctggagcagatcagctttatattatgggactatgcacagggtttcttctgggtagagggagtaacactgccacagatactaagcctaaaaacccaaaagttgacttactccagcccaggtgggcctgggtgaactcaccagggatgctgctctctgggaggacctcaaagataacctcctcaaagataacttctctgatgtgggaataataaaaaggatttgttagtctctagtctttgaagcatctgggcctccaaaattccaaccctactacagtctcaagcataactgatcctcctgagagctaagagctaaagtcagggtactggccctagtgtctccaaactcaaggatagtcatatcttacttggatgaagccaaggttggcctggggtgacctgagggactggggcctatgtgtccatctttctagaatcgcccggaactgaggactgagagggtagggtattgtggtctatgggaactacagaccatagcgcatggtccatcactgtccagagcccaagggacccatcgggaccattgttctattcccttgcggctgcggttttctctgccttggcccagcctgcctcgcgccagctctggcatgggaccacaatgcgctgccttgccctggaaaagggtccagctggcagcctcgctgctccccgccttgatataatgctgcgctctcaagtggcaggtcgagtctccccagaggacgcctgagagcgaccgcgctccgcccaggattctctacggcctcggggccgctaagccccgcccatagttccgcccatccgagaatttgtccaatccaggcgaagtattcacgctccgcccaaagttttgtgttgtcacttccggcccgctccaggaagtcgtgctgcggagccaaatttgaagcaagcggaggcgcgggggcgcgtctacgaagccggacctgtagcagtttctttggctgcctgggccccttgagtccagccatcatgcctatccgtgctctgtgcactatctgctccgacttcttcgatcactcccgcgacgtggccgccatccactgcggccacaccttccacttgcagtggtgagtgactgcagtgttggggcccggtgtttgcccgggtaccgcttcagggccttgaggtgttgggcctccaggcggtccaaccccggaatccagacaagtgatgagaaccttcctcctagacgaggccccacgggagcttcccaacctgggcagaagtgggtcaggacaggctttctggtagaggtgatagctgagctaagcctgagggggactaagatggctcagtgaagatagatgcttccttgatcacctatacaaacagatgtgatttcaaaaccgttagcctgggcaagggtgagctttcaccacatcaacaagtccttttatttcttccagatagaaacctgctaggcttctggctacccaagagagtttgctgtgccttacttgatggtttggaattattctacccagagtcatctcactgtccagacaccccaatgtattcgccatgtcagcaaacccgtttaacatggggaaggcaaggagatgctcccctatccaggggtcctgctgaccgtgtagggccattctgttgagtgtacagctagtggggaaagattcccctagcagatgtggacaggccggtttggacctcctagcaaaagagataaggcagcgttacccctgggaatggtgggtgataataatcacagggtcttgtggggctaaaggccctaggaagcagaaaggcaggcatgacactgatggctgctggcttacttgcaaagctttgtttaggcctgtgttgctgacagcctgagccccatgctgagggagccactgctgtttggttagactagaaattaagctcgcctctaagcgtactctattttctgtttgcctactctattttcttctatccttttactttatttatttatttttattttattttatttttgagatggagtctcgctcctgtcgtgtaggctggagtgcagtggcgtgatctcggctcactgcaacctccacctcctgagttcaagtgattctccttcctcagcctcccaagtagctgacattacaggcgtgcgccaccacgcccagctaatttttgtgtttttcatagacagggtttctccatgttggccaggctggtctcgaactcctgacttcaggtgatccacccaccttggcctctcaaagtgctagggcctatccttttactttaaacttttctgtgtccttgtgttttacatgtatcccttgaaacagcatttatttctttttttgtatattaaaaagtactttagcttactgcaaagatctttattttattttattttgagacagggtctcactctgttacacaggctgcagtgcagtggtgccatctcggctcactgcagcctctacctcctgggctaaggtgattctcccatcttagcctcccaagtagctgggactacaggcgcctgccaccatgcttgactatttttttttttttgtatttttagtagagatggggtcttgctatgttgcccaggctggtcttgaacccctggactcaagtaatccacccacctctgcctcccaaagtgctaggattacaggtgtgaaccaccgcacccagccttggaaaacaacatttagttggacttttaaaaatccagtctgataatctttgtatttaactggaccatttagtctacttaaaattgttgcaattactgattaaataaagagtaaacatattgtctttagtcgattctgttttgccttgcctattatatcttattgtctcctttcttgccttggtaggaattggttaaatattctgtatttctccatttttccctcagttagttgggtcgttatataccccatttccatttataagtggttatcctagaaattaaggtatgtatccttaacttaccaatttcaaggttaatcagcacctttctcattttcccaggcaactcaaagagcttagaatactaacattcttttcccacttctacgttattgttgaatattttaattgtgtgtatgtgtggtatttttttcgttggtgttatttttgagacagagtcctgctctcttgcccaagctggtctgcagtggtacaatctctgctcactgcagccttgacctcctggactcaagcgatcctcctgcctcagcctcacaactagctgggactacaggtgcatgtcaccatgcccagctaatttttgttttttgtagagacaggatttcgccatgctgcccaggctggtttgaaactcctgtactcaagtgatccaccctccttggcctgccaaagtgctggggtttacaggcatgagccaccacgaccggccaattgtatgtttttaagtaaagtttttgtttggaataatttttttttttttttgaaacaggatcgtgctgtgtcgcccaggctggagtttataattgtttcttcttgcaggattgaactttttttaaatgttcttctttgtccttctttgtctcttgtaactttaattcaaagtctgtcttgcctaattttttttttgagatggagtctcgttctgtggcccagactggagtgcagtggcgcaatcttggctcactgcaacctctgcctcttgggttcacgtgattctcctacctcagcctcccgagtagctgggattacaggcacacaccactgtgcctggctaattttttttgtatttttagtagaggcagagtttcactatgttggccagactggtctcaaactcctgacctcgtgatccgcccacctcggcctcccaaagtgctgggattacaggcgtgagctaccgtgcgtggcctatcttgtctaatttaaagtccattttatctgctattagtatagccacttcagctgtcttttggtgactgcatggtatatcttttttcatctgttttattttattttattttattattgtttttagagacaaggtctcgctatgttagccaggctggtctcaaactcctggcctaaagcaatcctcctgccttggccttccaaagtgctgggaatacaggtgtgagccaccacactcggcccttatccaacttctagcttccgttgtagctattgaagtcagattttagtttatcagttactcctttaagcatactttggaactttatcctcagactctcattacctttagaattttctctgattttggctttctgcagttttggtatagtgtatccaatatgaatttctttttacctttttcttttcttttttttttttttgagacagagtcttgctctgttgcccaggctggagcacagtgggacaatctcaactcactgcaacctccacctccctggttcaagcaattctcctgcctcagcctcccgagtagctgggactaaaggcacgtgtcatcatgcccggctaaattttgtacttgtagcagagacagggtttcaccatgttggccaggctggtctcgaactcctgacctcaggtgatcttcccaccttggtctcccaaagtgccgggattacagccatgagccattgtgcctggccgaatttctttttacaaattctgctcgggattcattagatttctttaacgtgtagagcaatttctttctttctttcttttttttttgagacggagtctcgctgtgtcacccaggctggagtgcagtggcacgatcttggctcactgcaagctctgcctcccgggttcacgccattctcctgcctcagcctcccgagtagctgggactacaggcgcctgccaccatgcccagctaattttttgtatttttagtagagatggggtttcactgtgttagtcaggatggtcttgatctcctgacctcatgatctgcctgcctcggcctcccaaagtgctgggattacaggcgtgagccaccgcgcctggccgtgtggagcaatttctttaatcagttctggaaaattatcagccattatctcttcatatattgcctctattccattaacttttttatcctgtgttattatttatttttgaggtagagtctcgctctgtcacccaggctggagtgcaatggtccgatctcggctcnnnnnnnnnnnnnnnnnnnnaaaaatttaatttaaaaaaattttatggctgggtatggtggctcatacctgtaatcccagcactttgggaggctgaggcaggtggatcacttgaggtcaggagttcaagaccagcctggccaacatggtgaaaccctgtctctactaaaaacaaaaattagctgggcgtggtcgcgcatgcctgtaatcccagctacctgggaggctgaggtaggagaatcgtttgaaccaaggaggcggagtttgcagtgaaccaagatcgtgccactgcactccagcctgggcgacagagcaagactccacctcaaaaaaaaaaaaaaagttatgagtacatagtaggtatacatatttattgggtttatgagatattttgatgcagggatacactgtaataatcacttcagggtaaacagagtagccatcacctcaagcatttatcatttttttgtgttacaaacattcctattcttttagttactttaaaatgtacagtagattattgttgactgtagtcactctgttgtgctatcaaatactagattttattccttatatctaactttatttttgtacccttacttacttttatttctggttgatccttaccttgaaagtgtagtctttgggattccagcttaaaatgggggtgttatcagagtcctcatctctgagggcccctgagcttcgactatcatctctcccaaccccagtcaaagcccagaatgttgcctaaaggacagcttttggccaagccaacagggccaaaaaaagggccagctggttggagtcctgagtacccatcaggccttgcgggaggtgctgtaactgcctatgctactgtcctcttatttgggcaggcattgggtcaaggaggagcagaacagaccctttcgtggtcagaatgtttgcctggcttatgtccccagacaaaccagggctcatcagtctattgttctgcttttcattccagcctaattcagtggtttgagacagcaccaagtcggacctgcccacagtgccgaatccaggtgagagtattggggtgggaccacctcaactgaagagatctccttagcagagagcaggaatgtgaaaagagctctgaaactgcaatatctctgaccttttttggaccctcctggtttaaggccagttgagcctcacttgtgcccttgagtgtttgggaggtctgcttacacccacaggtagctggcagatggacttgttgcctgggccagttttcacttgggtagatttggctggcctccttccctgtcttttcatcagtgactccgcacctagagttcaggtatcttttgagcacttaaccgtgtaggtctgtagtaatatgacttcagtgaccacgaaaccagcagccccaacttggggtacctgcaggagtaaagaggtcttttgactctaaaggatgtactttgaaaaattaggtctgagaacaggcctgacatgcatgtcaggcaggtagtcagacccatgtacaacactctcctccttgcgcatgacccagctacacaatcatactcttaccttgttctcccatccaggttggcaaaagaaccattatcaataagctcttctttgatcttgcccaggaggaggagaatgtcttggatgcagaattcttaaaggtacccagaatttatctgattctactgaactccaagccttgtgcgagttcacttttcttttttcttttcttttcttttttctcttctcttctcttctcttctcttttctcttttcttttcttttcttttcttttctttttttagagacagggtcttactttgttgcccacactggagtgcagtggtgcaatcatagctcactataacctcaaactcctgagttcaagggatctccccacctcagcctacctagtagctaggactgtaggggtgcaccaccatgctcggttaatttttttattttatttatttatttatttatttatttatttatttatttattttgagatgaagtctcactctgtcacccaggctggagtgtagtggcgtgatcttggctcactgcaacctctgcctcctaggttaaaacaattctcctgcttcagcctcccgagtagctgggactacaggcacgtgccaccatacccggctagttttgtgtttttagtacagacggggtttcaccttgttggccaggctggtctcgaactcctgacctgaagtgatccacccacctcggcctcccaaagtgctgagattgcaggcgtgggccaccgtgcccagccctaatttataaaaaaaaatttttatagagatagggccttgctatgttacccaggctggtcttgaactcttgggctcgagcaatcctcccaccttggcctcccaaagggctgagattacaggcatgagccactgtgcctggcctgggagttcactttctatttccacataagtggagggttcctggaatatggagatgaagttatagaggtgagacttggtacagttttcaaggtggggacacaaaaatcagaggacaactgatgagacacagtcatcagagaaatgcactgtgagggaagaggggagctgcttgactgtaaaccctccctttgggatttcaggtcaattccaacctgaattctctcctgcggtcttgtctcctcatcttttaaagaacctacagccatcctgtacagcctactttgctgcttggacagttagtgacagattagaaaactcttctactccccagccacgggagatttttggattcagtgttccctagcctgcctgtgcctcaaaattgcctggggaggctgggcgtgatggctcacacctgtaatcccagcactttgggtgaccaaggtgggcagatcacttgagcccaggagttcaagaccagcctgagcaacatgggaccccatctctattaaataaaaaaagttaaaagaaaaaaaattgcctagggagcttggtataaagtcagatgcctgggccttccccagaccagagctcttggaatcaagagttgcagctcaggtgggaatggatatattaggggaaagtgggtagtttccctcctatacgtctaactgcttcccctcctaatctaaaatttagctttttttgtgtgcaagcaggctgcgttggcagagaactcttgaggaagttggatttgggttcacaaatgatccctggactctgagggttaatttgctggatatctgtcagatcagagttcatttggctctggccccagggtgtcatgatgtccttggaacctcactgcttcaggaacatggagcttttgtgcttagagcaagcatgttcatcgtcatggtaactgctcccagttttaagtagtgtcttccctgtgatgaaggcaacaaaggcagtttcatttatttccagctttcaaagccaggtttgtgagacaggtagcaacatcttgggtagtttggagcaagggcttggaagcccctgctggagtgtggaagaagtcaggggactatgggtagtggtgcagcagccatgtcctggtatctgttctcaggcagcccttgcgtgctcttccttacccaccacctccactcccagctgttcagcctatgctaaccagcccagccaccagaagctcttgcccccagagtcctaggtggagagtttgacagtaggggcttgtttacccactgggcctgggccatactattggtcacatgtgaaattctgagtcttctgttgatcttagacaagtgatctacagtaaggtttgcctggattccatctagctaccaccatggacccttggtcaagcgtttcagttttgtaaaaccttggatttctttgttatggagcaggcacctctcttgctcatggggatgttgagttctgtggcatcctgaacaggaactgggttcaattctgccacagcttctcaatgattctgtggcatggctgtgaaacatttgcaggggctttgagaggctcacttgatcctcacaatagtctagttagagactagacacatgggaggtttcatccaggggtacaaagctgtcctggcatagctacctccattggatactaggtctggaaggtttgtggtacacagagccagttcagagcttggaggaaagtcgactatgaatcaggaagacccagggtggagaggaggagtagtcgcccaaggtccttggccattcctattgtgtgtccctggtgagtcagctgatgcccagagggaatgagaccaacatagagcgatgaggccaaggaagtgatagaaacttctgctatggagactgatcacaggggccctactttaacttcccttccactattctacctctttacctgtcctggggccttgcccctgagattgttttcctccatcttacctacttttcaaaagggcacatagagctacagcagtgcttatctttccattgttagcttagcttggccttgaggcactgcaggattcatgccctagaaggcctcattgttcaatcctggggctccccacagccttatgggagaccacgtggaggtcagctatgatgctttcctgctgcttattgtgggtattgcctttcagaatgaactggacaatgtcagagcccagctttcccagaaaggtgagttagcaagagacgaggggtgctgggaagcccctgacttggatgctggaggaagggggccctaggaggaaggtttcaaaccgtttgggagagccagggcctttccctgctttgtatgtccaagagtcctgctagctgttgtggtgggcagaaaaagagagggaagggaggtgactgaagctgttcacctagaccaggtgagcctcttgtctctgagtgcagcttcttgcccaggaaccaagatgggagggggttacctgatgggactgaatatcttcgggagagggctcagctgctgagtttggctggaacctgcttgagtcctgggttgatgaactaactggacccatggcaggtagggaatgggcagtaaaatattttcctaagtagttcaagcagcagaaggtgggcttttccctgaatgaaggctctggctcagcttctctggtttggcacatcccagagaaagaagcgggccacccagctttcaggcctgagccttgtttctcacctgcctaagggatgaggcactgaatccaagggcccaagttcttctgctgatggatggacaggcctttccctttcctccgccctctacccctgctccagacaaggagaaacgagacagccaggtcatcatcgacactctgcgggatacgctggaagaacgcaatgctactgtggtatctctgcagcaggccttgggcaaggccgagatgctgtgctccacactgaaagtaggtcctcaggttttatgggtacagaattcatagggaggtattgccccagaactggactccccattctgggcttatcttctggttctgctccagtcatcaccttggtttggggagttgtaaaatagaggcaaatcacttcttccccttgcccttccatactgtacccatccatcccataagaaaagggccatattggctatacttgtgggttttgtactaggtagtttgaagagtcaaggccttcccagtacctcacagaggggatgctcaactaagacctcagtgaggctgggccatatttccgaaagtggttcatactctactgatgaggccagcctgaagaaccttccattagcactctagtccttggctgggctgctctcctgagccagatcaaacagcatcctagggaggagcaagggcctttgaagtcagctgtgctgagctgaccaaccagatcaaagtctgcagagtgaacagccttagacccagatgaattttgcatcagcctgggttggtgagcctcttgctctccaaggggcatgagaggcgattgatctgaacccacgattgatattctggccttgtaggcaggagcagtccttgctggatgccatttgaaagggaaagggagccatccttgtgaacagacaaggccccaggatattcattgtctctgttcctgcttgggggctgggctggatcacatggtctggctggtgggagggagcaaactggcacctggctgcagagcaggagtctctcatggtattctcaggtcagagacaagtggtcttaggctgaaggcagcctggccagcttcccctggctcaattattcattcttggcaactgtccatgggtctgggtgttggatggtgaggcctgggtttgtgctctggacttcttcagccacctgcacaacatgtaccatgaggcccagaccactggaccttggcagcccacagtgggcctgtaaatgctggcagtgggctgtgtctactgtaagatacctttcaggaggaagcaggcagggaggtgaagaagcagctggcttagagccttttagaagaagaagcacaagcgagagtgggacccaggagctttacctcctggggtttgggagtacatggttatcagcattttcaaaacataagctgcagagagttctggagcagagttttcctagtgactttagcaatggctcctgagggcctccaagcatcaggtatgggtgtatttgctcttcagaagcagatgaagtacttagagcagcagcaggatgagaccaaacaagcacaagaggaggcccgccggctcaggagcaagatgaagaccatggagcagtgagtttggagctgggtcctgcactgtgcctttgcccccagggcctgcaagtggtacagttcttaggactgcagcagggagtgggattgggtcatgtccgaggctcaaatctccataggccatggagggctcaggtcagctgggtgtgggcacagatcttagcctctatgaactcttcccccattccaaggaatgggagcccttgccacattcctccctgtctctgctgcctgtggccagatgacctggtgggtctttccttccagaaacctctctccaggaaatccctgaccttgagaccctctttcagcacctcttctttctcagcagcatccttggagctatgctcatctctgccacagggcctttccttgggcacacccacctactaaagcatcctggcagcctagcctgttaccttagcaacggcagcaaaggaaggcagagcggcactgggtacctacccatcagcctccagattgcaaatgccgtgggctgggtgtatttttcaggattgagcttctactccagagccagcgccctgaggtggaggagatgatccgagacatgggtgtgggacagtcagcggtggaacagctggctgtgtactgtgtgtctctcaagaagtgcgtactgtggcccctctcagcaaacacaggagataggccatggggccccagccgtgtcattgctccccatctcttgtaaagcagatggaactaaggggcaaactctggagccatgctgcctttgtttgaaccctgattccacctttcagcaactatgtggcctgctgccagtttcttggcctctttgaccctcaacttcctgaatggaaatagtagtagacctgcctcataggattgttgaggatttagtgtgaatcttaagtgctgtttctaagggagttgacctagctctctgggctataagccccattgtgattgatatgtagagcctgttccccattagcactatgatcctgcctggctgggatcaaactctactcatattcttcactctggtgggtgtaaggttggcaggaagggtggagggccacttagctgagaggcatagagggtccaagatgcctcctttaagaccaggtggtttagggagccccctagtgagactggggctttctgcatgccctctcaagtcaccagtgcctgcaggacaggcaggaggaaatagtcacttccttgcattctctgcaggaccctccacagtgctacctggtacttgttgggctcaggtgtcaaagtaggaatgagagtgagttgaggggttgggcagtgctttgtgttagattagtgctgtggctcagtctgacctgcaggtgttcttttctggcatctctttccatggccacattgcagagagtacgagaatctaaaagaggcacggaaggcctcaggggaggtggctgacaagctgaggaaggatttgttttcctccagaagcaaggtaacttagcagtgaacagaggttgaaggagaagtggctctccttttgtcatgttcactctggtctcctgagcaaggccatgggacctgatggcacagctgactccctggggcagctggaggacttacagaaatttgttaccagtccttactgggcattggcctgaatatgtggcttgtccactaggggtggacagatcacagaggtatcccccaacatgtggacactgatgctcccctctgctcttcctggctcctgggtacctctcagctggctggagagcacaggcctcaaatgtgacagcgtcagaggcctatttttgtaccacatctggagtaggagggctcctggaacctgattcggtcagcacagctgcttttacttctggcatggtgcatccacaggctgcaggatgtaggaagcagcctttgcttctaggcagctccggatgtgcattgccagactgaggcctagcctcagagagctgggatctctgcccatatctctagtctcttctgggctaccttgatcactccctggggagcagcaggagggggcagggcacaaggctaccacttggcttgtctttcattccctacactttcttatagttgcagacagtctactctgaattggatcaggccaagttagaactgaagtcagcccagaaggacttacagagtgctgacaaggaaatcatggtgagggacatccctggcttgacaggaatgaggggtggtttgtgtgccctcccagagcagggctgggctatctctgcccaggacccttgcaccagtcagtggtggttctgggcccctgcatcctcctgggtcagggtgtgccccttggccctggtccggactggagcctgggcctcctcaacagagggcagacagaaccatgagtcttccctcatagtctgtcctgcacttacatccctgaggtcccttatcagaggaggggctctacctggggcttggcctcctgagcctaatgatgaggtatcaggccttgctctgttcccagtgggctggcctttcatgcatgctgctcatgtcctctgcattatctccggacttgatgcctcagcctttctctcacacacttttctttccctccccaagagcctgaaaaagaagctaacgatgctgcaggaaaccttgaacctgccaccagtggccagtgagactgtcgaccgcctggttttagagaggtttgttgagccttgggcggtacaggggtcacaaggtgggagagctttctggtaacagtctttactcctcctggctttggtggggtgggtgacctctgtggacctgatgtctgcagacagcctgccctgggagccagccaagatttagctggcaagcagccttgaagcaaattaggctctgacacggagaggccagagaaggccagaggacctagaagtggtctgagaatagggcagaagcactgactgtcttggggcatcctgtttatggagtagctccccacatttatctgtccaccccagattttgaaacaaatatgaaaccactgtaaaataattcccttagtgccaggagtgcgtgctttaaagctgccagcagagggagccacgaggcagaaggattggtgtccctgcaagcatgggcatccatttctgctcctgagagtttcacagaagcagactagctgagagcatcctcaaggctacctcctgcctgccaaaagtccccagcaaggacccagacagaaagcacacaactcctgtcagtggccccagtcttttttttttttttcctttttctttttttaatggagtcttactctgttgccaggctggagtgcagtggcactatctcggctcactgcaatctctgcctcctggattcaaacaattctcctgcctcagcctcctgagtagctgggattacaggcgcgcaccaccacgcctggctaattttttgtattttagtagagacggggtttcaccatgttggccaggatggtctcgatctcctgacctcgtgagccacctgcctcggcctcccaatgtgctgggattacaggcgtgagccactgcgcccagcccagtctttaatcttttttttttttagatggagtctcactctgtttcccagactggagtacagtggtgcgatctcggctcactgcaacctccgcctcccaggttcaagcgattctcctgcctcaacctcctgagtagctgggattacaggcatgtgtcaccatgcccagctaatttttgtatgttttggcagagacgggtttcaccatgttggccaggctggtcttgaactcctgacctcaagcaatctgcccacttgggcctcccaaagtgctgggattacaggtgtgagccaccgtgcctggttgcttttgtttactttctttacctcttcagggtgctggaaggcctggactcctacagcaggtccttgatgagtgcccactgcatggcagaccttctctgttctcttggagcttatgttccagtgggatagatgagcttggagcttagatggctaagcccacagccaaccagctatatactacattatagaatctggtctgtagctcccagttggggacgggcccacctcattctgagtaagcttcatgccagggcctgcagcccatcttggtacagggaggacagcaatggtctcccttggctttcaggccagcaggacactaaacttgacaagccttcttctgtaagctgggctgggcttctcatcaagccacatgaggatgacttcattcatttttgtctccagtatttttctgggcataaatattgaagtggttggctgggtgcattgactcatacctgtaatctcagtgctttgggaggccaaggtgggaggattgcttgagtccaggagttcaagaccagcctgggcaacatagtgagaccctgtatcaaaaaacttaaaacttagccaagcatggtggcacacacttgtagtttctagttactcaggaggccaaggcaggaggatcacttgagcccaagagtcgagctatgattgtgccactgcactccagcctgggagacagagtaagaccccgtctctcttggaaaaaaaaaaaaagtccgggcgtggtggctcacacctgtagccccagcactttgggaggctgaggtgagtggatcacctgaggtcaggagttcgagaccagcctgaccaatatggtgaaaccccgtctctactaaaaatagaaaaattagctgggtgtggtggcaggcgcctgtaatcccagttacttgagaggttgaggcaggacaatcgcttgaccctgggaggtagaggttgcagtgagccgagatcgtgccactgcactccagcctgggtgacagagagactccgtctcaagcaaaaacaaaaaaaaattacggtggcaggtctgtttgtttttagcaaaagcccttcttttaactaggcattaggcagcaccagcacagtctattcttgtgtttgtttgttggtttgtttgttggtttgtttgttttgagatagggcctcattctgttgcccaggctggagtgcagtggtgtgatcacagctcactgcagcctcaacctcctgggctcaggtgatgtgatcctgcctcagcctcctgggtagctgggactaaagtgctgggattacgagcgtgagccaccatgcccagcctaggcacagcctcttctaaactcatagcctcaaactctcaaaaatagttgttgaatcctcagcaacggcattgccctgtcttctttgtgttctgatggcaagaccctcagaactacaagtgacctcaaagactctgcctctacctttctcctgtgactgctaatgtgttactacagaggtctggaagaagtcttaagttttcttgggccacctactcgggaggctgaggtgagaggatcacttgagcctgggaggtcaagactgcagtaagtgatgatcacgccactgcactctagtctgggcgacagagtgagacctgtctcaaaaaaaaaaaaaaaaaaaaaaagtcatgtcaaggaagatggaagagtagaaagctccaggaatccatctctccatggcaacagttgatctggttgaaaccatctgaagcaaccactttggaaatctggtctagtagaacatttccagtatccaggggagagggtgatgaagaagctggtaaacttcagtaaattttcactgttctcatagcagctccacctcctgggctcaagtggtcctcctgcctcaatctcctgagtggctgggattgactacaggcatgcaccaccacgcccaactaattttttgtagaggcagggtctcacttattgtccaggctggtcttgaactcctggcctcaagcgatcctcctgcctgggcttcccaaagtgctgggttacaggcgtgagccaccgctttgctttgctttgctttgctttgctttttctttttctttttccttttcttttcttttcttttttttgaaacagtgtacttgctctgttgcctaggctggagtacagtggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccggttcacgctattctcctgcctcagcctcccgagtagctgggactacaggtgcccgccaccacgcccggctaattttttgtatttttagtagagacagggtttcaccatgttagccaggatggtctccatctcctgaccttgtgatccacccacctcggcctcccaaagtgctgggattacaggtgtgcgccaccgtgcccggccaagaagtttcttaagttttttaagaagcttcttaatttttataactttttactgcagcagtattttttattgtagtaaaatataaacaaaactcaccattgtaaccatttttaagtacatttctgtggcatcaagtacatttaattgctgtgcaaccatcaccaccatcccactccagaatgttttcatcttcccaaagtgaaattctatacccattaaacaataactcccctttcccctttctcctcagctccttcacttaccattctttctgtctctatcaatttgactactttaggagcctcatataagtggactcatacaatatttgtccttttattactggcttatttcacttagcataatgtcttcaaggtttatccatgtagcatgtattagaattttcttcctttttagggctgaatcagtaatcatatttaatttttttttgagacagggtcttgctctgttgcccaggctggagtgcagtggcacgatctcggctcactgcaacctccaccccctgggttcaagggatcctcccacctcagccttccaagtagctgagattacaggcatgtgccacaatgcccagttaatttatttaattttattttttgtagagatagagtcttaatatgttgcccaggtcagtattgaactcctggcctcaagccatcctcccacctcagcctcccaaattgttggtattacaggcgtgagctactgtgcctggcagtattcatgttttaaatttgcaagcattctttcttgctctttgagtatgtctgttttgcaaagcatcatgttcttgttttatggtctcatatttctgtttgtctcagagtcagtatttgtgcaccatggactttttcctgggctcccctcccatacctggtggtccttggctactttggaggccaacctatgtgggtagggtttgggggggatgtgcagactgctggcatcatgttgagtcttacctgaacccaggatgcagaaggctttactgttgggtccaataatattggctgccctaggtcattgtacatagtttgtttagtgtctttgagaaaagctcttctatttattggcccagggcagcagcctaactgcctagtgttctaccaatgcagattaggatggggtggagccaagctcacaatttcatcagtgttccagttttcaggcctgtttaatgcttttgcaaggccctccctttccttcatggaccccctccttgtgggttctggctgctgtgtcagtctcttgtcccctggccatgctttgtctcccagaattttttggaaatctctgggggctgatggtggttgccccttctacttgttgcagtaggattacccttcatacctgtcattttagggaggcatcagcatgtagccaccacccccaactacagagtcaatgttaggaagatctctctcatggaccccaagggcccctgaactccaggctagagacagccagggagacctttccttagggtagggtaaggccgccaggagccatgagttcatggaggagatgttgactaatcccatgccacgcaggcaatgggctgctcaaggccttagctctgttctggaaaggggagctttgagtgtcttgcctggctccctgaggcctctggcatgaagccctgtaacttgaccatgggtgggtgtcccaagggtgatagtgtcactcaggagggcctcaagccagcctcaaccagtgagggaaggactactaagccctaggttctttctccttgtaggacaaacagaaagtgggaaggaaagaaagtggacccctggcagaaagggaaataggcttcaagctcatgaaggaagaagaatatagaaacagtctaagacaaggccgggcgcggtggctcatgcctgtaataccagcactttgggaggccgaggtgggcagatcacgaggtcaggagagcgagaccatcctggctaacacggtgtaaccccatctctactaaaaatacaaaaaattagctgggcgtggtggcgggcgcctgtagccccagctactcaggaggctgaggcaggagaatggcttgaacccggaaggcggagcttgcagtgagccgagatcgcaccactgcactccagcctgggtgacagagcaagattccgtctcaaaaaaaaaaaaaagaaacagtctaagagaggaagaaatgtgtccatatgatccagatgtggatatggggagtgagggaggcaccgtgagaacctcctgagtcttgagtttagtgttgtggatgaccaggaggtgcaagtgaataagcctggcttgccttgagcttgggcaccactaggcaacgccttaggggatggctgggagtagaaagtcctgccttgagccacctggagggtaaaatttacaggacccagcgagatcctgccttcctcttgagtttacctttcctaacctgagcctcaacttgctggggttggtaaatggtggcagaatatggatactgcaaaaaagttggcatgagtggtcctggctgctgtggttcccagaggaggaagcaaagcagccagcctagagttggtttgaggtgggtttgtgcagtcttcattttaacttgcaggcggggacagaggtagagcttctagggtcctggacagggaaaggaagaaatagtccaggctgcctggattgcttagccacccaaatcaatgcaggtaggcttcctccctctgatgtgtacaccccagtggaagtgggattgtggtgcagctctgaaaagttcctgaggaaggaaagagagaaggcatctttggagctacccttgccattccccagggttctccttgtatgacaggaggtggggagccctgccaggtctgggtgggctggaagaatcctgtcggctgtagttttaatagannnnnnnnnnnnnnnnnnnnnnnnnnnnnnnnnnnnnnccccccccccggtgttataaaagtaaaaacacactcattgagaatttggaaaatagggagttatcatagaggtacttatggttgacatgtggaatatttccttctcctttttctgcatgtgggagtggtgggggggtgccaaatcatgtaattgcactatacatggagttttgtgtgctttttaaattaaattaaatttaaacttttttttttttttttttctgagacggagtcttgctctgtcgcccaggctggagtgcagtggcgcgatctcggctcaccgcaagctctgcctcccgagttcaagcaattctcctgcctcagcctcccgagtagctgggactacagacacaagccaccacacccagctaatttttgtatttttagtaggatggggtttcaccatgttagcccgggtggtcttgatctcttgaccgcttgatccacccgccttggcctcccaaagtgctgggattacaggcgtgagccactgtgcctggccgagagtagggctttcttgaggggtggccttgagtcaggagtgggctccaggtccctggagctgagttatctctgatgcttcaggagctgttgtcctgggttaccactgtggccccaagtaaccaggtcatctctgccttcagcccagcccctgtggaggtgaatctgaagctccgccggccatccttccgtgatgatattgatctcaatgctacctttgatgtggatactcccccagcccggccctccagctcccagcatggttactacgaaaaactttgcctagagaagtcacagtgagtgatagtcgctggcactgtccatgggctggtagggggatagctaagacagctctgcaggccctgtgctgttagctctgagtggctgatggggcagtgagggttgcctaggcttggccatggctttggttccagctacctcttgttccctcacctgagcactcaatctgtgcaaaccccttctcttgtctcattattcctcaccatcacctttcaaggcaaacgtattggaatgcaagttagagagaatgcagtgatgccagaaggggtgggtctgggctggagagggtgctcccaataccttgaaggcctgcccaccagagtcctgagcgagggactctgaacttcctcttctatgtttgcctctgaggctcatgcctgagggaggatcatctcaaaccacagagcccaaggccttaccacccaagggggtgacccacaggggcaagcatgagaagctgtctggaattccagtggggcaggtggaacctgctctggggtacagtgggaccagaaaaagggaggctgtctccttggccaggtttgccaagtgtaattcactgtggagacaaggactatactcattcatacaggtactgttcaggtgaggctggtcaagggctgggcaggtttcctctttttcaaagactttgtacagagagaaagaagagaaagagaaagaaactgagatgctagacagtggaggtggaagggagcaagagggcaagccagctgggctgtcctacctcccaaacctcagggggcatgggcacccctgttgtagagggcgaggcctggtagcaatgagaaacaaacctaggacccgtgggctgtagtcctcagggatcctgtcagtgtctgctgtgtactctggcttcctcccattgcccttcttccgctgtaaaggttgaaggtggacacctggggtcttcaggctgccaggcctttcagagacatttccaccaccttcatggcctgtggaggtagtgaaggaggtagtgaagttctgagtccctaactcagctcgtccttcctggagccttggttgtcatgtagccttaccacaggccgttagggcaggagcagaggagtcagtcatcaggccctgatcccactcttgtccttatggcttgagaagccacagggccagccttagatcaccatcttctcacccaccagggaaaatgccaggagagggtatccagctgctgggttccccaggaattggatggaaatacagtttctggctctggggctgggattgggagaccagggcctggggccatgcgctattctgccccaggcccttcttagacacactctctagggagatggcttggccctgtgttctgagaggattttgtgggctactttactgaaaggctaacttactgaggctctcgtggaggtagtgtcccctctctgggaagacaggactaggcctgagctcattaaatttcttttgctcgtatcagggcatgactggctttcctcccgtgggtggtgagttgattgggctcttcagccccatatagagcctgggacatggtgaggtgcccgaggacttgaggagcgttggaatttggccttgagtggaagccacaggattgggacatggtccagtcatccccagtcatccctgtctctgccaccctactggctgtggctgtccagctgttaacagacctgcacttggggtgggatcactgaggtgccttgcccagaatgcaggcatggcagcagcagtgccacatggtaactccccaaggggcgtgtgctgagcctggttcacctgcccccatgtcttgcttacctaccccttgccttctctctcattcttgtagctccccaattcaggatgtccccaagaagatatgcaaaggccccaggaaggtaagagctttctagaagaagcacagtctaacctttggcaggactggacttttgggagggcacggtcttgccagagccttgtcactcctggtccaggactgaggtacttcggagccacccttgggattctactcattatccctcctgcctcctagtgaggcatcagagatcctgatcttgttccaccaccactaccctccctcctttgctgacatccagctcatcaagtctggccctggggtcttccctgcaggagtcccagctctcactgggtggccagagctgtgcaggagagccagatgaggaactggttggtgccttccctatttttgtccggaatgccatcctaggccagaaacagcccaagaggcccaggtcagagtcctcttgcagcaaagatgtggtgagtgtggcttcccacagtggcaggagccagccctcttgggtagaaatgggtggccagccccccagcccattagcctggcccactcatctcttcccttccaccctaggtaaggacaggcttcgatgggctcggtggccggacaaaattcatccagcctgtatccttttcctgtgatgttgagctgagctgaactgtggagcccatactatgcctcacctatacccccagcctgccagtgccaacagcctcaggtgtgcagtgctgggcctcattctgtgtatcagcgccgcccacccccggctctgagcctttcttgccctgcattgcagtcctttctcgccctgcattgcagtcctttctccatgcctcttccttgacagctcctccagactgacacagtcatgatccgcccattgcctgttaagcccaagaccaaggttaagcagagggtgagggtgaagacagtgccttctctcttccaggccaagctggacaccttcctgtggtcgtgagaacagtgagtctgaccaatggccagacacatgcctgcaacttgtaggtcaaggactgtccaggcaggggttttgtggacagagccccactttcgggaccagcctgaggtgtaagggcagacaaacaggtgagggtgagtgtgacacccagagactgctcttcctgccctcaccctgccccactcctacgactgggagctgacatgaccagcccactgatcctgtcagcaggtcctgctcctgttgccaggctcctgtttatagccatgatcagatgtggtcagactctttctgggcctggagaccacggtcacttgttgactgtctctgtggaccagagtgcttgaggcatctcaggcagcctcagcccaagcttctacctgcctttgacttgcttctaggcatagcctgggccaagcagggtggggaatggaggatagcatgggatgtatggagaggatggaagattttcatgtaaaataaaattaaaaaaaaaaaaacaatctcttcttcctggttctgagagtgtaaatttgcaccaacactttagaaaactgtttggcatgactttctaaagcaggaacatcgccaagcctcagatccagcagttccttccctaggcatatgccttgctgcatggggcacaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12536 - DNA, 57560 bp, Human
ccagcctgggtgacaaagtgagattctgtcgaaagaaagaggaaagaaagaaggaaggaaggaaggaaggaaagaaagagaaagaaagaaagaaaaagaaagaaagaaagaaaattagctggtgtggtggcttatgcctatagtcccagctacttgagaggctaggttggaaggatcacttgagcccaggagtttcagactgcaatcccgcctgggcgacagagtaagacccctatctaaaaaaaaaaaaaaaacaaaaaacaaaacaaacaaaaaaaaaacgaatgaacaaataaaaagaaaaaagataggtaaacataaagaaaaattaactcatcattcaatcattcattcattgttgccaccgacattagtagaaattaattaaatgcctactatgtggctgttctggggcagaggagaagcaccaaacatttaagagtatctctgaaggggtggaattaccacgcattcaaacagcccttccaccaatgtttactgagcatctacatgccaacagtgctggggcactgggaatgcagcagtgaacaaagacagaaatccatgttgtcatggggctgacattccagcagaggagacaaccaacaagcaataactacaattaggagtgagaaataagaacaaagcagacagagtttggtagtatgtgagagggatgtttgctgctttccttagggtgagcgagggaattagttcacagagaaagtgacatctgtgtaaagccctgaaaaaagggagggagagataaggatacctgggggaagagtatgttccaggcagaggaacaaccagtgcaaagactgtgaggtgagagcgcacctgacaagagttcaggaacagcatgaaggctggagtccagtgaataagatccaggaggagagatgtctggccgggcgcagtggctcacgcctgcaatcccagcactttgggaggccgaggcaggagtatagtttgagcccaggagttcgagaccagcctggccaacacaacaaaactctctctttaaaaataaaagaaaaaggccagcttggtggctcacacgtgtaatcccagcactctgggaggccgaggcggatagatcacctgaggtcaggagttcgacctggccaacatggtgaaacgctgtctctactaaaaatacaaaaaattagctgggtgtggtggtggacgcctgtaattccagctactcaggaggctgaggcaggagaatctcttgaacccgggaggcggaggttgcagtgagctgagatcgcgccattgcactccagcctgggcaacaagagcgaaactctatctcaagacaaataaataagtaaaaataaaattaaaaaaaatttttaaagatgtctgctgtttgttttcaatattttgaccaattacttcgtaaaaacttatttaaaaattgaagagcaaacagtctcaggttcccgggctcagacagaccagcgttcaaaactcattaccttctttctatgatgctaagccagctatttcaccctctgaacctctgtttctttatctgtaaaatgggtattaatgatattataccacagggttgtatatgcagcgagaaaatgcaagtaaaacacttatcccggtgcctgcctcctagtaagtgcttaagaactgtttctgcccattaactcattactttctcccagcccctaactccttctgggggggaagttagaaaatcggtatcacacgaaaacagtcatttcccctttaaggacctcagtgggccgggagccagccttcccgcaccttttccaaaatttccaatccccgcttggcattttctgcccgaaggtctccgattggacgctctgtaccaatcggaggctggagcgggccctgagaggcgcccgactccgcccccgcactggccctgcccactgcccggtcagcctcgttgctatggggactggtgggcggtgaggggggaaagccccggatgttcgttggggattcaacatggcggcgggagtgtccgcggtggtggcggtgcaagagagctgagggaggcgcgagggcgcggagttccaggtcgagcagttaggccgcgagcgactgcggcgccgagccggtaggataaggggtccggccaggggcttgcggtgggccgggcgctggcggcgggacggcgtttccgcgaggaggggggcggggccgccggggtcaaaggtcactggtggagggaagggtcgcgtccgaggggtcgggggttaacgcagactggagggagttgtagtggaggtcggagatcaaaccagcgaagggggcgtggcgaaggggagtgcaaagtttgaaattcgaagtgggggcgcgttcgaggggttctgggcgagtctcaaaaaaggcagggtcaaagttaataatttgagggaaggctgcccccacgagggtcagaggtcacagccccaggggcgccaggttggaggtttaaagctgcccctagcggagcagatgaatgagttttaggttcgggggcgtcttttaggggttcaaagctggggcgtgcctagaaggtacaaaggtgagaatctgacagcggggcagctgtttcccagagtcaaaaattaaaacccaaggagggcgtattgcgggggacggggagggggggggcggcgggtcagagatgcttcctggtgacaggagaagggggaaccctcccacaaataataatggcaaacactcatgaaacactatgggctagaccctctttttaacgctttacttgtatgagcttattcagtcctcactatagtcttagggggtcttaacctggtattaagaggttaagtgatttgcacaaggtcacccgatgcataagttgtgcgctgggattctaactccggagttctggcccagagccctgctctggccgaccgcctctcaaatcatcataatgtcggttaatgtttaatgagggctcacactgtgctccacgccctgtgtgcccggtcgtatttcactcctgctgcaatcttgtgaagtgagtgctcaagatgaacctactttacagacgggaaaaatgaggctcagaagcttctgctgaaggcagagttagaatcgaagctgggcctgggtgattccagggctcctgcccctggtcgccacattgtccgctgccagccattaggtctctcctggaagcagggggctgggcagggctgggccactccctgggcggatcggattgtctgcttggtttccttggaagggtgtgatctggcagggaagattcctgtgagcctatgggagtagggtgtttgtaggtggtctggagtccgagcaagggagtccgacgggcttctgactggggagagtgtccctgggtggtaccctgggcagagcggggtgttcactgttcttaaaaccctaagctctcactgtggtccttagtcactcccacctcacttcttatggctctgcccatttctccccagcccctttactgttctccaactccaggcccatgcctcccgcccggtctttgaccttcctgttccttctgctgggaatcctttccccaccctgccctctctcactgacgggtcgctcactctcagctggcccgggaccaccctggctcgccttgctgcaggctctttttctctcatctgaccagcccttacctccctccttaccttaattattagggtgcatggtggaattgctctgtggggttccttgcctcggtccccactgaagccctgcctggcctgcagaggatgtgacattgctgggggttgactgttgggcactgtgccgggtgctgggagtgtggcaggggacgagatccacagagcccctagcctcagagggcactcagttccctggtgggagcagagtggaaccagcccccaagccagtgacacaagactgcgtctctgcaaacggtgatgtggcttgcgagggcatcttcagagagccgggagagtgcccctaccctgggctgaagcctgagtccctttcccctgggaaggctctgaaggatggggaggagggctgggaatgggcttaccaggcaggaggagcagtgtgtgcagaggccctggcatgactggaggtcaggactcgggtgcacagttggggatctgggcaacacgtagcctgtgcaggttcagggcaagaccctgaggggactcagctttggagggacggtgggagcaggggagggctgaggagtacctgtatgtgtggagctgcctgaggccttgatggagcgtgattcagaaagcagtgctgggccagagatgcctggtacacacccctctccatcactcacagagcatgtgaggacctccgtttccacttctgcaagatgggcatagtgttagcgctgcctcatagaattgctgtgaggatgcaggctagagagccttggcccaaggcctggcatacagtagttgctgtgtaagcattagtcttgctgctgctgctgctgccaccccaccactgcctggggagggcctcagagacagtggaggccctcgctccacctgcctcctggctttctctggcagccaccccatccctacctggctctggcagggtcagggagccggcacactgccaggcagccctctgaggctggcccagcctcccagccttgcagtgccagctcactcagcatctcagggtttggcacagataaagaaggatagggtttgggcattggagacccatattcaggtccctcccttgtcacttaccagccatgggacaaatgatttatttgccacttttattccttcaacacgtttggctaggggaaaaagggctttcagtataatgaaacactcatgcatccggccatcgtctggcctgggacagaacacaccgtgatacagttagaggccaagggtctcctcctcaccccccctcctccctcccttccaggggcagcctctgtcctgggtgtggcagtcaccattcctctgcagcctttcatactttgactgcccttgaatgtattcaccaacagtagagcaacagctcttgcccctggctgcacattgcaactccctggagagctttgaaaagatgccttggcccaggcccgccatggaaattctgcttccaacttacttggtctgggctggggctggcctcaggcttttggaagctccctgggcagttcttatggccagcaggggctgacgactgttgtttcacagttcagataaatggtgtcaccataaacatgcctttctgcaagttgctgtttttgttcaacattataggtatatttgagatgggatcttgctatgttgcctagactggactcttaactcctgggctcaagctatcctcccacctcagcctctggagtagctgggattacaggcgcgcacacctgctccccgctttgagctgagcattggagtctggatgtctcttggtggggatgtgtgtaggcctgggacaggccatttgtttttcctgatggtgtttctttttgtgatcgtgtcacacaggagttgcctgttcacctgttgatggccactgaggtggtccgttggagctataaccgtgcagcaatgggccttctggaacgcgtgttcctgtagaccatggccagagtctctctggcatatgcctagtagtggaaaagccggagctccccgctttcctagcggttgccaagtcatgcccccagtggctggaccactgtgctccccagcaggctccggggctccctttatttcaagtcctgctttgggcagctttgtggccctcactgaaacgatttcctcggccgtgacatgggaggtttatgggcccacccacccacccaccaggctgtttggaaacagatggggagatggttcacacaactggcttagctgggacctcgtccccactgactccctacaaccacaggagaagaaaggatggaagggctttcacctttacccccttgggcatccaggacggtgactgcagctttgccccaactgcccttgggggcaggtgccaggggtgacagctgggaaagagaactatactgattcgaacctctcaggagggaggcagggaggacggaggtgaaagttggaggatgggtgaggccttgtaacattctttctgtgtatctgactgttggtcccagtggtaaccaacacagcccagctctacccttgtagattatagtacagtgaaggagacagacctgctgtccccagacggtgacagcccagagaggccagggctgtgaaggagaggcctaggcgagggtcagggcgggatgtgggggggacccaggcagaagggtcagggcgggatgtgggggggacccaggcagaggggtcagggtggggtggtgggacccaggcagatgggtcatggcgggatgggagcggggacccaggcagagggatcagggtgggactgggggggacccaggcagagtggtcagagaaggatggggaaacccaggcagaggggtcagggcgggatggggaaacccaggcagaggggttggggctggatggtggggaggggcacagagagggattgggactgggatggaggcgcagggaccgtaggaagcccgaggaggcatgtggcccagcgtggggagttgaggagggctttctggataagatgacatctgactgatgagaacatatgagcgaggctggaaggaggtggaaagaatgtaacaggtcatgggtacggaagtgccaaggccctgagggtcggaatgacctcggaatggtcgaggatcatcagataggccggtgtaggctatgctgtgcaccctgactgtgtggtagccttgctctgcaaagagcagttaaagaaatacataaaatataaaataaataaataaataaaaaagcaaaaaaaagaagccagtgtggctgagcagggggtggggtcagaggcttggaggcggtgttggatacagcagggcctagcagagccaggtggggtgtgtggattccattctgtgcataatgggaagtcatcagaggctttagtgacatctggttttccccttataaagattgctcaggctgctgtgtgggggacggatcgcggggggtggcgacagggaggctgtggggaggctgctgtgacagtccaagcagaagagggtggagaagacgaggggacagtgatggaggagcgtcctcgtgccagctgaggtcatcagcgctttacccctgttacctcacttcatcttcacagcaacctgtgaagtaggtgctagtatcatcctcactctagagatgagaaaggaggcccagagaggtacgggacttgcttaaggtcacacagcaggcagtggcagaggtaggattgaaccccaggccttggggcttcagtgtcactgattactggggctgccctcccgtggtttggaactggctcggacaagacaggcctgattcctgttcagctggttcttacccaggctcctttgttgacagaagttccgtggagacctgttccccctgggtagtttctgggcgctgggtccctacctccctcagggcctccctttcctttctcatctactcctcgtcccactggctcgtggtgagccagacttcctggccagacaccggtcaggggtgtccccagcagctgtttctcccatcaccgagcccagccccgcacatgctgccagcaggaagcaacctccttccaagtcatggccagggaagtgggacccttcccgcctagtcacccatccggggccaaggcttcttgtctgccagacgccttggcccacaggaaggttggaggggccgaggagggtgagaaggggaacactctcccatcccaggggagccagcgctggcggatgcgacagaagccaccgctcactgaagcctctctcctgggaccctccggtcctgccccgacccttcccaggctgggaggccatctgctgccttcccgaggggcagtggaacttccctgccagggctgctcagtccacacacatcccttagcctttttcactagctgggagcccctggggaagagacaaagaacttccctgggcctctgattcctcacctgttacagggagtattggtggccacctctcagggctgtgggagggcggaagatcatgtgtgtgcgtcgtgcttagcccgatgctcagcactcagtaagtgcttggtaaatgttgaacttggtgcgttcgatggtttccgtcccttgcaccctgtccccctctgggttctcatcccgtagtgagctgtaataaccccagccccccgcccggggtcccagctccacgtgccaggcacgcgtgtgctgtgagtctatgagcatggtcatgtggctgtacccagagaccctgaggaggaggtgtttttaacctcgtttctcttttcccgtgttttaattttcagaaagcacgtttttcctccatgtgcatgcattacctattcccctaaataatcactgaaaaactgcacacagcacaaaaggatgtacagggacgagcaaatctctttcccacccgcctgccaggcccttcccagagatagcatcatcacccccggtttcttttctttctttcttgaaatatttgttcccccaagtgcccgcccctcccttttgtttttactcaaatggagcggacttcccatgtttatattctgtcctgtgctttgcgtttcccactccgaagctcgctgtcaggacacagagtgccgcctcgtgtcccacgcacacgcgtgcccccacggacagcacagccattctgtgctgatggccatcaggccattcccatctttccgtgctgtgaacagggctgcgcccgcctgagtgtggctgtgcatatgtctctaggtgtgagtctgagcttgtggcctcgtggtctgagacaggtgccccgttaactttgccggtagtgttagtgtttcaccctgctggggaggttgtctggctcacactcccaccccccagtgtctgatgacaccggggtttcctcactcccttgctggaatagacgggtgtcacctgacattctcacctttgccagtcagataggtgacaaacagtctcatcatggttctgattttaatcagagcaaagtgggacagctttgtgttgttgaaagccatcttgagcttccttttcttggagctgtctattcctgataattttactttctctgagaaggggaaactgaggcacaggccagcagtcccacagcaaatacgtggcagatgtggcactcaaaccttggctccgttctggagctcctaacccatctgacacagaagaggtcaagggcttggcctccggagccagctttgtctcttactagcagtgtgaccccagacaagtcacatcacctctctgtgcccgggtgtcctcatctgtaaaatgagggtgctaatgatatctactcttagagttgttttgaggatctaaatgtatattcggcaggcaaaatgtatagtaagtgctcaaagactgttagctgcgttactaatagccgtattattaatattatagctatgtcaccaatagccatgttattaatatgagcaggcactgtttgagtgctttctgtgaactaacctactggaccctcccatcaactccaagacacacgtgttcttaggatctcccttttctagggaggagactgagagcctgggggacctggccccgtcacagagcaagaggaactgggatttggatgctggaggcctggctggtaatcgctgtggccgcttcccctgctacccggggctaagcctgagggttacaaagctctccctcctgcttcccccacccaccttctgctgtctgcattccaggcaggctgcccaggagctttcgagcagacaccttgagggttgggagcaccgggtgggcagggtcctcacctagagagctccccgtcccagaccctccctgctcctgccacctgtcctgggaactcctgataaagcagcattgtgcagcggttttgagttcacttcccagcccggttttgccactcccacacttcactcccagaggcggaaggcggccggtcttcctgggctgcgtggggtgccagcccccctccccttcccttccctccctcactgcgcccacagtcaccggtcagcactggccatggggagaaagtaggaccctgcgggccactggcccctccacagacccgtccccaggtgaagacccctccctgccctccccacaggaggcccctgtccttctctcccgaggaaccctccttccctgccgcccacaggggcctccatagttctgtcgtcccttccccgcaaatcttccactgcagcctgggcccacgttatttgactctcaaatgctatatatatacacagcgcttctaactccactgcttttaaaaaacctttaataattgtcaattataatatgcccatagaaaagtgcataaaatgcacaggtaagtttagcaaagaattacaaagtgaacaacgcttccccaccacctcggtaaagacagaacacaacctcccaaaagccgcctgcccataacccctgtccatcacgaccacagtcgtgagtgctctcctgaccttggtggtcactgtgtccttgcttttcctgatagtttttaccatgaggtatgcatccttgaattacagaatgtcatcttgcctgcttttgaacttgacataaatggaatcttccagtatgtccttgtctgtgctttctttcgcccttaggcctgtgagatccatctgtgtgctgagtgtttctgtagtcattcatctttgttgctgtataatattctttttttttctttgacacagagtctcgctctgtcacccaggctggagtgcagtggtgcaatcttggctcactgcagcctctgcctcctgggttcaagcgattcacctgcctcagcctcccgagtaactgggattacaggcatacaccgctatgcctggctaatttttttttttaatttttagtagagagggggtttcaccacgttggccaggcgagtcttgaactcttgacctcaggtgatccacccacctcagcttcccaaagtgccggcattacaggcgtgagccactgtgcccagccccatataatattctgttcctccatctcctgctgcgctgatgcgagccatctctttgtagcatctcctggggtgccggtgcctgcgtttcttcagggaatatacccaggagtgcgtagcccagggcagagggtggggtagcttcagatttagtgggcgctgccacacagcctcccaaggtggtcaaatctgtgtatcctcctagcggtggtgactgaggatcttagttgctccacctcctcaccaacatttggtaccgtcagactttttggttgaccttggaacatttttattcttttttcctgcaaaagtaacaccactggttatcatcgggctgagcccctcatgttattttgtcctccccttgctcctgtccattccgactctcacccattctgtggacaggagtcaagtgcttattctttttttttttttttttttttttttttttgagatggagccttgctctgtcaccagggctggagtgcagcagcgcgatctcagctcactgcaacctccgcttcccagatccaagccattctcctccctcaccccctcaagtagctgggattacaggcatgtgccaccacgcacggctaattttgtatttttagtagagacagggttttaccatgttggccaggcaggtctcaaactcctgacttcaagggatccacctgcctcagcctcccaaggtgctgggattacagacgtgagccactgcgccctgcccaagcgtgtattctttgaccagctttgcgctggggcccagcgactgaagggtgaacccaaacaacaggcagccctccccgagctcagtccggtgggaacacagacctcgactgcagagcaacagaaagataagccgggctggaggctcccggcccccatcttcccacagtgaccccattttgggaacaggaacccccatccctcgtcttgtttcgggattaggcttctccaaatctggcaccctatcaccttgactcctctcttgcccccccgccacatccaaagtgtctggaaagcctgtcactctacatgacaatgtaacctggtgctgcgggctcctcttccttgtcactccccttcctcgtcatcccccttcttcgtcaccccccttcctcgccacccccttcctggtcacacctcttcctcgtcacccttcttccttgtcacccctcttcctcgtcaccccccttcctcatcatcccccttcctcgttaccccccttccttgttacccttcttcctcgtggccccctagttcaagccaccctcatctccctcctggaccattgaggcgtgctccctgctcccttctcccccactgtccccacagttgtccgcacacagccagaggtagccgtgcacacctggtcagggcaggaaccctcccctggctccacctctcccagcagagaagcttgcaaggtcccaggcaacctggccactttcctgcctgccctgcttccctcttctcctgccaccattcctggaacattccaggcaggtcctaccccggggcctttgttcttgctgccccctgggcaggcagcaccctccttccttctgttcagtcagcctctgctgacagtggcccccttggggagatgtttcttcccgaccatgggtccccaggagcagcccctgtcaccctccctctagcaccttcccccggtaaccctcatgatggttacttccattatgacatgtgggtctgttggtttattttgtctcccggcataacgtagcctcagggcatgggggtaggggtagaaccacagggccttgccctgccccttgctatgttctcagggattggagtgtggtagtctctcagtaaatgctggttgactgactgactgactgactgactgaactgtagtaagctgggctgccagagcgtctaatggggacccgccctgggtggggcacaccgggaaggttttcctgaggaggaaatgccacttgaaggatgaacttggcctcgactaagggaggaggctgaggcagctgccattgcagaggtctcccggcgggggagtgcagggggcctttgaggaattgaaggaagacaggtaggtcggttcttgggttggtctggattccagtcttgacagctgcttgggcctctctctgcctcagtgtcttcctctctagaaggtggctgcttcaggtgttcctggacattcctgaagttctgctcctaacacacttatcctggtgcctgatacataaatataaatgtgattgtttatttttttccaacaaatttggtggagtgctgacccgtgtggcctccagggatgcggtggtggataaacagacccggttgccgcccatttggagcctggcctctggagccatctggggcacccctgcttggaggcaggagaaggcctggtgtgaccttgggcccggggagtccttattctagatccgggaagctcttcagggtgatgaataggaaagacgaatggagggtttgtgcgtgccggccctgtgccccggccagtgctcccaagctgctgcctgggcctccctgaaatcccaggaggtagctgcacccgtgtgacccatttcacagattgggaggtgaggggggcaccaatgctaagtccttcgcccattttgcaaactagagtagatctggtggtgtttcctctgtggtctgatgtgtttttctggtagccagtcaggtggggcagctttcaatttgttcttccagactcctgtgaaggaagggccagttcaggtcactttcctttttttttttttttgagacagagtctcactctgtcacccaggctggagtgcagtggcacgatcttggctcactacaacctccgcctgccgggttcaagcgattctcctgcctcagcctccggagtagctgggactacagtcgtgcgccaccatgcctggctaattttttgtgtttttaatagagatgaggctttgccgtgttagccaggatggtctcgatctcctgaccttgtgatccgcccaccttggcctcccaaagtgctgggattacaggcgtgagccactgtgcctagtgtcttagccattcctgaggttttttttttttttttgagacagggtcttgctctgtcacccaagctggagtgcagtggttcaagattggctcactgcagcctccacctcctgggttcaagcaattctctttcctcagcctcagtagctgggactgcaggtacacgccaccaccctgggctaatgggctaattttttttatttttagtagaggtggggtttcactatgttggccatcctgttctcaaacttttttttgttgttgtatttttatagagatgggatttcaccatgttgcccaggctagtctcaaactcctgagctcaagccagctgcccgcctcagccttccaaagtgctgggattacaggcatgagccactgtaatgggcatccagcccattcttgactttttgtaattccctttaaatattagacaagcatgttgtcagtgtatgtacgtgtgctcgtgcgcacacacctgacactgagtctcccaatccatgaacgtggtatgtctctccatttgtttatgtcttctcgttcatacttttccagccgacgccttgcccacctcttgtggggtttttcccagggtagttcatgatgtggcagggagtctgtgccctccactcccacaagatgccgtgcaccctgggtttagccttgctggctgaggacctcatggcggtggcaggaggccacttctcccattctctgcttcttccctggtaccgcccctggaccctggcggagggcgggcagggtgcccagaaaggaggctgtaattttcctgaatgatttcaagggctaattaaaggtttgccttgactaatcagcttacggtttaattattagggaacaggctctgggatgcgggaagcagctcagctggggtctccccacagcgtggcaggaaggagccaggacccagccctactctggggggctggcaggatatggggataccccagcaccctccagtgggtcagtggggggttctccatcccccactgagctgtgacaggtggagggcagcaggtgtgatggagattacagccgattcctcccctgattcacatcatcccccacagcccatggctggctggggaggggctggccctgtccctccagcagctttggcagggcccgtccctccccactttcctgcagcaccccagcctcgctggcctttgtggagtgctcggacttcatttattctgtgggtcttggcttaaaggtcagcacctctgggaagcctcctcgggcctccctcctgtcagagctggtgatcagccgcacggccccttgccagttcttgggatcatggttgttcatctgctgcaactcctgcagacactgagaagtacactgagggggatgcctgagctgggccagtgtcggggtacccagcgggataaagggttcgggacctgggctccaaggagggggctgggaaggggtgttcagggaggactgagtgatggcttggaggcggctggaccaggaacacctcatgggagtttgcgaatggggaggggactctggagatggctgtgccaggcctgacttcattccttgcattcctcagcaggccccagactcctgatggtcctaagtgggggaaggtgagccagagagggccttctgggtactgccctccccccactccatcagtctgtctcagtctctctttacaccctcccccatccaggtctcagggctggatccatcctcctgcccactccccaatctccttatcctttggctgcgccttagggtcacccggggtgggaggcactgcaggggcccaagctggaccatttgaagctgactgtacagctgtggggtctgggccttggggttttttaatgctcccctggcgactctgacatgcttctgagctggagtgagggctgctggcctgcaggaatggcaacaaatgtgttttagcttttggcatgttctgggtgcttttctaggcttctgacatggaggggttaagtcacggcacgctacggggacatgtgactgtgattcctgtgttccagataaggcaactgaggcccagagaaggcctcgagcttggcgatggcagtctctgtcactgtcttatcttcccatttctggtctgtccagatgtctgtctgggccttctctgtttcacctctgtctctctccctgtttttctgcctcttatctcccttccccaccccaccctcctgcatttcagcttccctcctcccctggcagaaacttcccagatttctgtgttttgaggcaggatctggctgaagccacagaggggagatgggttctgcaggcccaggacatccttctgaggggaaggatgctgatgtcaccacgctggcctccctaacagctcctgacacgtggagtctggggctgggggcaacacaccatctgactgacagtccaagggtggctagggctggctctgcaagtttgcagggaggactgtccccacgggttgactctgacatgccctgtgacaccagccacctctacggtcccgggagtcctctactgccagttaatgtttcagcttttgtgggtaggactgcctgtcggtcagtagtttaattgcaacaaaggtttgtgctagaaaggcgaatattacattgcaagagcctttattatttgatgggactaggggggactgatagctgatggtcccgtatgtccccactcactgagggatgagggctccccttgcctcctctccccctacccctctccagcgaagggctcaggagtccagctccacctgcagcctctccctgctccggcacagcatcctctgaccttgggcgaggccctgagcctcagatgtttttgagttcccacatctggagcaggaggataatgattcctgctgcctcccagggttgctgggaggatgaagtgagtctgctgtgtgatgctcagaacagggccactgtcattatgccattctggttactagtactcttattaccattacacttattagagaggcaggatccgtgcttggatttagtagttaggattcacagggtgagtgatccataattctttgccattacgatgaggtcacatttcctttggtaaaatgttgaacacctttgtattatggaaatgttcacacatacccagaagaatagtctcgcgccctcctggggtccctgtcagcagctcagcaggtagcagctgtggccaggccttgtcgcctgtgcctgctcctcacctccctgcttatttcagagcaaatcccaaacgtcgtacagccagaaatattccacacttttccagaacaagcctgcctcagtctcctcatgcttccccagttgtcttataatcctttttttttttttgagacagagtctcactctgtcacccaggctggagtgcagtggtgcgatcttggctcactgcaacctccgcctcctgggttcaagtgattctcctgcctcagcctcccgagtagctgggactacaggcgtgtgccatgatgcccggctaatttttgtatttttagtagagatggagtctcaccatattgaccaggctggtcttgaagtcctgacctcaagtgatataaccatctcagcctcccaaagtgctggaattataggcgtgagccaccgtaccctgccataatcctttttcatttgttttttgttgttgttgtttgagacagagtctcactctgtctcccaggctggagtgcggtggcacgatctcggctcactgcaacctccgcctcccaggttcaagcacttctccctgcctcagcctcccgagtagctgggattacaggcgcccgccaccacgcctggctaagttttgtattttttagtagagacagagtttcctaggctggtctcgaactcctgacctcaagtgatccacccgcctcggcctcccaaaatgttgggattataggcgtgagccacggcgcccggcccatttgtttgatttgggtctagacaaggtctacactttgcatccggttgataggcctcttttttttgttttgttttgttccctttgttacccaggctgaagtgcagtggagcgatcagagctcacgtgcagccttgacctcccctgctcaagcaatcctcccgcctcagtctcctgaatagctgggaccacaggtgtgcgccgtcatgctcagatactggcatcagctctttggcgtgcatgttgtggtagtttttctacaggcgacctaggccatttgtcctggagttttgcagtctggggccagctgatacatccttgtggtgtcattgcacgtgttctctgtctctgtgcttcctgtaagttaggacttaggtctagaagctcgatctgatgcaggttcagtttcttctggcaagcacgctttcttaggtggttgcttggatgagcatcagaattacttacatgtctgtatgactgtcaagttcagttttcaagtaaaaattaagttttttttaaaaaagcgagtgggttgagaagaacactctgaagtcactcctagtaaggctggtacccagatccagcagaagtagggtgggagggaccaaaggactgaggctcgggtccccccttccccaccccccggggcctgggagcaataggctgggtgccccggcttcaagtaaaccagtggcattaacatgtgggcctctggttcctgctttgctagggccacaggcttccagctgagagctgctgccacccaccctggcaaccccttccgcatcgcgtggtggtgacaccttcagaacagagtggtctcccaccccagctctacccttggctgcctgtgtcaccctgggtggctttcccagcctctctacctgcttccttcttgacagcctgatggtggccatacgtcccttgggctgtggtgactgggcctctgggagctgcccttccacttctgcattttaacataaacctccttgacctcagctgctccattctctgctcccttccagccactcggattccagtcctgggggcctcctcactgaccatgccctccaccctcagtgctgttccctggtactctgcatggcttcctcacctgtatcccgtctttgctcagacgccacccctttagagacctccctgactgtgccctctgaaagagcaccttgtcactctctgtcccttctcccacttgtttacttgtatattgtgttcccactagaatgtcaactccaggagagcagagactcttgtcttattcactgctgtgtccctggtgcctagaacagtgcctggcacctgctaagtgcatattaaggagtcgttgctcactgggtagaagcattaaaaaaaaaaaaaaaaaaggctgggtgtggtggctcacgcctgtaatcccagcactttgggaggcaaaggtgggtggatcacctgaggtcaggagttcgagacgagcctggccaacacagtgaaaccccgtctctactaaaaatacaaaaaaattagcttggcgaggtggcaggtgcctgtaatcccagctacttgggaggctgaggcaggagaatcgctggaacccaggaggcggaggttgcagtgagccaagatcacaccaatgcactccagcctgggtgacagagcaagactctgtctcaaaaaaaaaaaaaaaaaaaaaaaaaaaaaagaattgttgagtgcatgaatgaataaaagaaagaaaatgactgggcacagtggctcacatcccagcactctgggaggctgaggtgggcagatcacttgagcccaggagtttgagaccagcctgggctatagtgagacctctgctctacaaaacatttttaaaattattgttttaaaataatttaaaaattatttaaaatgtaaaagggcgtggtggcatgtgcctgtggtcctagctactcaggaggctgaggtgggaggattgcttgagcccaggagttggaggctgcagtgagctatgatggggtcctagctactcaggaggctgaggtgggaggattgcttgagcccaggagttggaggctgcagtgagctctgattgcaccactacactccagcctgggtgacagagcaaaacctatgatgatagatagatagatagataagatagagcgagcaagaccctatctcaggtagatagatagatagatagatagatagatagacagacagacagacagacagatagatagatagattagattagatagatagatagatagatatggttaagtgagtggactttggtcctggtcagacttgccacggaatcccagttctgatacactcgccgtgtgactgagggctgacatgtcttctctctgagcttcactctcctgcttcacacaccgtgtgaacggcaccctcctcgctgccttcttttgcaccaggatggagcctgcacgtaacactttgtagtggtctcactgctgtcctgtctccagcacggggcaccgatgagccagccagaagccgtccctgccggggggatgcttgacccaaatcttcagtaataactccttccactctgggtgaccagctgtggtgccccagggcagggacttgttgatctgggtttgttctggaggccagaagggtttcctggggactgggattggagcaggattgagagtgcctggtatgtggagagacctggctgttgtggcatgagtccgagggctcaggggccggctgcttcccggcctttgtcttccttgcaggaaacaggccaggagttacaaggggccagaggatgctgctgtggttatggtggaagttaacagctttgggaagtgtgcatgtgtgtgagtgtgtgtgtgtgtgcacttgtgctcattgtaaagagagacggtaaagaaatgaggagagactgcaggcacatgcaaatacagagaaagctttcagttgtcaggatcgctctcccggtttttcctgcatggtggtgtaaaatctgacatgtgtacagaaaagtgtgtaaaacctccatgttcagtttaatgaataattataaagcaaacagccatgaaactaccacccagatcaagaagacaggcatcaccagctccctgaaagccctctccttcacctgcccttcccagtgctaacaaaaacattctcctccctttcttttcattgttcctcttttttggtgaattgtgaaagatttcagacacccccaagagaagagagaatcacctgctgaccaccctcaggcccgctgcccagctaaaagacgaaatgcttgctgtgggtgcagcccccaggtgcctcccccagggccccaggcgtcgctggccctgcgtctgcttccctaaacagtgtcccgcattgttctgcaggattttaaactgcgtgtaaatggtacgaggccagcggcacttggctgcaactctctcaatattttgttcttgagatttctctgggtggagtaatgaagctctgtgccagaaggaatggttcccagcgggggtcagggcacccctacccctggccagaggaaagcagctctgtcctgggggggccccaggaggacgctctgggctcctctcacccaggcccgcagccccctgctccacgtgggtttgaggcggccacctccagtggaagtggtagagcgccgttggcttcctagggcaccacataggacccagttacagccgtgatgtgaaggggccctccctgagcttatgtaaggtgtaatggggcgctggtgccgcctggggcctgtgtgcaccacggaggggccttctctggaggagggcatagatcagcagctggggcaggagggcctcttctcttcccatactgccctccccctgcgcccgcccactgcccaccctcacccgccctgtttgccaggctcacacagcctttcttggagaggccctctggcggggagtttactctcaaaggctctatatctagctgacctgggattgccacccagctccgccaccttctagctggacggccctgggcatgtgttgacccctgccccacctctgttggcctcagtttccccatttgtaaaatggaattgtgtgagggttatttcatccatgcaaagccttcgtagaagctagtgtgtggaagcctcttaatgagccttagctgttagtatctttgtcatgcttgccattcattcactcatttttgttgatagtaactttttgcctcctctgagtccagccctgtcaggctgaggtcctgccttcatggagcttataatacagtgagggagacagacatggagacagacatggtactaggcagtgacaaaccagagtgaccttggaaagcacaggccagagtgtgacagctgtgatgggagaagacccagaggactgtgggaggccctggctccagcctaggaaatcaaggaaggcctcctggaggaggagacttcagagctgaggcctgaaagaggagcagggttagtttgcggaacattgtcccaaggagagcaaatagcatgttcaaaggctaaaagttgggaaagggtctggcattttaaataaaccattactatttttaagaaaactttaaattctgagatcattgtagattctcctacagttgtaagaagtaactcagaatggccaggcgcagtggctcacgcctgtaattccaccccatttggggaggccaaggcaggaggatcgtttgtgcctaggagttcgagatcagcctgggcaacctggggagacaccatctcttcacaaaatagaaaagcttatctggctgtgatgctgtgcacctggagtcccagctacttgggaggccgaggtggatcacttgagcctgggaggttgaagctgctgtgagctgttaatggcaccactgcactccagcctgggcaacagaattaaggctctgttgcaaaagaaagagagaaagagagagagggagaaagggagagagggagggagggagaggggggaaggaaggaaggagagaaggagagagggagaaaagaaaagaaaagaaagaaataatacagagaggaggtctggcgcacctttacccagttttccccaatggtaacacctgcgagactgtagtaccagataccagagtgtcaactgacattgatacagttaaggtatagagcatccattcagtcacaaggatccctcctaataccttctcatagctacacccttcccctgcccatccctaacctctggcaaccactcatctgtctattcccccattgttaggattttgtcaattcaagaatgttatgtaaatggagccacccagtatgcaccctttttgcattgactttatcccctcagcatgattctctggaggtgcatccgcattgtggtgctgatagtgactactgagtagtattccgtggtctggatgccccaccgtttgtttaaccatttcccgttggaggacatctgggtttttctaattttttggctattacagacaaagccactataaacctcgacaaacagggtttcgtgtgaatgtcagtttttgtttctctggggccaatacccagaggtacaattgctgggcagcgtgctggttgcatgttttaagaaaaccatcaaaaccattttctagagtggctgtaccatgttatattatcaccagcagcaggttccccacatcctcaccagcatttggtgttgtcactattttttattttagctcttctaataagtgtgcagtgataactcattgtggctttaatttgcatttctctaatggtaatgatgttgattagcttttcacgtgcttatctgccatctgtgtatcctcttcagtcaaaggtctcttcatgtcttctgctcattttcttattggattgtttgttttcgggttttttttttttttttttttttttttgctgttgagttttgagttttcactgttgttctttttttttttcttagccccaccaggttctcatatgagatctttatctattctctctctcttttttttttttagatggagtctcactctgtcgcccaggctggagtacagtggtgtgatctcggttcactgtggcctccgcctcccgggttcgagcgatttttctgcctcagcctcccgagtagctgggattacaggcatgtgccaccacgtccagctaatttttgtatgtttagtagagacggggtttcaccatgttggccaggctggtctcgaactcctgacctcaggtgatccgcctgcctcggcctcccaaagtgctgggattacaggcgtgagccaccgtgcctggcgagatctttattctacatactagtcttttgtcagatacgtggtttgcaaatattctctcccagtttgtagcatgtcttttaatacttttcatacggacttttgcagagcaaaagtttttaattttgtattaatttttttcttttatggattgtgcatttgctgtcaagtctcagaaccctgtgccctgtcttaggtaccaaataagtttcttctgcttttttttttttttttttttttttttttttgagagagagtctcgctctgttgcccaggctggagtgggctcactgcagcctctgcctcctgggttcaagtgatgcttctgcttcagcctcccaagtagctgggactagggaggcgcccaccaccatgcctggctaatttttgtgtttttagtaggcacaggatttcaccatattggccaagctggtcttgaactcctgacctcgtgatccgcctgcctcggcctcccaaagtgctgggattacaggcgtgagccaccacaccctgcctgctttttttttttccataaaagtttgatagttttacatttaagtctgtgatccattatgagttaatttttgtacaaagtataagttttggattaaacttctttttttcccccgtttggcatgtggatgtccagttgttccagccagcatttgttgaaaatgctgtctttcctctgttgaattgcttaggcttctttcacaagaatcagttaccacgatgagatactacatcacacctactaggatggctgctgtcaaaaaaacaaaaataacaagtgttgggaggatgtggggaaattggagccccgtgcattgcttgtgagaatgtaaaatggtgctgtcgctgttcggcatagaattaccttgtgacccagcaattccgctcccaactgttcgtccaaaagaattgaaagcagggactcgaacagatatttgtacacccaggctcatcacagcattattcacaagagctaaaaggtggaaacagctccgtgtccatcagtggatgaatggaggaacaaaagatggtatacatgatggaatattattcagccataaaaaggaatggaattttgggtagaaagctatcatgtggatggtcttgaaaacattatgcttagtgaaatcagccagacacagaaggagaaatcctctatgattccacttgtacgaaggacctagagtaggcaaatacaaagagacagaaagcatgcatggagtcccagctattcgggggcaggaggatcacctgagcctaagaggttgagttcagcctggacaacatagtgagacccggtctcttttaaaatatatgtatataggccaggcgcggtggctcacgcctgtaatcccagcactttgggaggccgaggctggcagatcaagaggtcaggagatcgagaccatcctggctaacacgatgaaaccctgtctctactaaaaatataaaaaattagctgggcgtggtggtgggcgcctgtagtcccagctacatggaaggctgaggcatgagaatggctagaacccgggaggcggaggttgcagtgagctgagattgcaccattgcactccagcccaggcaacagagagagactctgtctctaaataaataaataataaaatatatgtttatgtatatatagagagaaagaaagtagaacagaggttatcagggtttgaggggaacaaggagctgttgtttattgggtacatagtttttgttggaatgataaacatgtttgaatatagatggtggtgatggttatacaacattgtggatatatttaatgccactgaattgtatacttacagatggttaacaatgataaatatgctgtatattttaccataataaaaataaatttttgaaaccagctaggtatgttggtgtagatctgtttctgagttctctgtcctgttccgctgctctgttgctgtgactgtcccaccccatctgggttacttgctgcagcgctgggagagggattcctctggcttcctctctcttttctctttttcaagattgagctcttgaaaaaagagctctgggagctggcattttggagctcctctagggttccgcgtgtagaagatggcactgtgttgggcctaggttcagagtcgtccttgacaccacctcatcctcagcccgtgtctgactcatcagcgagcattgccttttcttggtagacatagcccaggtctgtccccctctctccactgccactgtcctggctgcctcacagttgcccgaacagcgctgcctccttgtcactcatcctcacgcccactcaggccccttgattccgtccttcacagggcaaccaaagttacatctgtaaaacccaggcctggaccaggtggagtggctcccacctgtaatcccagcacttggggaggccgaggtgggcagatggcttgagctcaggagttcgagaccagcctggacaacgtagtgagaccttgtctctaaaaaaaataaattaataaaaattaaaaaaatgtaaaaacccaggcctgtccttggcacccacgttgtctccccttgctctctcatgatctgcctccaccacaccgtccccgttcaggcctgctgcccacccatccctccagccagtgtgtgtccgctggactttcacattttttgcgtgtggtgcttgactataagcctgatggggtagggcccacactgcacttctgcccccgcacaggcggcacgtgacagacgtgcattagatttctgtcggtggacgccatgaacgtgggaaggaggctgcctgtggccggagcaggtggttgggggcggagagtgtgcaaaaatgaggacagagaggtgggcgcgacctcggtgaggagacggctttagctctgtgggcctgagtaggtttttagcaggagaggatacaatcagattagatttacaaaggtctccctgacctagcagaaaaaggcaaaggctttgaatagacacttagcggaagaggacattctgatggcttttataaatatgaaaaatgctcaaccctactaaatagaaaaatacaaatgaaaactaggctgaggggggccacacctcacatatcagcagagatcagagagactggccacgccccgtgctgcaaggccgaggggagataggccctggcaccgccgaggggctgtgagtggggacaggcctcacgcagggccacttggcagtggtgaacttcactggacatttacccacagacaaacttgcacacctgtgaaatgacagctgcacacagtgagtgttgccgcaccatttataagagcaaaagacaggaaaccaccactctggcccgatggggactggctccagacatcacggtccttccacacagctgccaaagcagcaaggcagtgctctgccaagatcaaggcagggaaagatcaccaagacccacatatatatgcagcatgtctgtggtttcagttacctgtgaccaaccatggcccaaaagtacatggaaaattccagaaataaccaattcatatgttttatttatttatttttttgagatggactctctgtcacccaggctggagtgcagtggcaccatctcagttcactgcaacctccgcttcctggtttcaagcgattctcccacctcagcctcccaagtagctgggattacaggcatgcgccaccacgcgcagctaatttttgtatttttagtagagacaaggtttcaccatgttggccaggctggtctcaaactcctgacctcaaggaatccacccaaagtgctgggattacaggcatgagccactgcgccggcccaacagctcatacattttaaattgtgcaccattctgagttatcgtgattttttttttttttgtagagacgaggtctccctatattgctcagctggtctcgaactcctgggctcaaatgatcctcctgcttcagcctcccaaagtgctgagattacaggcaggagccactgcacagcctcgtgatgaaatcttgagccatcccactctgtcccgcccgggacgtgaatcacctttcttaccccacatatccatggtgtatgtgctacccatctgtggctactcagtagctttctcggttctcacatccactgttgccgtatcacagtgcttatgttcaggtagcctttatttcacttaacattgtccccaaagtgcaagagtagcgatgctggcaatttggatatgccaaagagaagctgtaaagtgcttcctttaagtgaaaaaggggaaagtattgaacctaataaggaaaagaaaaaaaattgtatgctaaggttactaagctttacagtaagaacgaaccttctatccatgaaattgcgaagaagggaaagaatttgtgctgggtttactgtcacacctcaaactgcgaaagtcaacagccacagggcataagggcttggttaagatgaaaaaggcattacgtttgggggggtggaagacaggaacagaaacgtgttccaactgatggcaatcgggttcaatgttatccacagtttcaggcatccattgggggtcttggaacatacgccttgcagataaggggaactgctgtatatatagttggccctgggtatcatgggccctcaggatcacgggttctgcacccacccattcaaccaacgaaggactgaaaatttactatggagggccagcttttccatccgcggttatggagggctgactgagggacgtgagcatccctggatgtggtacctcctgcgggggttctggagccaatctccctcagctaccgagggagaattgtatagatatatcaatttttttctttcaaatcataattataaattgttaggatacacagtgaaaattgcataaaacataaatgtatagcaaaaccaattactataaagggaaaaatctatgtagccacccctccaggtgaagaaacagatggtgccagcctcccccaacccccaaaagctcccagtccctcccttcccccagaagcatccactctttttaattttaattttttttgagacagagtcccactccatcacccaggctgaagtgcagtggcacaatctcagcttactgcaacctccaccttctgggttcaagcaattctcgtacctcagccttccgagtagctggaatcacaggcatgtgccaccacacccggctaatttttgtgttttgttgttgttgttttatttttttgaaacagagtctcactctgtcacccaggctggagtgcagcggcaccatctcggctcactgcaaccttcgcctcccaggttcaagtgattctcctgcctcagcctcccgagtagctgggattacaggcgcctaccgccacgccacgccaatttttatatttttagtagagacggagcttcaccatgttggtcaggctggtcttgatctcctgacctcaggcgatccactcgccttggcctctcaaagtgcagggattacaggtgtgaaccaccccacctggccttaattttaattctctaaaaatgtagagatggggtttcacaatgttggccaggctggtctcgaactcctggcctcaagtaatcctcccgcctcggcatcccaaagtgctgggattacaggcatgagccaccgtgcccagtccaactctcctgacttttgaggccatcatatgcttgcttttctctctgtttgccacctctgtatgcagcctgaagcagtttccttttgcctggctttgaaccttaaagtccgaggatggagtattgttcgatgtttttgcctcttctgtgtggcgtcttctttgatgctcatccacatgtagctgtagtcattcattcattcattctccctatcatgtgcggtgccatggagccttcattcaccacctcctggggacgagcatttgtcttgtttctagtctcttctcgcgtgtgctccctgccccatgggcctgcgttatgctggagtgtgtacccaggagagctcttgctaggtcaagcgtgtgtccccacttccactcgatgctgctaagctcctgccaaatgccagcagcgtgggagagccacggaatgttttcgagaagagcaaagtacagaatattgtgtgtcatgtggctgccatttctcttgtttttttaaaaagcaggtaatcatgtgtgtacccatacacacacgtaggatctctcagaaaggaaaagaaaaaacctgaaagtctagtagcggttgcctccagggctgagctgggccagggtggaaggaggacatcctgtcacagtttaccctttggtgccttttgtcttttgaaccgtgtgcctgtattacaaagacagagagaaggaaaagaaggaaaaggggtagatgagtgtaaatgtggtaaagtgagaatcactgagaatcgcccagtgcagctccctctccgtccattggggacctcgtttcctgtggctgtccagagctgtccaatccccatccactccccgccagagcccaaacctgcccgtctggtttgcagagctgccccacgtggctcctctgcgggtggttactcgacaaatgccccaccccccaccccatggggaggcagtggcctgagatctgggacttctggatctaggcccctagacctgccctgctgtggtccagagcctggcccagcccctccttggacttcctcctcactgtgacagggggtggacagaggtggagatgggagttccaggccctgagagcaagcgctggcctcccagcccacgttctgtgtgtggagataacatctgcccttgaggagttggctgcaggggcaggggtgtgccagagcagggtagtgggaaggacccaggtgcgtctgtctgctgtgtgccggggcgcttgctcactgttgtccctggattcaccatggcctgggtgcccatcctgggtccgggcacccagcagccttggtccctaccgcctaccagactggagtccctggtagagcccctctagggtgtcaactcccgtgggcaggaagttttgtggagtttgttcagtgctgaactatcagggcctcccacaggtgtgcctggtatgtgcctggagctcagtgaatgaatgagaggcgggcaagctgcagacagtgacagcctgggtgctcagggctggcatggggaggtgcagggtggagtgcacagggctggagcccagaggatacctgacccagcctggggtggcagggagggcttcgtggaggagcaggtgcctcaagtggggccggagggtgagaagggatgaaccaagcagccctccggaggcctcgaggggaacagacagtgttcacaggagaaacagttacacctgcgagctctgcctcgggccagcctttgcactggaggtgggatttgaaggggagggaggggtgctgtggagcatctttttcttctgttcctgaacgggggttctgatcacatcagcctcatgcttggagcagctggttaagggcacagacaccgggacagacatccagcctgggagtcccagcgcctgacctcccctcgggcatcaagtcactccgcctctccgcgcctcagtttcctccatgatgaaaggggcctgctgaaggacctgtctcatttagggcagcagtgaggcaaagccccggagcccatgcctgtgccaagagcagggcctggcccagaatatggccttgtcacgttgagctgccttttttcagcagggttagtttcatcctggtgaggcggcgccagcatggcgttccaccttcttggcctcctctccctcctccctttcctgccatccacacctcccggccctattctcacacctcaggatggcgatatgggggcttcaccgtggtctcccctgacctcgcccctcccccggtcaggctaagtctcagattcctcctcatgggtgaggggggcagagtggcccctttcctccagcccatgctgggcacttgctagaatcccagccttggtcggggtggaggagaagcaagttccagctctccagttctgcctccatatcagagagcccacccacccctctccccagggctctatcctgcacctagtggcccctgtcactccccagccacccccacgtacataccctggtcccttgtttcaaacctggctgccccttagccgcctggccagccgcttgcaggtactcagccttgctgtgtagtcaccccctccagcccctggcacctagcctggcataggggggtgaggcggggtgtgcctgttggtgggaggctgaccctgctgaagcaaaggctgtggttggggtccccgcccagccctgccctctgtccaggcagctatgagccacgtggcccaggcccacccaccccagctccaggcccagccccgcctccctcccgccctccgtgggtggaagccacagccgaggctcaactcctggccgcgtcaccaccgctgccctgcaggctggagcatagagcccaggcacccctcctcggtgggtgcccatgttgagggcctggggagccctggatctactctgctttcccagctggaagcctgtctgtccacaggcccgccccattgagggtggcccaggaagtgggaaagagcgtggtggaggtgagctggccaggcctcgggaggggagggggagggctagactggctgccagggaaggagggtctgcccctggccactggagccagtgtgagcatgtgcgaaggccacacctttcttggggttggagcggggtcactgtgtttccatgtgtgcgagatggcaggtgcctgtctgctggggacttgcaggcatctgagcataggtccctgagcctctctgtgggagcacgctcctggggtctggcttgcacgagggcagaagtttccgtgagactgtgcctcactcagtcactctgggtgaccctggagttgactgggtgtgcctaggtccatggaggtctccttgcctactgtgtgtggttttggggtcgggggggtgcctcctagtgtagctttgtatcttgggggttattcctaggtgcgtgtgtgtcctggggtgcagtgcggctttccctcgaagtcatggagtgtctgcggcattgtgtgtatacacacgtgtccctgtgtatctatgtgtggatctctttgggagtctctgcatctctgggtgcacgagtctttgcagtgtgtatgaaagggtcgcagtccacggtccatccatggctcttctggggcccatgtgcaggctggctgagccgcggccttcccatttgctgcgcatgtactctgagccaggctggctttaagagccgctcccccaccttctcccactgaagtctcagaagctccctctggggcacgctctgctggtgccccatattctagagacatgaacggaggctcttggtaaatgtccttttcccctgccccacggcaagcaaggcactgacccctggccaccagcctcctgagcccatggtcctgtacgggccgccgcgaggtgctcaggatgttgtagggttgagggtggattgctgctgttgccggctagccgggaagttttctttttttggcctaagataaatattggagaagaatggcccgggagctttccatgtgaccagttcatgtgcctggaggcctgtggtttgtgtggctgggtatgtatctgcatgtctgtgtgatggtcttaggactcggctctatgtggtgtcagctgcggacatcttgcatgctctggcatgtcctcacatgcatctgtgtctagggatcatgcatgtgtgtatgcatgtgtgtgagtgtgcatgtatgtgagcatgtatttgtgagcgtgtgtgtgagcatgcatgtgtgtgtgtgcatgtgtgtgcatgcatgtgagcattgtgtgagtgcgtgcgtgcatgtgtgagcgtgcgtgtgtgcacatgtgtgcatgtttgtgagtgtgcatgtgtgtgagcgtgcatgtatgtgcatgtgtgggtgtgcgtgtgtgtgcatgtgtgtgcgcgcatgtgtgagcatgcatgtgttgcgggatggcttcgctcgctgctgtgtgttgggtctgtgaggagaggccgtggttgctgcctggtgtatgtcctggcgtctgtgcacggccttgtgtgttgcatggcaggggaggtagacagtgagagggcttgggtgctggagcctgagaggggcagggcctctttcctgccacatcacccccttccccctgcccagcctcaggcgaggaataaatgacgtctgctctgatttcccaggccgtatgggctcccacacactctctgttgtggtgtccatccccaccctgagtacctctggggggtgaagggcaccagcagtgccctttgtgtctgtgcccttttgtgctgggccagattcggggcaggagggcttggccctggcatcactgggggctctgagcgccagcctgggcctagctgggtaaaggaagcatcatctcttcgttgagccacactctctgcgctgggcaagcctggggacacagagatggccccaggccctgccctcctgggtctcccagtccagtgggagaggcagacctgttatcagacaataacagcccatcaggctcctccctcccaaccctggagaaggtaagactagcatatttgctcggcagaagggaccatgcccggcatcctctgtagtgtgtttgttcattcattcattcatcattcagcagcaagaatggcagtaatgataacagcagcgagcctgcagtgaggccccactcggcaccagtcactgttgtaaatgttttacatgtgtcgtcttattcgctcgtccaacatgctcaggaggtagggactatcactacccccagtttgcagatgaggacactgaggcccagagaggttgagtcacttgtccaggggcacacagcttggagtagtagagccagtacctgggactgggcagtcggctcttaaccaccagtacaggcctgctgagcccctgtactgcgccaggcctctgctgaggacaaagcagtggctaggagagacaggccctgtcctcgtggggctgcccgttcattgcaggagacatactaattaaggactataaggacaaaggtaaaattacagctgtgacagatgctgtcaaggggaaggcacgggacatgcagggtttttttcagacagagtctcactctgtcgcccaggctggagtgcagtggcgtgatcttgactcactgcaacctccgccccctgggttcaagtgattctcgtgcctcagcctcccaagtagctgggactagaggcacatgccaccacgcccagctaatttttgtatttttttagtagggatggggttttgccatgttggccaggctggtctcgaactcctgacatcaggtgatccacctgcctcggcctcccaaagtgctgggattacaggcatgagccactgtgcccggccatggacctgcagtttgaaggaagaggaagggataacaaggtgaaggttgagggggcagggggctcttcaggacccaggctaagggcacagtccatgcagaggcctggtggcggggacggcgctatacctggaggaacgaaggagagcagggctgccccctccaccctccacagacgctgctgaatccaggccccacttccaaaggcgtcccccccactggatctgtgtctttatgggcttttacccattgtgggggctcatggatttccagaggcaccccccatgtgatttggcttttgccaggatacgctgccacttcctgagattcccagcgtaggccatgtggctgggtgggcccccctgcagtggggagggcctgggcgttcacagtgggggtaccttttgtggtgctgggacacacaccagcttacttgctgaacagccagattcagtctctgaagacccattttctccccaggcgtcaaggtcagacttccagggagtgagtgtacgaggcccagggacttgtgtctgtctcggccccatccccgtgccctgcgcctcctcagggaccaggctcattactttggtaatggcatcacccatttgttccacagatatgtctcgagcacctactgtgttccagccactgctctagatgccggcaagaaccagacagacagacaggtccctgccctcagggcactgacattctgctgggggcactgccagtcagtaggtgtaggatgccagggggtggtaagtgccacagagacataaaaagcgaggtgcacattttgttcaggggtcaggcagcctctcggaggaggttttatttgcactaagacctgaatatcaagaaaggctgagcagtgcagttctggctgagggaagataggtgcagaggcccggaggctggaacagctgtgatgagtccaagacatacacggaggcagccagcgcggctggagagaagcgaggggaggagatgaggtttgcgaggttggcagggccctcccagtcagggccgtgttgaatcagtgtttgagccaaagtgggaagccctgtagaactgtgtgtgtacatttgtgtaatgtcttcagattcccttctaaccacggtggcttttctggtcttggtctggtcattgtcagggacattgtcccttcctgtttttgtcccataaacctccaaggtcctttctttagagtggaggccttggctggagccgggaccactggggaacaggaggctgggggatgttgacttgccttctctgtgggacagagtggctgcttttgtgacctggcactggatagccctgggcagtgagttcccctctcggcctcagtttcctggtttggggaacaggaaggaagaggactccccacccagcacccagcactgtttagagggctccgcgtggcctggtctgtgtgcctggcacagcctgggcaagtccacagccacgaaggggagcccttgtgagtccacgccctgctgtaggcactgaaatgcagccatcatgaaccaaaacgcggtccctgtccatatgagtcactgacttagcgaggaagatggccacagacaggcaaacaactgtaatgtgtgaggcaacgctgagggccctggagggaacggacctaggctgactgcgccaggctccgcgccaggtgctgggggtgccacatggagcaagaccaggccaagcccctgcctatgagctcacgctgcagccctcggccagtcctgccacctccacctttacagtgtgcccagaacctgctcatgccgccccctctgcagcccccacaaggtcctgcccccttgatttccactgggccatcacagcctcctcctccctggtccccctttccgttctgcccccacagactgttcccagccagtgggagcctgtgaactcctgagtcaggcggtggccctcctgggctcagagacccctgcaactccgtctcactcgggaaaggaccaggccctcccggtggcccccaaagccccacacgatctgccccattacctccttggcctgtccttccacttgccccctcgcccaccctgctccagccacgtggcctcctcgctgtcccttgaccatatcaagcaaattcctaccgccctggctgttccttcctcctgggctgcccttcctccagagccctacatggctccctctcccctcctcacgcaggtccctgctcacgtgtccccttctcagcaaggcctgcctgaccactttattttataataatagttattattattattttgagatggagtctcacactctgtcgcccaggctggagtgcaatggtgcgatcttggctcgctgcaacttccacctcccaggttcaagcgattctcctgcctcagcctcccaagtagctgggactacaggcgcctgccaccacgccaggctaattttttgtatttttagtggagatgggatttcaccatgttggccaggctggtctccaacttctgacctcaagtgatctgcctgccttggcctccaaaagttctgggattacaggcataagccactgcacccagcctgttattcttatttttgagacaaggtctcaccctgtcacctaggctggagtgcagtggcacgatcactcactgcagcctcgacctcccaggctcgggtgattctcccgcctcagcctcctcagtagctgggaccacaggcgcacaccaccacacctggctaaatttttatttattttttatttttggggtagagacagggtctcactaggttgcccaagctgatcttgaactcctgggctcaagcgatcctccctccttggcctcccaaagtgctgggattacaggcgtgaaccaccgtgcccggccttgaccactttattgagaattccagcctcccctcccctcagctcctttctgattgctgcgttattttctatgtcagcatttctcacccgacttagtagatgtttttctgatttatctcatacattgactgcctccttccttctagaatgtgagtgctgcgaggacagggatgtttctgactgttgggtgcactgctatgggccccaggcccagcagagtcagcccttggtagacatggacgggtgcgtgggtcgatgcgtgggtgggtgtgatcgggtcacttgtgggtggagtaggtgtttgctaaggcagactctggggatgtgtcggtcccaaacctgaggactccttggaggaacgaggctcagtgtgggaggcctgaagagagatgtggttagaggagggttgggggccgtgcaggatgggggcaagagctaagccaaggtttggaggcaggaatggcttgggggactcaggacagcgaggagcctgctgtgccgggacgggaagccaaactcccagcgcctccaccatcaaagcacatgccagaaggtaggaggtaaactgaggcagggaggggccctcccagagctggtaggtgaagattgtggcagggtggtgagtgggacccaatggtggaaggctgagtgcaggctggaggcagtgagcggtctgggtccccttcctgattcgagtttcattttggtaatgatgaaaggatgcctgtggtcctggccacctcccctgctctgcccctgggcccctgtgttctgggtgggccagccccctcccttccaggggcagcagctttgatcagagcctggagggggcggggcaggaggtaagggtttttgcacgctcacgtctgctgacactgacagctttgtcgcacggtggatcttgcttttccatttgggccagttaaccttgtgggggagaatgggggtggtgggacccttttcctcccagaaaaggtcagaggatgcagggggtgactggaaaatctgaagtgtctgctaggccaggtcaacgctgcctgtcccgcatgttaaagaattcaaaagattttttaaaatttgaaataaacattttagagtaggatacaaaatgcgcttgcatttctgggatcaaatactggacttcagaggcatctgtgccccggctggggcagaaggctgcaccttcctgctgctctgggactactgcccccaggtcccagctgcttatctgaaagatttcccgggtgctgctgggccttgtccaaggcctctgagcaggggaataatgcagcggacagggacgatcattccacggagtccctactgtgtgctgccctgggctacgagggggtaagacagaggacagtccctgccctgtgaagctgacacattctaagggagaggcagatgctaaagaattacacatatggctgggcccggtggctcacgcctgtaatcccaacactttgggaggctgaggcaggtggatcacctgaggtgaggagttcaagaccagcctggccaacatggtaaaaccccatctctactaagaatacataaattagccgggtatggtggcggacgcctgtaatcccagcttcttgggaggctgaggcaggagaagcacatgaacccactaggcggaggttgcagtgagccaagatcatgccattgcactccagcctgggcaacaagagtgaaactctgtctcaaaaaaaaaaaaaaaaaaaaagaattatacacacacacacaagcacgccatatatgtggtaagagccctgaggaaagataaagcagagacaggtgtagagggcgacaggacaggagcagggcttgtgagcacaggcgggcctgggaagtcagggaaggtgggagatcagtgagaggagagttccaggtggggcactcgcccatgcaaaggccctgaggtggaaccatgtctaggatttgaggaacagcagggggacctgtgtggccagggcacagtgagtacaggggtgcttgggagaagaggagggcagcatggtgatgggcgcatcctgtggggactctcaggccacgaggaggcattttgggggccagcaaagggtttaaggctgtgaactctggagtgggcaggactctggaatgggcaggactctggcttccaggcccagctctgctcggtgagcttagtgagagattttacctttgtgagtctctgtttccacagctgcaaaatggggctcagaatggccactccaccgtggttgagggcgcctgcgagctcagcgtcagcgtctgctctgggccatgggtcccttgtggtggtggcgatggtggtgggagtaccgagctgagcctcaggccacatttggtgggaggggttggttttaagcatctttcctgctgcacaggcccatgggaaaggctggtgtacagccattggggaggtgggggccccggggcccactttgtgcttcctcccactacccgtggggtccaggacaggtcacacaggagggagggaccctcactcagcagagactaggcaggagaggaaaggcaaggtctgggtgtagacagaaagaatgggaacggagggagaggggaggccaggaccagccttgagaggatgatgatgatgataataataataataataataataataataaggccgggcgcggtggctcacgcctgtaatcccagcattttggaaggccgaggcaggtggatcatgaggtcaggagatcgagaccatcctgcctaacacagtgaaaccccatctctactaaaaatacaaaaaaaaaaaaaaaaaaaattagccgggcatggtggtgggcacctatagtcccagctactggggaggctgaggcaggagaatggcgcaaacccgggaggcggaggttgcagtgagctgagattgcaccactgcactccagcctgggcgacagagcaagactccctctcaaaataaataaataaataaataaataaataaataaataaaataataatagacaaaaccaacagtgtcacctcagccctccagggcagcaggacaggcaggtaagagcccagccttcagtgccttccatacacaaccgcccaggttcaaatcctggctgcttctcatgtctgcctctcactggctgcttctcctgtccatgccctggacaagggccttcccttctctgggcctcagttttcccattcgtgaattgggatgaggatgcttgtgaggatggaacgggattagacgcacagcagggccggaacccgcgaatctctgcagacaggcctggagtctggtgtccactctgccaccctagctgggccacctgggttaatgaggtccccctctgtgccttgttttccctgtctgtaatccggggcttattaatggcccctccctccaggatcatatgtgggactccgggtaaagtgcctggaagagggctggtatacagtaggtactcagtaagtgctggctgctattggaatggtgaccggcacttactgagcacttactgtgtgtgtgatttgccttggttctgatcccaaccactgtctctgggccaggccctccgtgccctctgttctgcgtaattccttataaaaactccaggaaggccaggcgcagggctcacgcctgtaatcctaacactttgggaagccaaggcagatcactagaggtcagaccagcctggccaacatggtgaaaccccatctctactaaaaatacaaaaattagctgggcgtggtggcaggcgcctgtaatcccagctacttgggaggctgaggcaggagaattgcttgaagccgggaggcggaggttgcagtgagccaagatcgcaccactgcactccagcctgggcgacagagcaagactccgtttaaaataaataaataaatactccacgaagcagctactattatcgccgtctttgaacagaggaggaaactgaggcacagcgtggctgagttgctcacccagggccacatattgaggtccccaggttgggttagagctccagttcacagacacagaaagtgaggtcatatagggccagtcgtggcagccctgctggggtttggagccctaggcagcctgactgccaagcttggagctggcctgggagcccagcccccacccttccctccctgcacctgggcaagcccagcctttctgcctagctcttctccctcttcccaggcctggcacggcctctgtggcccccatgaggtcaggagcatctgttgggaagggagcgcctgctggggaagccggcagggcttggagctgcacaggacggcccagggtggggtccctgcctggtcattataaacatgttcagttcctctgtttgtcctgccctctgtgcagtgcccagagggaaggggtggccccaggcaaatatccggaggcgtgccccttgcccccttcccttgggggtttatgggtgggagggcaggaggccaggcgtcggaggacatcccccagaccccatgctgccagctgggccagccgcccgccctccaggctgctcttgccccgtccccaggtgtcccccacctcagggtctgccccgctgtccgccctccgggcttagtgaggggtcacatggctgatcctcttcccgtggctctgggaactgcctagtgccccgcagtggggagggagcgggatggggcggggcgacaggttcacgatgaagaggcctgggctgggcatggggccaaagggggtggagggacatctgggaggacggagaggccggaggacatgggacgcagatctggaatgacagcaggcagagtgggcaaatggggactgttggggtatgtggatgaccctgggagctgggcctagaaagccatgagagagtaggtcagggccaccaggggtgggctgggctggaaggccacgagggaggggtgggcagcactcagggcgccagcattgggctcagagaaggggctgggcagagacaaaggaggccccccgtccgccctccatcctgggccccagggcaagcagggaaactgggccaaccctgggagccttggccaggcccggctctgaccacccgctggcctcttgggaccagctgagacaggttggctgccgggcccccacccccctcccacggggctcccgctgccaaaccggttcccctggctggctcccatggatggtcctagctctgggcagggcctcacctttcccagctgctcccaggaaggcagcctgagccgggaggagaagtaggtgtggaggggctacgtgcatctgcgcgtcctctgtcctctcactagggctacaggacttgctgtgccacgcgctgtgccaggcgcgggggagccagctgggacaagacagaacagaaactccacctgcatgtcccctcgtcccctggtctcaactcttcccctcttcctggaagccttcctgctgcccaccccgcgtccctccagactgggtcccgtgctcccgtcccccagccctgaccaccctgggcagctgctgcatggggacaggtctgtctgccccacacgaatttcccatgaggtcaaaggctgtctgggtcactgcagtggccacagaggaggcccattgctgagttattcccaaatgaatgaatgaatgagtgagtgaatggatgcattcctctcattttacagatgagtaacccgaagcccctagaggagtggtcacctgcctgagggcacttctgtcccaccagcatcagaccaggtgtgtgcaggtgtgtgcgactccagggcccaggcccggggcagctggggtggggccttaggggggagcaggacctgggcccctcctcccacaggcactgtgggagccgccccagccatcacagtggtccccaccgataggccccccatatttgcccagccctgcaccaagctctttgctcccagtcacccattacccctcgcagcagccctgtgggggttcatccacagcacagagaggttgtcacctgcccaaggtcacggcagcatgtgatggagagtcgaactctggcctcttggctccccctcccatctttctccaggctctctatgggatgccgccatcagaatgtctcttcctcagcccctttgttttttaaagtggctttggtcgaccatttgctctgtgcttggtactgtgtcaagggcccgattgaagaccacagatcctaaagataggggagtgtcgcgacaaggctgcctggggtgccctcttaacccaggggatcagtaaccctgtgctgagtcaatatccaaaggtgtgggcgtccccagcccagactcatggctggaccagtggcagtggccaggccatcagtgaccgtccatccagtacacaccatgtaccaggcatagcaggggatgtggggaagcggggcagacgagacccagccagaatgtggcactgacactctagcggtgcggtgtggatgctgcactcatgaacctaagaaggaacaacaaacaggatttccatgagttccgggctgtgactgtgatgtagagcggggggacggcgggacacggggctctttgccttggggtggtcaggaaaggagtcactgctgctctgagaactgaaggaggggacggggagccctgtgcagacactgggaagtgagctcctggcagaggggccagcccgtgcaaaggctctgaggtctccagggggggtgagaacagagaggtgatggggccttgtgggcccgcaggagacagagcggcaggaaagttctgagcagagggacgtgaccgctcgggtgctcacgggtaccctctggctgtgtgtgccacacagatgggcgcagggggtgggcagggagacccagaaggaggctactgcctcctgttggtcccggtgtaagatgaggatgggagggacagagcaggggcagaggaggaagagacatgggcaggctctcactcacccaccgtgattccctcccgcaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaaggtatgtggcacccaccaccacctcccccagcccaccccaacccccgagtggccctggccctcaaccccacactcgaccctgtgaccgacacctcctcactgacatggaaatggagacaaaccccagccttccacccctatcctgggtccagtgctggcctttcaccctccacccactggctccaagtcctaagaacccatgccaccccaacctgagcccccccacggcccatctgacagcccccacaccagcctccaagctctgctgtctcccgcagactcatgtcccgggggccatgctgctgtaccccggaccacactcctgtctcacccaaccttgagcctttccagagctcctggcagtggaagacagacccattcccagagggtgacagccccaagtggtcagggcttgggtgggggagcccggaggaggcacctgacacagaccaggggtccaggcaagcttctgggaggaggggacaccgaggcagagcccagggctgaggaggaggaggagaaattccagcagatgctggggaagccgggctttagtggagaaaatcactcctgtgaaacgctgggggctttttggttttgggtttttttttttcttcctgccatctagagcaaaatggcaaggttgggatttgaaccaatgtctgtttccaaggcccgtgctcttaacccctctgctgcctccatgtgaaatcataagagttgtggagccggtgtctgggtgtggcctggcatgaggctggcctggcctgagcccgtgctgggcctctgaagccagccttggagcctggactctctcccatggtcagtggggaccaggaggggccgcaggccaaggggaactcggccaggtttgcatccagcgggtggagatgggtgtgcctggggactcaccctcccggtgcccagcccagcctggcggggagaagccccaaggcccacaagttggccatagacacaagtgcagcctcagtgtggtagcccactgaggggtccgtgtggtccttgcagggtgcttttgaatgctttgacttctttgcctccactgagaaagtgacagacttcacttccaaagccgtttctggcatctggtgacagaccagctggaggcgagtggcagctgcctccacgggcagggcactggctcttctgggccacaggccgcacccgacccacctcagctccacgccctgcctggctctgtggccacttgcatgtaggctttgcccccaccaaggtgtctccaaaaacccagcccctgcctggcttgccagatgtgaggcctgcctgtgactgtcccagcaggaggcagggcacttgaattcacacatggggccttgtggccagcactgtcctggggccccataggcacttgtgtttgctgcccttgaccgggcctcaggcctcccaggaccttctcgactccctgttggttttttttttttttttttgagagacattcctgctctgtctccctggctggagtgcagtggcgccacctcggctcatgcaaccttcgcctcctgggttcaagcgattttcctgcctcagcctcccgcgtagctgggattacaggcgcccaccactatgcccatctaatttttgtatttttagtagagacgggttttcgccattttggccaggctggtctcaaactcctgacctcaggtgatcctcagcctcccgaggtgctgggattataggcgtgagccactgcttcttgcctcaacgccctgttctaacagcaaagtctggccttgtgtccaccttgacttcctggggcccctgggcaaggcccggcttcaggcagacagccacggccaggagagacagggcagcggcagaccacggattttgtgggatcagtgttttctacacgttacaggcaggcctctggctggaggatgcctggcagccccaggcagggtccgggtttcgtgggatcagtgttttccacacattagaggcaggcctccggctggaggacatctggcagccccgggcagggtccttgtcagcagggcccacgttctcagctcactgtggcctttgcacagacacctcactcactacgtggtttagcaaaagttcactgagcccctgctgtgcgccagatgctggtctaggtgctgagatggagcaggacccgaagcagacaggaaaaaacaatccctgcccagagcatgcactaggcagagccgggagcagacagatgcctgtgtgctctgtatcagctgctgttaggtgctctaggtagaatgcaggcagggcaggggccggggagggcaggggctggcattttagatgatgggaggccagcagaagcctcactgagaagctgagttttgagcaaagacctgaaggagtggagggagggagccacagggaccctgagagctgatgttccaggcagagggagccgccagcggagaggccctgggcgcaggggggcgggggtgggggagacacccgtgtgtctggaaatggaacaggggcagagggggcctgcaggacacgactcagaccacagagggtggggaccgggtgactcgggatgcactggatgctctgcctggtccccatctgcatttgtatttgccacccggctcctgggacccccttgccctctactttgggaccaggcctttctgactctccctgtcccccactccttgttgttcatgggagcagagagtgtggttttggggctaaggaacactggcgcccacatgggaggaagtgccaggccaggccctggccccagcgccctgtcatttgcagccctcggggctgattatggggtgggtcaatttctgcccttcctcccccaaacccctcagggcaggactattccaccagtgtgaggaacaggagaaaaacaaggggggcctctccagggtcccaccgagcccagggggcagcagcctggccatggcgatcactcctctggcccctgcagctgtgtccccagggaggggaggggctgcactgcccatgccattgtcactccatggcatctcttcattgcgtctctgtcttgtctctgtgtgtgtcgtgctgtcctgtccctgcgtgtcggatgcacgtcctgtgtgccccactccttgctgggcccccacccaccattgcctgggaccccagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggcccagggaaggcaggcagccgaggccggttcgccggtcacagcgaggcgggtggcggcagtggtgacaggcgacgggcggggccagagaagaggcccaagtcttccagggagggctcagggggtccccaggagtcctcccgggacaaacgccccctctccgggcctgatgtcggcaccccccagcctgctggtctggccagtggggcgaaactggcagctggccggccctttaacacctacccgagggctgacacggaccacccatcccggggtgcccaggtaacccatcccccgccccagggcccccactgtcccctgcccgttgctcctctgtccccaccttccagccccgccccaccaccgtgcatctcatcctgaccacccatgtgtctgtcccatcgctgggtctctctcctgcttagggagcagagctgctccctggcacccatcactgacagctacctctcttctgtttcagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtgcgggcgctgctgccctgccgccctgctggtcctcccacccctccctcccaccctccctcccctcctccctcctctccctgcactcctccgtgctgggccaggctcccctcctcccctcactcttctccctccccaggccgtctcgtccgccccagctgggtccctgcctctgtcctcacagcaccctcacccacatctctgtccctgagccccagacccagggttcctcgggccactgacccccgacccagtgtcttccaggcccctcgcacccactgaggcccgcctgggctccagggtacagtgtcctccagacctgcccctcctgggttccctgtgccccgccctggcctccactcctgggtgtccctcggcacagcccacacaaccaccaagagtatgtttctgacgttcaggcccaccccctccccgtccctccttagagaccctggcagtgccccgtagcaccctgacgataggaagcccaggtccctttgccgggtgtgtgaggcccctctcgaccccgttgcccatcacagtgccgggctgcaccatggagctcctcgcctgggttcctcatcctcccgccgacacacgcctcttctctcatccttgcccttgtccgggtctcagccctgtgattgaacgctctcttcccacctgccccccagcactagcccaggactgacctgagatgggcgtgtgcccaggggggcgcgcccccagaagggaggcgtgggcttcaagctggctctgaggcccacgtggctgtggcagtaggggagggcagtccaggtggccccagtgagcacaagcttaatgtggaactgcagggggagccaggggggtggcggtggctgggtctggcactggcagccctcccgcctccctccaccactgacccagcccctgcacaggtggtaatcatgagggactaccagcacgagaatgtggtggagatgtacaacagctacctggtgggggacgagctctgggtggtcatggagttcctggaaggaggcgccctcaccgacatcgtcacccacaccaggtatttctggggcctcagacccctcctgtgacacgaccaagtcccctccagaccactaggggtggggccacatctccaaaccagctgtgctccgggcccctgggatggggtcgtgtcttccattcctcccactccagagtggggtcgagtggtctcagattcctcccactgcaaggcagggctgcgtccccctcggcaccccggggtgctgtccagctggctgctcaccccccaccccaccccgcaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaggggacgggcggcggggtacgggggcggcaggtttccggctgcggggcttccctgcctcttcccatcccctgtgagggtaggtgagctctgacccccaggtctgtgtcttgaggagctgggaacttcgtccctccctggtggagcagcccagagtcaggttccagctcagtggggactctgtgcagtgggagggcacaggctggcgggggctctgccatcagcacaggacactgggcccaggggcagggatctgggcagacagcgcagcccccgccacaggcttcttcctccactgaaaagctgctccctgcccagcacccagggcggtccatggaccccagtcctgtcttccatgctttggactgaggttccaaatctgaggctgtgacaattataacgtcgggtggacatgattttctgtgagagagggcccttgacttgaatgaaatgcttgcagaagtggatgactccatcccctcccccaaggaagattaagccacaccattagtccaggcagaggcagagagagctctgtgtcactgacagtctgaaaatctccagatgtctatagatgtgttttgggggcgatgtctatgggccacctgagattgtccacacacggttgtggggatgtttgctggaggcaggaagacccatagaaatcctcaaaaatcggaaagggacccacagttcctaagaaggtgtgagaggcctggttgtcgcaaaggcaggctgtgtcccctcacggccctagtgcagggctactttctgctccaaccgaactaaagacttgttccagggcagcagggccccagggcacaggcttttggggccacccctgttcccagctccggccctgcctttgctatctgcagtactcaggccagtgtccccaaaagccccagaggctgtcagggagggaaatggggggatcgtgggggaggtgacttgcccgagggcccccaccaggaggtggtggagctccccattggtctggctctagaccccagctctgaccctagaccccagctctgacctctgggccgcacattgtgtctgaagccaaggaatgacgcaggcagacgcccctgctcgccctcctgctgtgccagctcctctgaccccactgcctctgccctgtcccaggtgaagctgtcagactttgggttctgcgcccaggtgagcaaggaagtgccccgaaggaagtcgctggtcggcacgccctactggatggccccagagctcatctcccgccttccctacgggccagaggtgagccccggggtggcttggttgtcccgccgtggacagcgtacgctgccattttccagctgcagcgctggcgggagatggggcccagtctggggagtcattgccaggaatggtgctctggacaaggaggtactgcaggcatgcatgtattcattcttcttttttttttttgagatggagtctcgctctgttgcccaggctggagtgcagtggtgcaatctcagctcactgcaacctccacctcccgggttcaagcgattctcctgcctcagcctcccgagaagctggttttacaggcacccgccaccatgcctggctaatttttgtattagtagagatgggggtttcaccatgttggccaggttggtcttgaactcctgacctcaggtgatctatccgccttggcctcctaaagtgctgggattacagatgtgagccaccgcgcccagccttggctctgccttctgagcattgttttcacaggccggctttccccttgtgggagcagagctggtcccggcagctctgggaagtgtctcccacctatgggctcctctctttccctgggtgttttgggtaaagtccccaggttggctctgattggctcagcctgggtcctgtgcctgtttctgaaccaatcactgtgtctccactgtggtgatgaggccgcatgggtcctgaacccaccagtggatgctacctgggctgagggagggaggacacctgggggcagttgacagaaagaagaggggtgggtgctgggggggcagctctcttgaggggctccctggaggactagtgctctgtggactgctggctgggtgcccaagagggagttctgggccaaggactccaggagccagaggcagagacagcgctggagcggtccctgcctgaggcctccccaggacccaccatcccccaacagctcagccctgctgtcccttctcccgccccaggtagacatctggtcgctggggataatggtgattgagatggtggacggagagcccccctacttcaacgagccacccctcaaagccatgaagatgattcgggacaacctgccaccccgactgaagaacctgcacaaggtaggcccctccctggctgggaaactgtgcgccagctggcgggtggcagggctccaggtggagcatggggtgtggatgggatggggacaatgatggcgcctgggatggcgcttactgtgtgctgggccccccacccccgggcctcatgtgtctgtgcagaccccctctgtggggcctgggcgacagaggcagcagagccacaggccctctgcaccctcaccattgccctgggccccacccagccctagagagatttgcacgtttagaagtggaggacagggccgggaccttcctagtggaggacttgccaggagggaaaggggcacctctgggccccagttgctttcagcttcttgctaaaccatggaaatagggagtacatgagcccccagggtttgtcacttcctctggggccacatagtaagcgccatcacaggtgccatcactgtccctgtcccgtctacaccccaagatctagacacccatgacctccgccccctgccctcctgcacagtacatgccgccagccgacttggcagaggcggacactgcagccctacagcaaatgaacagtggggagcctcgccccctgaccctcccctccttctcgacaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgtgcaaaggtccagccaccccgtcctccagcccgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgttttgtgtctgtgtgcgatgtgtggggggcagggggccctgcccggctgtcttgggtgggaatttgcagggagagggtctggatctgggagcaaaccacgattccagccaaggcagggcaagggtggggtggggagtggggagttcaggtcatagcagccagtaagctcccccagcctgccactccccagaatggggcaggattgtccccacccctggaagcagccagtttgccacagtccatgtgcagactgatcccagtttgccaaatctgcaatttcctggaaccttttaaaggctgtcttgagcgcgtttggtgagtaggagctaacccaagttagtaaattgaaggccatttggcaaattggtcagtgggcagatgggcttttggggattgactgaggctgactggcctggagctgctggcttcggagagacaccctgtgaagtgtgtccttccacgcaggagcccagagccgagcccacgctggggggaatctgactggcatggaggtggccatgccaccatcgctgctgcagctgcatcctggcactttgcgcctcaggccctgttgggctccactttctgcatcctccccagcccccagggaggcagtggagtggggagagagccaggagtgagcctccgtccccaaagccagccaggcgtcatcagcaccagagacctcagcctggtcctctcgggaagtgagtggccagggcagagattccaggttagtccacgcctcccacccttcacaggtcctgaccccaagaatcagagcactgtgtgtgtggcagggcctatgccaagtgcaaacacagcctagatggatcatcacagagtgaaacccagcggtgcaagcagctgtgctctctgcgatgtattggaggcttaggtgaggtggatgcctttctggaaaaaaaaaaaatgctaacattggcaaaagaagaaatagaaaacaagaccaaaataactgtctcctcactgcacacacactccagaataaataaaaggtttcaggcttgaatgcactttcaaatgagattttttttttttttttgagacggagtatcgctctgtcgcccaggctggagtgcagtggcacgatcttggctcactgcaacttctgcctcctgggttcaagcgattctcctgcctcagcctcccaagtagctgggattacaggcgcttgccaccacgccaggctaattttttgtattttgagtagagactggatttcgccatcttggccagactggtcttgaactcctgacctcgtgatccacccacctcagcctcccaaagtgctgggattacaggcatgagccaccatgcctggcctcaaatgaggtttaccagactttgaaggagcaggtaattccttctaccttgtgaacaagttgttccagaaagatagcagctcaggaggcctctgtgaccatggttccagacccagataaggacggcaaagaacagagcatctcagaaacgcaaggctcacagccagggtgcccggcgaccccacgggcactgagaacagctagctctaggagctccactctcctgctgaagaaaccacgggctcagagacggggagctccctcgcccagccacatctgtgaccccacggtaactctgctggttttggtgccttcagtcactcactgcaggtttgttttgttttgttttgttttgagtttttttgttttttgttttttgtttttagagacaagatgttgctatgttgcctaggctggtttcgaactcctggcctcaagggatcctccctccttggccccgcaaagtgctgggattacaggcgtgagccaccgtgcccagcccgctcactgcagtttgaaggcatggctttgggtggcgtggggtgaaagctgcccgaggccccgttcctccccacgtggctgcctcctgccagagccagtcaggaaaacagaccccaactagagttgtttcaaatggcagggatttggtaccggtggttg

SEQ ID NO: 12537 - DNA, 119649 bp, Human
cctggagctacagatgcgtaccaccatgcacagctaaatttaaaaaaaagaaatgttaaggccgggcgcagtggctcacgcctgtaatcccagcactttaggaggccaaggtgggtggatcatgaggtcaagagatcgagaccatcctggccaacgcggtgaaaccccgtctctactaaaaagcagaacaaaacaaaacaaaatacaaaaattagctgggtgtggtggtgcatgcctgtaatcccagctacttgggaggctgaggcaagagaattgtttaaacctgagaggcggaggttgtagtgagccgagatcgtgccactgcactccagcctggcgacagagtgagactccgtcaaaaaacaaaacaaacaaacaaaaaacctttatttttggagagatggaggggcggtggggtctcactatgttgtccaggctctccttgaactcctggcctcaagcaaacctcctgagtagctgggattataggcacaagccacgatgcctagctcaagaacaggacttcctcacagttctggagactgggaagttccaagatcaaggtgtcggcaggttctgttgtctggtgaggactgttgtctgcctccaagatggcaccatgttgctgtgtctgccagataaaggaatagcgtgtcctcacatggtggaaggcagaaggacaagctagtgaataccgcgtgaagctgctttgataagagcctcaatcccactgaaggaggcgccctcatgggctgatcacctcttaaaggtcccacctcttaatcctaccatgttgccaacgcctgagttttggaggggacacattcaaaccatagcagagtccattcaatagatccattaagagctgggatttgttcacagatggggcacacacactttctctaactcccactcccattccctgtctgcttatttggtaaaatagcctcctcaaatatttctgaagcctagttcctactataattctcagttttcattcactcattcattcattcattcattcattcattcattcattgttctgggcactgtgctgagattaaagctgtgaaaagagggatagggacatggccctgtcttcccgaatcttatagtctgtttctttgttgatatggcagctctcccaacctcctccttccaggccaagtctctgaatctctgacctttagaagaaaatgaagactctgccggggtccagcctgtctcctgcataactactgggtgaagactgcagtcctcaggatgtgttgtgacgttgccaggggtcccctactattttctgtgcactgaaatttctgagtatggctagaaaggctgctggagttggggagcgcaatactttcacctgtgagacaggaaatgcgcccagtattcttagagacagactctggggctggtgatgtcactgttgcatgatttgtgtcttaacccagagctggaggagagtatccttctcgggtagctgttcccagctctgtgtaggagtctgcccacctaaacaggtgtccaccaggaaggcatgacgtgggagtgaattgccagtctccagccctgctgggtcttgatcttcctggtgggctctggcagccccattagtaattggttgactccctgaggagtgcagagctggcagtggggccactcctggctgctgagtccaggactactccgggactcaaccttcccaggcgtgcccagccatgccctggctgcttctgggtgtccagctgcctccgtggttggggaagagagaacttgctggagagtcctttgtggaggagccttcaagcagtgccaatcacggcactgggctcattagcaagcattgccatagcaacgggtctgccagaaagtggctcgttaggctgacaacttcagagctgttatatatagatctgggtgtggggggagtgggggtgtggggccctgtggatatgcttttctttagagctcctattgcttctgggtttggggtgtgagaggatgcagagtgggagaccttaaaaccgtctgatctggctgctaaagcgagtgtctgacgaccacccattaacaccagcgagtagcgtttgctcacggctttaggataaggtaagagtcaggtgttctcagaaacctccggagggggagagagtcccggaggtggaggtggcatccgggttgaacttgagcttgaagcatggtgggagcggtagggagcggagtagcagggtctgtactgcctggaggctgcagagacaacctccaccgtctgttaaatagtttatttgaagggtttggggcaatggaacagaatctttttctttaataagtcactgtgcagcccaacactgtctttttacaaatcatgcttataaaaattctatgatctcagttttcatttcagaagtgatgttttttctcagttgctgcctctaatgctgcaacggagtggctttagagcacaggactcacccaggatcactgtgacaaatgcagcctcccaggctgctctggagattgagtcaggccccagagtgtgcacttgaactcacatcccaggtgactgctggggtggcccacggtgaccatactttgaaaaacactgctgtggggggatttgtttttgatctctgtaatctctgggtgactttgcttgcctgcttttttttttttttaaaggaggaatcagtagccaccattaaggggaaaattttgggggttgcgttgtttttttaaataaagagacaaggaagtcagcctacagctagggaacgtgacggcctggacgcgggcggtgatatttttgcacatcatatgctcacttggggactgggagacaggaggatcaggcttgagttgtcatcctccttgggaaggagctggggtgtcaggtggtctcagtgaggaaatggagctgagtaggtgtagctggggagagatgtggcccaactttaaggtaactggatagaagtctctagaacaaagctattattttaattaattaattaattaattttgtgtagagatggggtcttgctccattgcccaggctgcccttgaactcctggcctcaagcaatcctcctgcctcggcctcccaaaacactgggattacaggcatgagtcactgcatctcgccagctgatatttttaagcagtttgtttttaccattaaccgtgccacactgggcaagttattaaactctctgcgtctcagatgccttgttttaaagcggggataaatgccatctatgaggcaggcttgttgtgacgagtagctgattgtctaaagcacccagtccagtctggcatgcattatagatatttggtgactggtaaaaagtcattatcgatgggtacagatggacctgggctcagatatttctcgagtcctttctagagtagggttctgaagtagtgtagaaacctcctgatattacttatgaaatagcgtgtgtgtgtatgtgcacccattttaggggacagaagatccatagccttcctcagattcttaaaggatgctctttccatatatatcattgagcaggttgcctactgaacaaggaggcccaggtgagggtggatggagagggactgaagcctgtccttgcaatctggccaagggatggtcccttccagaggaagaggccgcgttttattattcccacaaagacaccctgtattaggtaaagaatttctgagttagaaagaacttccttcgttttcccccaccccaaatcctgctacctctgatcttgttccttccaggtggggtctgtccccagcccccgggcctgtgtcacctctgcttccagtacagttcccacgggaaagtgctgacagaattgaagggaaaaagccacaggactaaggaagagaagggaaggatttaacttggaaggaaactaattagaagaataagattgagagagaccttaattattgggtggttatgcacactgtgtcctctggatgcctgggggccggctgctcttgcccctctgtggccatgaagggtgaggtaatgctggtgctgttggcccttaagtgaagacttgaaggtaggaaggtctaacttctgccttcgcagaaggcagaaaaaagtttttttatttttttattttttctttatttttgaaacagagtctcactctgtcacccaggctggagtacaatggcgcagtcttggctcacggcaacctccgcctcccaggttcaagtgattttcctgcctcagcctcctgagtagctgggattacaggcacctgccaccatgcccagctaatttttgtatttttagtagatgcagggtttcaccaggttggccaggctggtctcgaactcctgacctcaggtaatccacccaccttggcctcccaaagtgctgggattacaggtgtgagccaccgtgcccagccaaaaaatttttttttaattgtggtacaatacacatgacaaaatatttaccatcagtgatatatttatgtattcatgatattgtgcaaccattaccacgatccagttccggaacagtgtcattaccccaaagggaaaacgtgtacccattctcccctccccaggcctctggaaaagacaaatctgtttctgtctctatggctctgcccattctgggcatttcatatgcatgaaatcatacaatatgtggtcttttgtgtctggctcctttcacttagcataatgtattcaaggtttatccatgttgtagcatgtatcacggctccatttttttttttaatttctgaataatattccattgtatggctgtactacactatccatccatctgttgatgggggatttgagttgtttctactttttggccattacgaatgatattgctgtgagcatccatgtaccaatttttgtctgactgcttgtttctaggtgtttgtgtctatacctggttgtctccatgtcttttgacttttaaagtcagccatcaggaggaactcctttctaagagaacagaaaggtgatgggactgtggctgcctcgggagatggaggcagagtgcggccctgcaggagggagatgtggagaccatctttgccacatcagccacattaggagatgggcctggtggccccagtgccctcctccccacctctttcagcatctcatggcccttcacggctcagtatcagggtgcctcccaccttctgtaaggtcctgaatttcctcgttgcgggagacctcgtggtcatcagtgccttgcggagaagggacggcatcattattgctctttcctgggtgggacactgaggttcacaggttgggtccactggctctccagctcctgtaaggagtggtctcctcactgcccagccctctcaccagaacgcactggccagctctcaggctgttaacctccccagcaggtgtttgccgttcaagtcgggtagtattggaaacagaaacctcagagaagtgactgttgatgctgacatttcagacagagggatggtgaggctagggtggaggtccgtatcgccgtagacggactgtgtgaagcccttccagtggaaaaccccattcattgcgcatccctcaggacaggcgctgccctaggtgctgagttacgtattgttaccctctccgtcgtcttccacaactgggctcatattatcacccttcgtttcacagattcgagaatagcctggtgagtcagtagcctgtggtcacatggctgtcaagcggtccaggcaggattggcactgaaggctgtttgagcctgagggctgttttcgctgtgcctgtgggttcctgtctcctgcaccccttttctgaccatgtcaatatttgatccttcctatttcctcccaagttatttggataagtaccaatatggctttcccatgtttgattgaaggagaaactagaatatttcactcaaggggaggacacctggcatcttgcccctctggttctagaatctctttcatcaaacactcatgcctgtagttgtatttttttgttctttgttttgagacagggtctcactctgtcacccaggctggagtgcagtggtgcgatcacagctcactgcaacaacctcctaggctcaggcaatccttccacctcagcctcctaagtagctgggaccacaggcgtatgccaccacacccggctaattttaaaaattatttgcagacggagtcttcctatgttgcccaggctggtctcaaactcctgggctcaagccattcttccacctcggcctcccaaagtgctaggattacaagcgtgagacattgcacctggccctaaccctcagttttaatcccctgaccccccacccatgccgactttatttctaatcctattggacagaatgttcatctcctgtgcatgggatacttctctttctctcaacatgcacgcgcgcatgcacacgcacacacacgcacacatgcacgttgttataatcctatttgtcttgcatatattttggctatcttccaatcctggagagtccaaagcagtgagagggcccaggtaaacctgcccagatgtgggcttgtgcttactggacatgctggtgagacagcaacctgcgaccctggtgggatgccacaccgtgttgatcctggctgctgtccacctcactgtctcctgctgtcttagaagacagtcttccatacggaatcaaacgggcactgcaggttagcaggtgtaggagatggagcgtccagggcataggggaaagcttttaattaagttgtgaaaatgcattgtgaaacttacaccgcagctacgcagagggcagaagggaggctgtgtttactcaaagtccccgagcagctcagatttactcgttccctccaatgacatgcagggcactacgggaagccacggcacgtggttttgcaaccttcacaaagcgtgagagtagcctgggagctgtgtgtctctgctgctctctttcattctgttatcttgttttcctaagcgggggtcaccagggaccaccactatgggcacagctgggggatactgaggacatttgggagccgattacctttactgtttgtgaacagtcccctggctttgctgagaaattcatggctactctcttcgtatggctacaattctgattttaatcaatttacttcaaaaggcacagcaatcttacgggctaatttggactctctgtcctaattttaaaatgttctttagctaacaacttttatttctgtgtttatgggagaaaatttagggggaacagatatgtagaaaggagagtataataattgcctgtaatcccagcacccagggatcgtggctgttttttgtttgtttgtttttatatttttgtttgtttgttttgagatggactctcactctgtcacccaggctggagtgcagtggtgcgatctctgctcactgcaacctccgcctcctaggttcaagcaattctcttgcctcagcctcccgagtagctaggactacaggcgcacaccaccacgcctagctaattttttgtatttttagtagaggtggggtttcaccgtgttgcccaggctggtcgcgaactcctgagcttaggcaatccgcccgcctcggcctcccaaagtgctgggattacagacgtgagccactgcgcccggccatggttgttttttttttagcatctgtctactagatatctagtttctttgtatgtcatatacatttttctctgatttgttttttaacgaaaagtaattctatacatggttaaaagaattaattgcacataaatgcatacaatgggaagtcagcgtctgctctgtctccgagtcctcgttctttttgccagagtgatctggacccttggcgagagaagctccatccagctcttcatggattctcagcattattatagaatgttttgcatctggctgtgggatgacttgcattaattacttctgctaggtttgcacagcaagcctggggccttgtctgctgctgtgcttcgtggtctgggaatttcaggcttcagatttcacaatgggaggtggtggagtgacagggcccccttgcaagctcagcaccccgtgagtgattttctagggggccgtggagaaagtctagctccattagctgaatggcattttcctctctgctcccagaggagctgtcctctgtgcaggggctctgaatgctcaggtgcttctcactgctcatgctcacgcaaccccggaggtcacgtgtgtgctgcctctgacctcaggggtttatgggccgcagacttcccaatgtcacgctactgtagggtgaattcatcagcctttgccttcctggtttaaaaactcttgcaaaaatgccaaatgggtgtgaccttttctttcttctccaacagaagcctggaatggtcccccctccgccgggagaagaaagccagacggtcatccttccacctggctggcagagctacctgtcgcctcagggccggcggtactatgtcaacacgaccaccaatggtgagtcccgctcgggggagaatcctgcaccaaccccctggcattctggctctctagaggggcacgttttttctcccttcttcgcctctctgtttgggggttttttcttcttaagtctatgctcaggggctacagtaaagtcttactcctcccactgtgctgggtggtaggggtgcaagtctgggtctgtagttctgggagtatcttggaaggaaggctgccctttatggtttgagtcttccttggaccctgacgtccaccctgggtatctgtgttaaacccaacctgttcgtctggggctgggttttctgaagggtgtctcaaaaggttctatggtcaacagctggcttgaataaaatgaacgaggcaaagtcactgcatgatgtcttggaattttgaaggttttaatgatcttgaagcttcaatacaggggttgcaaatgcgaggtttccctaatttcactacaacgtcatctttttccttaagtatctcactggctggcatttctccagatgttttttgggaaatgccgggggtgcttatgggttatttatcccatcaaatagtacaggttccatgtgcatctgagttgaataggaccacacctcaatgaccccaataattagggacctcccaggccttcaaatgaccccaggatccccagaagtttgctgtggatggtttataaaaggggatgcaccacgtggcaggttctgtaacaaggtgagcaaagggcactgttgcaggctgtggtcttgggcagggcaggacagggtaaaccagctgaacagagctgtgtcttgacctccgtgactccccagagaaattgccatgagagaactgagaggatttaaaccaaggaaagttagatttagtgggaatcacagacatgcgttccaaggcaaaagatgaaaatcgtacccaagtccactgctggctcagccttggcctctcactcctctgtgcctgcctgactacatgaccaccccttcccacctgggggtatcgttactacagctgatgtttataagcctgcaccaggagggggtcctagtgacaggggagccagctactgtttagcagagacacaaagaaggcagctggtttattcgtatcccctggcaacctgaccttccacaggctcaagaggggtgttctagcgcaagaggtaatgaagtttctaggaaaagggaagtaggactatttctgaccgttctaatcttacacttcctcaaaacaaacacatgaacagctttgcactgttaccggagacttgaaatttcagaggagagtgtgtctatgtatgcaacacccatctgccaaacacagaatttggaccgtaggatcatgagatcatcaattatttgggacaacattggatccaaattattggaaggtcaggttgctaggggatatgaataatttggatccgttattgtcccaaataagctactctattgcaaaggggcatggggggaaatggctttctgaatttcagcatctttatctttttttaagttagagactagtttgttttcacggtaaaaaattcagtaagtacaaaatgatttcaaataaaaaataatccccggtctcaccttttaaacatatgtatacttattcttttaaaataaattggaaaatattgtctatgttgtcctttaagttactttgacagtgtatgtggacatctttctatactttgtacatttcagtctaacccattcttttaaacagctgtgtagtaatccatcgcatgggtatgctattaatttcacctgcactctattaatttaagtcatattttatatcaatagacagtgtctggcagcttttttctgggactcagactttagcagatgccactggtgacagctttcttatgggtcctgagatattgtgatcccacagaggctccaggccaggggtcagtgaactttttctgtaaagggccaagtagtcagtatgtaggctttgagggtcacatggtctccatcccagccactcagctttactgtttcagcatgaaagcagccctggatgataggtaaacaaatgagtgtagctgtgttccaataagactttatctatggatccgaaaataggaatttcagatgacttgtgtgtgttataaaatatcatcgttctggccaggcatggtggctcatgcctgtaatcccagcactttgggaggccgaggcaggtggatcacttgaggtcaggagttccagacaagcctgaccaacatggtgaaaccccgtctctactaaaaatatcaaaattatccgggtgtggtggcgggcgcctgtagtcccagctacccgggaggctgaggcaggagaatcgcttgaacgcgtgaggtggaagttgcagtgagccgagatcacgccattgcactccagcctggtgacagagcaagactccgtctgtctcaaggaaaaaaaaaaaaaaaagtggaagatgattttcgttggcaagttcactgggccatatgatagttggtttgaccagttggtcccttggaccatagctgctggtccctgcttcaggctgtctgttggctccacaaggacttgtcctatttgcccttcctctctttatttatttatttatttatttatttatttatttatttatttatttttttagacagggtctcactctgttgcccaggctagagtacagtggcacaatcatggctcactgcagcctcaacctcctgggctcaaacactcctcccatctcagccccctgagtagctgggattgcaggcatgtgtcatcacgcccggctgatttctttatttttttatattttttatttatttgagacagggtctcactctgttgcccaggctagagtgcagtggcacgatcatggctcactgcagcgttaacttcctgggcttaagtgaccctcccacctcagcctcctgagtagctgggattacaggcatgtgccaccacacctggctttttgtattattattattattattattattattattattattattattttttgtagagatgttttgccatgttacccaggctggtcttgaattcttggcctcaagtaatctactggccttgaccttccacagtgttgggattacactatgcctaaaaacagttttttttgttttgttttttttttttttttttttttggtagagacagggtttcagtatgttgcctaggctgatcccgaacttctggcttctacttctgcttcccaaagtgctgagattataggcatgagccaccgtgctcggctctctcctcttttatgctaaaaataattccagcacctaccttggtcttacattctagatatatgccagttttattcattacttgtttaactctttttttttttttttttttgagacggagtctcgctctttcacccaggctggactgcagtggcgcgatctcggctcactgcaagctccgcctcccgggttcatgccattctcctgcctcagcctcccaagtatctgggactacaggtgcctgccaccacacctggctaattttttgtatttttagtagagatggggtttcaccgtgttagccagggtggtctcgatctcctggccttgtgatccgcctgcctcggcctcccaaagtactggcattacaggcgtgagccaccgtgcccgaccttaacttattgtttatctgtttgattgaatcattccttcaacacatagtttgagcctcaaatatgtaccaggcagagtgagtcttgggatactggggatttaataagaacaaagtctctgccctgcaagtgtttatcttcttatagtgggaacagattttaagtgaaaacctatttgatcaatcaggaaagggttgtgaagcaggagtccagggtgttttaagagcatgtcacagagagaccctggggaatcaggggaggcttcctggagaaggaagctgcaggatgggaagggtaaggaagggctaggggatggggagtgtcttactgatggcaaagagtcagctgtgtttgtagggatcatgcagcccatgaacatcatattaataattttgctcggcagtctaagggagaaggaaagcagctatctttctgattctcctctggaatcgtttcttagacttgttttgtttggctgtagggatgttttaaatatattttaatctgcctgcctttctgcaggaaggcatctatgagaatagccactcatgtttttcttacctcctgactcctggaggcacctgagcttgtgcctcctcactgctgggccagctgcatctatctgcctttctgcctggccccttgcttaagcatctttgctctgtcgctctccaggtggcatttcatccacatgctagcccagtgcccagaaagtgcagtcccggttctaagcaggccattcttctcttcctctttgtctgtctacctttcttccagacgcttctagtctttctcccttaatccctaatctcttcttttccagagggtgcctggggataataggtgttctgtccccatttttacacctataaccagttgaaagtctaatttacatttgtattaccttgccttggctaatctgcttcttttcttttcttttcttttttttttgagacagagtctcgctctgtcgccagactggagtgcagtggtgcgatctcggctcactgaaacctccgcctccccggttcaagcgattctcttgcctcagcctcctgagtagctgggattacagacatgcgccaccacacccagctatttttttgtatttttagtagagacagggtttcaccatgttggccagcatggtcttgatttcctgacctcatgatccacccctcctcagcctcccaaagtgctgggattacaggcgtgagtcaccgcacctggctggctaatctgcttattttcacatccatttaggattttatggatgaggttgtcactgtgctagccactgagccgggctctggggatccaaaatcaaactagatgctgtctgtgatctcagaacctgcagttctaatagggccagagacacatataaacctataagtgttacaggtattcgtgtggaaatctgggggctcgaggaagggagtagtcagcttgatctgggtattaaccaagtctttgcagggggagggggcggccttgactcaggcattccaagccaaggttacagcatgagtaaagaccaggcaggagagaaaaacagcggatgtgtttggcattggttaaggaagaaagaggtgagagagagagtcaggggccttggggcattttgaggagtcaggtctttatcctgtaggcagcgggaatccatgggaaatttccaggcggtggcgtgacatgatcagaatattgtggcaaggctgcttgtgcggcagagcgaaggctttaaggccggtaagcgtggaggccgacagactaaatgagaggagaaataatgaggtcaaacaccaattctacagcagtggctggagaggaggaggtagaatctgtcagacaggatgtggctgtggcaggtcagggattggaagtgcctggattcctccgggttttctgccttgtgtgatgggaccatacagtgagtatagggtattcaagggaggaacaggttaggaagaaagaaaaatgagtccatgctgagtgtgtggttccctggggtgcgttctgggagagatggctggcatttggatggctacggtgtgacttagaggacttctgagctagagatgggaacttggtgagccatgtgggtacatggcctggccactgttgcgcagtgaccaacctgcccagccacagagggtggcccaggatttgtgtttcatcagcagagaggtgaagtgatgaggatgtagaagatcacccggggccttgcagcacaggtgtaaggcagcagccaaggagaccttgaaggaattgtcagagatacaaggaatccaggagaaggtaatgtcatcaaaggcaagggagaatagatagggaggggtagtcagggacagactgaaatatagatcaggtttatgataagagtgttgttttaaatcactggggaaagcatggattatttagtaaacggcgttgggccagatggctaacaggaagtttcagtggttaatgcagtaatgccgttgctttcatataaacttgccaatgccatcagagcatgctccgtggactttgggaagtccccatctttcttgtggctctctggaaatttcatcatgcagagtggccttcagttcagccccaggaactcccagggttttggtatcaggaaattgcttgtcttgtgctgtccagggaagctctccattcccaccaaaagttgcctgtgttgctaacggtttgggatagtgagctattatcaatagcctaccccatccagggacctcagctagtgttaaggagactgtcttagtctgtgcaggctgcactaacaaaaagccatagactggatgacttataaacaatggaaatttatttatcacagttcaggaggatgggaagtccaggatcaaggtgctggcagatttggtgtcgggtgtgggcctgctttctggttcataagaacagctgcattctgacgtggtggaaaggacaaacaagatcctctgggtttctctttttttaatttttttttttttttttttgagacagagtctcggtctgtcacccaggctggagtgcagtggcacgatctcggctcactgcaacctccatctcctggattcaagcgattctcctgcctcggcctcccgagtagctggaactataagtgcccgccaccacgcccggctaattttttgtattttttagtagagacggggtttcacagtgttagccaggatggtctcgatctcctgatctcgtgattcacctgcctcggcctcccaaggtgctgggattacaggcgtgagccaccgcgccctgcctgggtttctcttttaatggcactaaccccatgatggtggagcctgcatgacttagtcacctcctaaaagtgccgccgcttcatactggcacatggggaattaggtttcaacacgtgaatttggaggggacacaaacattcagaccacgacagggacctcttatttatacaacaaataattatatttcaagagatatagcacaacattttttgctccatttatgattgaaaggtcggctgggtgtggtggctctcacctgtaatccagcactttgggaagccgaggtgggcagatcacttgagcccaggagctcaagaccagcctggggaccatggtgaaaccccgtctctattaaaaatacaaaaattagccgggtgtggtggcgcacacctgtagtcccagctacttgggaggctgaggtggaaggatcacttgagcccaggaggcagaggttgcaatgaaccgaaatcacaccattgctctccagcctgggtgacagagcaagccactgtctcaaataaataaataaaataaaaatataactggaaggccaggcatgcatgcttcttcacttaatatagtcataggtattcaggccctctttttggagagatgctgaccttttagatatgtttaggatacattttaccatttggacattagggatatttgaagccagtatagatagatggccaagattagtttagtttaatgtattagtcaagattttacttcttatttattaatctttttatactctaaatccagtagttttatctgtgccattctttttttttaaacaaagagtaccatttgagatggtatcttttgttttttttttttttgagatggagtttcactcttgttgcccaagctggagtgcaatggtgcaatctcggcccacacaacctccacctcccaggttcaagcgattctcctgcctcagcctccctagtagctgggaccacaggcatgtgccaccacgcctggctaattttgtatttttagtagagacggggtttctccatgttggtcaggctggtctcgaacttccgacctcaggtgatccacccgcctcggcctcccaaagtgctgggattacaggcatgagccaccgcacccggccttgagatggtatcttaaccctttctcccccactataaagcagagcctgatgcaaggattgagtgttaacaccttatttaggaggtatcagtacaaagtggtgagggtaggtatgcaagggaaggaaagccaaagaacaatgccaagtgatgctggctggtgtttgacagtgaaatgcagagtcccagccggtcacttagtggatatgttcacttctggaagggctgcaaggaggagccgtagcctggagtagtctgcaggaaagcagagatgttttatctactcacctctgtcttgtctcctatttcacactggccaagcccctccccttgcacagctatttccctacacatttggtttgtaccatctgactcctaccaagctctcagaaagccagattccaccatgcagagtgatgcttcatccaagcccaaggcagtggtcagcagagcatgagtgaggtaccaagcaaaacagaaggtggctgttgatggaactatgaagagtccagtgcctgtgtccctaggcagagactctcctagaactgagtgctgtggtgaacatctgtttccaccctcagaccttgataacttgatctttcataaaagtgggttgcagaggctagtgattttgcttcataatcatcctaggaggaaacttctaaatcctctaactcaggggttggcaaactgtggcctatgggccaaattcaactcacagctgtttttgtaaatgaagctttctttattggaacacagccatgcccttttgtttacatattgtctatggctggttttgcacggagattgtagagctgagtacaagctgtctccaacttaaaatggttggacttaacgatctgacttggtgtaaaagtgatactcattcactagaaactgtactttagttcagtattcaataaattacaagagatgtataacacttcactacaaaataggctttatgatagatgattttgcccaactgtaggctaacggaagtgttctgggcacgtctaaggtaggtgaggcgaagctatagtattcagtagtttaggtgtaatacatgcatttttgacatacaatatttgcaagttacaatgggtttctcagtatatagccctgtcataagttgagggtatctgtagttgcagcagagaccacgtggctcacaaagtgaaaatatttactctctgacccttaacagaaaaagtttgacaatacctggtttaagaaatagaatcaggctgggcgcggtggctcatgcctgtaaacccagcactttgggaggctgaggcgggcggatcaccaggtcaggagatcaagaccatcctggctaacacggtgaaaccctgtctctactaaaaaaacacaaaaatttagcccggcgtggtggcgggtgcctgtaagtcccagctactcgggaggctgaggcaggagaatggcgtgaacccaggaggtggagcttgcagtgagccaagatcacgccactgcactccagcctgggcaacagagggagacgcccccccaaaaaagaaagaaaaaaaaaaagaaatagaacctgtttgttttacatatatagaaatgaagtccctgcatggtaaagggacttgatccaagctatctggtcatttataagccaagctgtgaccagactgcccagtcttctaatcttttcttttttgcctcagtatttggaggaatgggcatgggtggcagtgacttaagttggaatgagaataactgagtttgtggattagtagataaagaaaaataatctgaaataacaattttttaagggaaacctatgcatctttttaaagcatgaacccaagtccaggagagttgaaaattgtttttaagcttttttattttattttatttttttagttgacttcctgggctcaagtaatccttccaccttagccttccaagtagctgggaccatgggcatatgtcaccacaccaggctactggaaaaaaaaaagtgttttattttttgtttggttttttttttttttttttgagaaggggtcttgctatattgcccaggctggtcttgaactccgggctcaagcaatcctcctatcttggcctcccaaaatgttgggattacaggcatgagtaccacactcaggcttttaagctctatagatttatagatctatatctataaatgtgttatgtttgtgagcgaagcttggaggactaaaccaggatgtgagcttttggattcctttgccaaatagtaattttcttgatttcttgctttaatttttctttaaatgagtggattcccatttaactttattatgccaggaactaatgtgagtttctggataagttttccagtagaacacttttttttttttttttttgacggagtctcgctctgtcgcccagactggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggccccagtagaacacttttaacttttctttgttacaaataattggatccttttctaactccccaaatagaatgaatggccctgataattccgtgttaataaaagttcctctgagaaggttctgtacccaaaaacatacatctatttttttctgtccatctgtgttgagcaaatgtgagactaaaaagatgtgcatgtggtacatttggttgattaaattagggttgcgtgcgtgtgcgtgtgtgcgtgtgtgtgtgagagagagagagagagagcgccagcctaatttatataaagcctaattttggctttattatttttctttaatggattcttagtggaaggctgttagagcttaaagcttcctattaatccgctttggtgtgggttttgttttctcttccaggatatccgttctaacatgtaatgtttaggtaatacttacgtgcataacacacccctcatttttcaccagtgtttaaggccaataatctcccatttgtggcaaatgccaagtggcttaaagtcagtcacactgctagtatgaagttgaagacccacacaagtaaaaagacaaaagagacagattttgttgtttgctctattctaggaagttgagttactttgcaagactgtttactggtaaacagtgtgagagcgttcctcactgtctgttagctggagtcagtgattagcagcatgtggttcagatatggaagtggaacaaaaacaaatgtgtagaataggatccagaaatcttctagaatattcagtgacccagaatattccactcctagctgtatacccaagaaaattagaaacacacgtccacacaaaaagtgtgcatgcatgctcagttcagaggagcattatttattatggccagcagcaaccaaaatgcccatcaactgatgaatggataaacaaaatgtggttttagccatacaatggtatattattcagccataaaaaggaatgaaggtgctggctgatacatgctacaacgtggatgaaccttgaaaacatcacagtaagtcaaagaagctagacacaaaaagccgtgtgccatatgattctgtttatatgaaacgcctagaatagagaaatccacagaaaaccaccctggtggttgcgggggggagctggaattaatggcgagtgactgctgatgggtacagggtttctttttgagacaataaaaatgttttaaaattaggtagtggtgcaggttatacaactctgcaactacaccaaaaaccattatattatatgcttttagagggagaatataatgatatgtgaattatattgcaataaaagtgtcattaaaaacaggcttgtgtgggcatggtgggcgtttatgactttcttggcatcctttagaaactgttctttttttttttttttttttttttttgagacagaatcttgctgtgtctcccaggctggagtgcagtggtgcgatctcagctcactgcaacctctgcctcccgggttctaagggatttctcctgcctcagcctcccgagtagctgggattacaggtgcccaccaccacgcctggctaattttgtatttttagtagagatgggatttcaccatgttggccagactggtctcaaactcctgacctcaggtgatccaccagcctcaccctctcaaagtgctgggaatacaggcatgagccaccgtgcccggcctagaaaccattctttagacgtcttggttagggagtctttctgtctgattgccaaactttggtgggtgtcagaaatacctcggaaattgagtttgtttaaaaaacaaaacaatacgcagattctatcacagaccttcagaatctatttggaaagagaaaaaatgtcaactttatatttttcaaagttttctaacagtcaccacctatttttatttgcaaggacactgtgtaataataaaatggtggaggcatagtcaaatatgattaagttgaagaacaaatttaaatccaatttcctcttatagaaatttaatgagaaaacacaacttctttaaataggtaaacatgtatcgtagccccaaggttaaaggttatataatcataaacaattgtagaatctcatggtggagctattgaagacaaacaactcaattttatggtgacaagacttagaatgagtataaaactgccaagaaaggcccttcacctggccagtgtttatattcttaagtgtcatcagcgtggctgacttgtgtatattttccagcctttattcctgtctgtataagaggatgtaatggcaggtcttataatttcaaagctttaaggtcaatagctcaaaaattgtttggatctcagcatttttgctattaaaaaaaaatacgcatgcactctgctttcaacttagctgaggctaagtcaaagaatttggggcggccgggcacggtggctcgcgcctgtaatcccagcactttgggaggccgaggcaggtggatcacgaggtcaggagatcgagaccatgccggctaacatggtgaaaccccatctctactaaaaatacaaaaaattagccgggcatggtggcaggcgcctgtagtcccagctactcgggaggctgaggcaggagaatggcatggacccaggaggtggagcttgcagtgagccgagatcgcgccactgcactccagcctgggcaacagagtgagactctgtctcaaaaaaaaaaaaaaaaaaaaaaaaaaaaaaagaatctggggcttgtactgttttcatttgtacattctgcttagcaccctggcatccggacaagatgaacagcattcctgccttcaaggaacctagagtctcgtgtgcagcagttcaggccttggaggtttggaggagttgtaaagtttcttctttcatttttctcttctatggagatctttagactggggcatcctaatttgcctctactttggttaggatgagtgtgctggcctgtagtcacttgtctctttaccattcattacatggcagagcccagtggcttagtggagtccaggcactaatcccatagcaggatctctaccagtcattagatcaaccagtactcgttaattacaggccaaaggaagtacaggtccactgtgcattgtgtacctatcaggaatgacttttgcttgatttgaactctttttgaaaagtgctggtctgtgattactggactcctagggaaatggcattataatgttttggggatggcagggaggtggcaggcaggcaaggtcaggacctctggaatccaggagagctgtcttgcaaagacacagggagggtagatgtcacttgctggattgtcattagactagagactgtcaacagaagcttccattctgtgaacacagtgcttaaaaatgttgttagttttcaacattgaaaaattgggagtttttttcgtaaacatctggatatctatcttctttcagaaaatcgtgaggtgtggccccaccagccccaccttcctgcatgaacacagctggttggggctgagaaggttaccactacctgccattttttttaatactcaactgggcttcatgcatgtgttttccgtgtttagttctgtgggtgtctgagtttgggcccgatgaaaagagggtgcctggtgattttacatcaagtattgcgggtgagggtggcatcagacacaaagtcaggaagatatatatatatatgtgtgtgtgtgtgtgtgtatatatatatgtgtgtgtatatatgtgtatatacatgtatgcatgtatatacatatacatacatgtatgtgtgcacacacatgcatgcgcgcacatacacatacatgcacacgcgcacatgcacacacatgcatgcgtgcacatacacatacatgcatgcgtgcgcacacacatgcatgcatgcgtgcgcgcacacatgctggtatgcgtgcacacgcacacacatgcatgtatgcgtgcacacacgcatgtatgcgtgcatacacacatatatgtgtatatatatgtatgtatatatagagagagagagcgagagagagagatgaagtcctgctctgtcgccgaggctggagtgcaatggcgcgatctcagctcactgcaacctctgcctcccgggttcaagcgattctcctgcctcagcctcctgagtagttgggattacaggcatgcgccaccacacctggctaatttttgtattttttgtagagacaggatttcaccatgttggtcaggctggtcttgaactcctgacctcgtgatctgccctccttggcctcccaaaatgctgggattagaggcacgagccaccgtgcccagcctaggaagacattttatgaatgaagttggaaatgagagattatgaaggggaccaagcaagagaataaaaaatctagggcgagcagacttattagtcaacaggtatgaagcaccagtttcgagagggatcttaaaacccatcctactctgcctttttttctggggcttttatgtgtgtccaacattagcgcaggaagctctgccattctggggcttgtgtggagcctgtggggtggggtgtgggaatgggaacctgtggtgcggcgggaagttttgggctacagggaggatctgtctggatggacataaccagagtgagcttttaaagggttaggtcccagcgagtcagtgaaactcctagtatgcattgaaatgatctgtaggttatattctaataagtgagtgggcaaggaccatgtgaattgattatcaagtaacaagtatttgctaaataccttccctgtgctgggctctaattaaccacttggatggcttcttgcgggggtggtgtgggcgaacacaatgcgaatggcttcttgtttgcaaagacagaatgcttcctgaagtggatatgagattgttaaaatgagactttcctttgggttggagttcatttcctttcctgcctgagtattgtgctgaaagtcctttccacctctaaacaccctacgaggctgtgagttgccactcctacgagctcatcacccaccagtgtttgagacggtgcctccctatgcaaagctggcatgaggtcccatcgatgagattgttattgttggaggaagaccttggagtggggtaatagcttttttgttacttcattctgagttggattccaaagtaggtagcactcatccaagaggtgtaggaggaggaaaatggggtgagaagttagtcatgcaggatgctgttgtttactacctgcccactccctgtgagcactgtgcccagtggcgcagaaggggagcagaaggggcactgagatggcatgagggtcttgtcatccttggacagatgatgcgccgtgctgtgcaggtagcaggcaccctggatatttctgtggcatgaagcttctgccctcttgccagctgtggttaatgcctatctgcgtgcccaaagataccctcagccccaaaagagtcgcttctgtgaggtcagtcgaaagccaagccatttattgagtggtctgccagagggatgaactattggagtaatatgttgggatagggtcctgctcccactctgaaagcttggccagattgtggggaccccatggggggccttggtggctggtgacatatggagtgggaaggtcggagcaaaagcagttttccaactggtacagacaatgtcactgttttcataatcaatattactgtactcatgggctttgggtgaacacctgcatggacttgtgctgtggttggagtatggctatcctgtgctttctttactgcccctctgggccatgccagacacctgcggtctctgctgcggaacccccaggctcctctgtttctcatttgtccagactttctcatccccagatcaacttccaggtgttaggtggacctctatccaagcctcctatcacccccagccagccccagccttctgcttcatgttacgggttgagttgtgtcccacaaaagatgtccaagttctaattcgccagtgcctgggaatgtgatcttatttggaaataagatctttgcaaatgatcaagttaagatgtggtcttccagtgtggcaattcctcaaggatctagaactagaaataccatttgacccagccatcctattgctgggtatatacccaaagaattatgaatcatgctgctataaagacacatgcacacgtatgtttattgtggcgctattcacaatagcaaagacttggaaccaagccaaatgtctaacaatgatagactggattaagaaaatgtggcacatatacaccatggaatactatgcagccataaaaaaggatgaggtcatgtcctttgtagggacatggatgaagctggaaaccatcattctcagcaaactatcgcaaggacagaaaaccaaacactgcatgttctcactcataggtgggaattgaacaatgagaacacttggacacagggaggggaacatcacacacccgggcctgttgtgggatggggggacgggggagggatagcattaggagatatacctaatgtaaacgatgagttaatgggtgcagcacaccaacatggcacatgtatacatatgtaacaaacctgcatgttgtgcacatgtaccctagaacttaaagtataattaaaaaaataaaaagatgtggtcttcctggagtatagtggacctatatccaatatgttggggtcctcatcacaaggaggaaatgtggactcagagacagacactcatggagggaagacgctgcgaaggcacagggagaaagccatctacgagccaaggaatgcccaaggccaccacaagctaggagagaggcctgggacagattcttggaaggagccaaccctgccagtatcttgatttcagatttctggcttccagaactgtaacaatacgtttctgttctttaagccacccagtaatgtggcattttgttatagcagccccctggaaactgacacacttcccccgccccacactagtggttatctttgagcactgatagctaagcagtggtatcgtgtccgctaggatgctgtaaacaggttgcaatctgtcccctacatttcaatacccggcatgaggttcaggtggcatgagcagcaggaagggtggcttgttttcccattgccttgccaggccatcggtgaatgtggggtgcaggctcttgcttagaagagctgtcttggtggcagttccaagagagatggatttttttaaaattatgtgtttttgttttttggtacaagctgcagaaaagagggacttaaaaaacaattaatttccaaatacttttgatccttctcttggctgctctgaaccataccagagaggacttggctgaaggtcttgcctgcagctgtgctgtttcctggttatgttaagctcttccttgcatttccagaatcctgaaattgcaattcccccatctctaaaagagagagttgggctagtttttaaaacctttcaggctctgtatttcccctgagagacaaccctgatggccgctgcaggggagcgctcagctcctgcctccacttcccttttttccccgattcctgctggctgggtgtctcccggcagtgagacgacacctcatcaagttggggagaaggtgcttgttcacagtgcttctttccaaggcatgggattagggagggttttatttcctctttttacttttctgttttccagtgtttcttccctggacctgtattacgtttataagtaggataaaaataatttctctgaaatagaggagagggctggagcttagcaccaagactttcttttgcttcccattccctagcataaccctcttgctcctctgtttctcttgatctttctcagatttctgtttttattcgtgtcctcttccctctttcctgctcgaatcttctagttgtattttggggtgttgctacgttaaacaagtggtcttatgttctggccatcaggggtttgttccagggccaagctgtgtgaacgtgaacctgagcctgaaaaggcccagggctttgtttgtttgtttgtttttatatgatacaaggagcatccaacaatgcccagcccgtgtgctctctgccactggagaaggagtgtgccaggctggaaggcaaggagatgatgactccttgtctcagaccaagacttcgcttgctttctgctcctggtatatacaaatggtatgtgctgattgggtagatgggtgccactgcagaaaggtacggagaagacagagcagacgcaaagccttgggaagcggaagaacagaaagggccaggggcacatggtgatttttgaatgctgcgatcccacctagctggctccactctttcgtatgaagagtagattcttataacaaggtgtgcaaacgcagaactttcttcactagcagaatttagagacagagatgaaaatctcaaggaactttcatgacgacctgagtatctgggaacctggctgatttcatgactctcagtgaatctgccctgttgcgttcactcttcttttcctagatctctctgaccaacctgatgtcatttctgtagttttcatcattaccacccgtttggaggaaatggtgcaggcagagggtgctttcaagtcaagagtaattggtgggttgttttgattcttatgcctttcttttaaagggtcctacctccaacacctggataaaggtagcacctggtgcagagaaaaccctgccctttgttgccttctagaccagtgtttctcgaagtgtggtccccagaccagcagcatcagcgttacctgggaacttgttagatgtgcaatttctcaggccctaccccagacctactaaatcagaaactctaggggtgagacccagaaatttgcattttaatgctgcctccagaggactgtgatgcttatatcacacagcatcataggactggcttgaaactgaccatctcagtatgaaacagaccaagtctatgaaacagaccaagtcttagtcagtgcctaacagctgcaatctgttttaaccagtccttcaagtgattctgatgcgctctgacgtttgagaagcgctcctttaaggctgcccctgttcctagcatcttaccattcctctgcatggatgaagttttcagtcctctttgcagggaggtttttaaacctcctgcaatttcccaaggaatcttatttccttatttccttcaactataagatgctgcctagttctgcttcattttgtgtgatcttctctatcctgaatgccatttttgacgtttgagaatagctttttttgcccagaatttctatacatgttttacagtgctggttcatgataaggactttttctgtgtgcctgaaggagccgtggggctaaatggccatcctcttccttgggaatccagcaagtttacaagtggctttgtggccacacctgagagattattgctgatttctattttccagaatagcctcacctctttctatttcccccaagtcctgtgaaaagcaatactcagtgattttgagcataatttttttttttttgaggcaaagtcttaccctgtcacttagggtagagtgcagtggcacaatctcggctcactgcaacctctgcctccccagttcaagcaattctcctgcctcagcctcccaagtaagtgggattacaggcatgcaccaccacacccagctaatttttgtatttttagtagagacggggtttcaccatgttggccaggctggtgtcgaactcctgacctcaagtgttccacctgcctcggcctcccaaagtgctgggatcacaagcatgagccaccgtacctggcctttagcataatttatacacataaagtcacaccttttactggaaagtcttctatatacagattagttatgcgagcaattgaagttaataaaggccgagtttctcagaaaacagcaacaaaaagttgatgcataagcggaaaaatgccatttatgggagaagtttcgaagcagttgtgtggtatgattttccatggagagattatggaagcactgcttggagcctgttaaaaagctacagttcaacatggtcaccgaagaattttccagatgtcagtctaatggcctctgggcctgtgtttgccatttacagggcagtgtgctttgatggatgtccttgggcagggagtgtcttgttataggactagaaacccgctcatactaacttatgaaaaaagggcatttattagagggatatgggggcatctcacaggaatgcaggcgtaaggatgggaaaatcaggtgccaagattgattgtcctaactgtgggacctggtgatgtctgatgctacttcttttccttcccttcccttcccttttccttttccttttccttttctgtctttctgtctttgtctgtccttctttctgtctttctgcctttttttctttctgtcttttccactttttaaaatagagacaggggtctcactatattgcccaggctggtctcgagctcctgggctcaagacacctaccttggcctcccaaagttctaggatcacgggcgcgatctttctctgggttctcttcatgcatctttctctccgcagtcttgccttttcttcttcagcagccatttggcagaagtggccactcatcgtggaagaggaccaccccaagtcctgttctatacaactcttggcaggtccagtagcagtagccaagtagtcacgcccatagcatgtgtatccaaactgggatttgggcagttcttagagaagagtcttgaacatgtgtagttggatattgtgaaatatatatttggtcttccatccagctccctggcataaaccttggaatctccagaatgttagtctcttgtttgctaatgagatgatgggtgtctgggatcccctaggcagcttcaggatggcagctggtcacaggaaagaccaaggcatgcttagaaggttggaacttcagcgcctaccccacaaacctctggggagaggaaagaggctgattatcaattcccagtgatgacatcaatcgtgtctatgtactgaagcccccgtaagaacctagaaaaacagggtgtagagagcttctggtcaactgaccacatggagcctggggagtggtgccaggagagggcatggaagccctgtgccccttcccccatccctggccctgtgcatctcttccatctgcctcttcatctgtatcctttgtcatagcctgtgtaataagtgggtaaaggttagtaaagcgtttccgtgagttcagtgagctgcttttgcaaaggaatcgaacccgtggagggagttacagaatccctgatttatagcctatctgtcagatgtgtaggtgacaacctgctgcttgtgattggtgtctgaagtggggagtagtcttgtgggaatgagccttcagcctgtgggatctgatgctatctccaggtagatagtatcagaatcgatttaagttgtaggacactctgcttgtgtccgctggagacttgctggctagtatggcggggaaaactcccatatacctgatgtcagaagtgttgagtgatgttgggtagagagtaggagaaacagtttagtttttcctatgttatcagatgtagcaaatggttgtcattttttatgttttattattctgactgtgatttttaaaactccacttaatagataaatatgccaatcttttccttttgtgatttctgccctttgaggccacactttaaaaggtctttaccaataaaagatggtaatattttcttctagcagtcttatggactgtttccaccgcccccgcccccacccgcccggcccctttaaaatattaagccatatggaatttaatttctgaaaatgaatgagaaagggacctacctcaatatttttcaagtagttctcccatcgttcaaatagcattgactgattcagcctttcaccattgccttgagaagcacctctttaccatacgctaaactagtctggctgagtctgtttctggtctttttccccttggtctgtctctctgttcctacaccaagttttgtctgttttctatcatggaaatttctcatagattcaaatgggatatactataaaaatatagtcttctggcctggcgcggtggctcatgcctgtaatcccagcactttgggaggccgaggtgggcagatcacctgagatcaggagttcgagaccagcctggccaacatggagaaactctgtctctaataaaaatataaaaatgaacctgggtgtggtggcgcatgtctgtaatcccagctactcaggaggctgaggcaggagaatcgcttgaacctgggaggcggaggttgcagtgagccaagatcacgccactgtacttcagcctgggcgacagagcgagcctctgtctcaaaaaataaaaaataataaaaaatatatatatatgtgtgtatatatacacacacacacacacatatatatatagtcttttttttttttttaaattatactttaagttttagggtacatgtgcacaggttagttacatatgtatacatgtgccatgttggtgtgctgcacccattaaatcgtcatttaacattaggcatatctcctaatggtatccctgccccctccccccaccccacaacaggcccgggtgtgtgatgttccccttcctgtgtccctgtgttctcattgttcaattcccacctatgagtgagaacatgtggtgtttggttttctgtccttgcaatagtttgctgagaatgatggtttccagcttcatccatgtccctacaaaggacatgaactcatccttttttatggctgcatagtattccatggtgtatatgtgccacattttcttaatccagtctatcattggacatttgacttggttccaagtctttgctattgtgaatagtgccacaataaacgtacgtgtgcatgtgtctttatagcagcatggttatagtcttcttactttggtttcatttttaagaaagaaccagcatcaaatgcttcatgtgtattctttcggcacatttgccttgcatatacaagcacagacattttatttatgcccttttgttaaagtgagaaccttttgtacacgtagtgtgttttggagcctttcactccagcactcatgcacttcagcagctccacaggatgccaccctgtcgatacatcattgtcccctgttggtgaacatttaggtcacttcccaagagtcttttccctctaatgaaaagtgctccacaaaataccttcatacttacattattgcacacctaaagctattgttaggtcaaaagacacgtgcatttgggcttttgatggatatctccaaattacctttcacagacaggcattctcacctgtttttgcagatcctggttagataggggttatcagtcacaaaggaggttattttccccatgggtgaaaacatagtatcttacagtcttaacttgtatttctccaattttgaatgagaatgagtatctttttttttttttttgttattgatcatttgcaattgttttttctgtaaatcacctgtatatgttctttgctctttttaaactgggctgctcactgataggtagttcataccacacaaagggaatagaggctttatctgtctccctggcccccttcttggtctttccctcgtctctttatctttctttttatctacatgcatatacacatgtatctttaaaaatcagccatcagccatgttactgaacataattctaatagttgatttgagctgagtcttccttcatttatcaattactgagtgtccttggtgcccaggagacaggtccacatttattcaatacagtcacaaccctcagaatacatctggtgggagggataggtatgaaagcaggggatgtagctgaggcagaaagagattcttcttccagccagcctgttagctccctagggcagagacgatactgtgagcccccctgctgctccccagtgctcagaaagtctgaatgaattgacaaggagcacagggactggactgttaggccacctggactcttccgttgccacgtcacggtgagaatagctggctgcctcactttccctgtcagctccaaacacctgggaacaggattgcttgaaacttgtctttcctgccctctaactcaggacttggccctcaggggcttaagataagactttgggaaggggttgtttgttttttttcttgtaaatttgtttgagttcattgtagattctggatattagccctttgtcaggtgagtaggttgtgaaaattttctcccattttgtaggttgcctgttcactctgatggtagtcttttgctgtgcagaagctctttagtttaattagatcccatttgtcaattttggcttttgttgccattgcttttggtgttttagacctgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccaatgcttgtttttctcaggtttgtcaaagatcaggtagttgtagatatgcggcgttatttctgagggctctgttctgttccattgatctatatctctgttttggtaccagtaccatgctgttttggttactgtagccttatagtatagtttgaagtcaggtagcgtgatgcctccagctttgttcttttggcttaggattgacttggcgatgtgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgagtgggagttcattcataatttggctctctgtttgtctgttattggtgtataagaatgcttgtgatttttgtacattgattttgtatcctgagactttgctgaagttgcttatcagcctaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagcatgatattggctgtgggtttgtcatagatagctcttattattttgaaatacgtcccatcaatacctaatttattgagggtttctagcatgaagggttgttgaattttgtcaaaggccttttctgcatccatcaaaaagtgggcaaaggacatgaacagacacttctcaaaagaagacatttatgcagccaaaaaacacatgaaaaaatgttcaccatcactggccatcagagaaatgcaaatcaaaaccacaatgagataccatctcacaccagttagaatggcaatcattagaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagattggattaagaaaatgtggcacatatacaccatggaatactatgcagccataaaaaatgatgagttcatgtcctttgtagggacatggatgaaactggaaatcatcattctcagtaaactatcgcaaggacaaaaaaccaaacaccgcatattctcactcataggtgggaattgaacaatgagaacacagggacacaggaaggggaacatcacactctggggactgttgtggggttgggggaggggggagggatagcattgggagatatacctaatgctagatgatgagttggtgggtgcagtgcaccagcatggcacatgtatacatatgtaactaacctgcacattgtgcacatgtaccctaaaacttaaagtataataataataaattaattaattaaaaaaaataaataaaattacaataaaaaaaaaaagactttgggaaggaggccaggccctgctagaaacacctccccgactcctgctgcctgtgcccacacactggaaccttctccccggaaccttttccctccgggcttccctcactgcagcactcactgcttttgtgccttctcctttctcctcatcttcacctattctagaaagactctgaggactcagtcatgctcatgggtttgtggcaatctcttctaattcatatagcacccctgggaactcaagtaggtagcaaagacccatgtcaaagccgcggctcttagaaggttggggtaacatctggggggttccttaaattactctacattgctaccatgtaccttgcctgatcctaagtctaacccactccctggggcttttgtctgggcccaggtacctcctgatccttggctgggttccgtgaccgtcctgctatggactatactagttttcccgacatgtggttagtcactgagatcgcttgataaaaatgatgagttgagttcctcccagcctactcaaccagaagctccaggtgtgaggtctgggcaccagtatttctaacaagtggctccagtagttctggtgagtaactggattgggaaatgagaccagagctttgccaaacacctgtgcttaggttctggatctggagcatccaggctttggattcgataaggtgtcttctcagtttctcaaccataagatgggagtcatatgcgtgagctggcagtgggttaccagcacctgttgtctcggtgacaagacatatttctccaacattgcagtcaaccttccttgcccttcaacccaagtttgggtcagtgatcgtcttttaaatgctcacagattcccggtgtgtttgcacgggtctacgctctgtaaggaggctggtagatcagggatcctaatggggattgagagacaggcttggacagctccaggcagcaccccctactccctgcgacccttcgaattccttggctattcctggattcctggccctgctctttcacaggccctctgtgcaggctggagccagaccagagcttggttctggcaaatatcaaagggccaggacactgacggggcctctgcttcatcccatcagtaacacagtttctgtatcatctgtgaaatgggcacaggagcccctgctccccaccaagattgtagggctgccctaagaattttgtaagcagctgtgagtgggaagttggggaccactcatagtgatgtttccctggttaactaagggatagcctgacactgcagcaatgctaaagaaggcattctagccccccttcacccctagcacccctcttttgggagatgtgctccttgtaggcatcaaaaggaggggtgaggcagggatccagcttctggggtagaagttgggaagcaaagaagaggaaggaaggaatggaggtggttttagttttttgttttgtcttattgttgttcttagtgtctgtgagtgcttactctgtgtcagaaactgtgctaagagctgtatgtacctcactgagtcctgtcctcaacaccaggaagctgggacccctatactgctatcccgtactttacaacagggaaaccgaggccaaataacatggtccttgttaaaaggaatagatctgggatttttgaacatctgtctgtaagatgccagcgccagagctcttaataacggattctcagaccttagagtataccacaatcacccagagggcacccagcaggttccagataatgctgatgttgctggtccgggaaccatactttgagaactactgccctggatgatccaatctggcccccattacctctgaactcatcttctattttcccttccccacaattcctcttcagccacactatcctccttgctgctctctatgatgaaggacatgcttctgcctcagaacatttttattttatgttcccttcatttgggattctcttccctcagatatgtgtgtggcttgctccttccctctgtgataggagccttccaagatggcccccaacacactcacctcctgatacactcctgtgtcatccctttctaccttccctcctgggtggtccctgagactaatagattgtggcagtcatgatggagtgtcacttttgagactaggttgtaacagacattgtaccctttgccttgctttcccctggctcgctcgctctgggcgaagtcagcagccatattgtgcagagcccgtggcaaggaactttggctcctgccagcatccgtagggcgagctttcttcttttttcttttttttttgagatggagtctcgctctgtcgcccaggctgaagtgcagcggtgcgatctcggctcactgcaagctctgcctcccgggttcatgccattctcctgcctcagcctccccaggagctgggactacaggtgcctgccaccacgcccggctaattttttgtatttttagtagagatggggtttcaccgtgttagccaggatggtcttgatctcctgacctcatgatccgtccacctctgcctcccaaagtgctgggattacaggcgtgagccaccatgcccggccagggtgagctttcttacaagtagctcctccagccccagtcaagccttcaaatgaggcagcacccactgacttcctgaccccaagctcatgggggaacctgaggcacaattgcccagctaagccactctctgattcctgatgtgctaaaacaatatgaaataatgaatgtttgatgtttccaactgttaaattgggggtaatttgcgatgtaacaatagatacataatacatttctctcagatcttcattctgtgttcctttcttggtgaggccttccctggccattcttaaattacagcttcgttctcataacactttctatcccccttccttgctttattctccttagtgtgtaccaagagctaacctgatatgttttgcttattttttgtctcctggcacaactccctcccccaatcccattagaaaatttttaagttttcacttatggaaaattttatacacatacacattttatacacatgtgcatgtgtctaaaattaactaaagatggaatggcataatgaccactagaatttaagctgaaggaggaggagtttaaccacttatatttcctgcaatataaccccgtgtccagcacagtgcctgacacagaataggccctcaaatatgtgttgaatgaataataataatattcatattgaggatgattctcaaataaagggttgtttatagattaaaatacactgttttgctgcagctcccagagtcccagcctagagctcagacacggtgagtgtggccagaaaatggtggtctttgttgtcagactgagttccagagatgccacttctcactgaggcctcagttccttccattaaaagtggaaatgggccgggcgcgtagtcccagcactttgggaggctgagacagacggatcatgaggtcaggagatcgagaccatcctggctaacacggtgaaaccctgtctctactaaaaatacaaaaaaattagccgggcgtggtggcaggctcctgtagtcccagctcttcaggaggctgaggcaggagaatggcgggaacctgggaggcggagcttgcagtgagctgatatcgcgccactgtactccggtctgggcaacagagcgagactccgtctcaaaaaaaaaaaaaaaaaggaaatgacagcacctatctcataggtgttttgtgaccgctgaaggggatgccagatgtggaggggcttggcgtgaccaggcgtaaatggttcttcagagagtagtttctttcctgcagagaaactgtggttgtgatttaaatatcatttaattttttttttcgagatggagtcttgctctgtcacccaggctggagtgcaacgacgcgatctctgctcaccacaacctccgcctcctggcttcaagcaattctcctgcctcagccatttacttttaagagggaatttcaaatgtcttgtagcaatggctgtactggaaggcattgaaaaaccagagatggaggaaactctggtgcgcaggagggaaccaggtctctgtgaactgctgcttttgtattggccaagggagataagcaggggcctccaggagaatgtggcctgattgcaaattctgcatctgcctggaccaaggcaatggggctcgcttggaggacagggcagcatagcctgggggcaagccagcttctgggtaggaagggagaagggctgagaaacggagtggcagggctgccatctgactagaaaaacctggccatagctaggcagaccctccttgtgaggactacagggcaaggagagaagccatgggtagagagaccgccaaaccagggcaaggaagaaagaaaatttggtggtgggggaggaggagatagagcaagtagcacagaagggtgagtataaagagaggcaaagaggagaagactgcaggaatctcagatcaaagtcaagaccccagagtccatttccttctgctctggtatctgtggttattttacctgataaccacagggggcagcagagagccggcacaagccaagaaaagtggacgagccccagcaggaggccactgggggccagaggcttgtaggtgggcccatggccagtcaccataaccagtggcttaggtccaggggctccttgtggctttcccactggagcccaatattgctaatgcaggcaggatgcagccttaacaaggggaaatgaagcccggaagtgactatttaaaattaataacttccgcctagctcactgtttttaaaatttattattattattttgaagaaggggcatctgtgctttgaaactcagatttacatagtcttcaagctttcaactggtctctcactttacaaattattcattcactcactcatccattcatttattcatttatagagatagggtcttgctgtgttgtccaggctggacttgaactcctggatcctattgcatcagcctcccaagtagctgggactacaggcgtgtgccactgtgcccagctgtctttataagttttattctatgtggggtagacactggcattcgctgaggagaagattaacatctttggctcttagcattaatgctaaaatagtacctcccttagactggtttcatccatggccagtatatggctctctgggtctcagcggaagaggtctgaatggagttctagttaccactaggaaaatatgtgttttgtgtgaattaggtggggtgggaagaggctccccggggcacatctcacttcttccactctgaccgcactgttcctcctagaacctctggggcctgtgtggccatggctctgttagtagagtgtgggcagtcatccgggatgacctaagaccacagggatggacgtccagagaatgcagaagggtctcaatccagcatctcttgaggcctggagctgccgcttcagtcttactgtgacttggtcaaggagccagatgtgttgtaagcagattagggaatcttgtattggaaaagacctggacacggcttcctccctgtgggtagtatggtcctctggggtgacttgtcctgctgctggtgaggtcacccagccagagccccagtggctctctccagatgtctgcctggcctggcctggcctggctcagcaccatccctgccccaggctcacagtgtctttgtgttatgggttggtcagatctcgccaagacaaggagatggactgggctgaatccttcaggcagctgcatcgtccctgatggggcccatttggaggttagaggggagggatatggtacttacggagactctagcttgtggggggtctgggagttgaccaggccagtgagggcagggaaaggggcctcccatcgggtccccacatggacagcagcattcagactgcaggccagcgtccacctagggtttcagagcctcctgcagcccccggagctgctggctgctgttctgattgcctctgtactggtagttcccttcatggagggctcaaggatgggggatggggagaggaacggggaccagcagcttctctgttcaatagtccagatgttattttgggtccgcagtggttggtgatggctcgcaggtagtaggcaaacagtgatggatgaatgggtgcaaggatggaaggagtagtcagtgcatgaattgtgaccctctgccccaaccagaagatcaaaggtggtgtctgcacatcagctggtgggacttccttttaaaataaggtcaatggtgtcagccaccaaaggggtggtggcagcagcacaaagggaaagttttctgggaccttttccctgctgtttattcctggagagcacatcaggtgggaatctctcttgtgctgtcacaatgtccgtctttctgttggcccatctgtccttgcatccttcaggccaggtgccgtatttgagagggcgaaccagccgtggcttcgaccctcaaggagataaggtgtcaaggttaggatctgagctgtctgagggatggacaaagtgctgatttcctagaaaaaagctggatggaatgtgtgtgttgcaggacttaggtcaggttctcaagaagacttgaggcagatttacatgcaggagtttcagtagggtgtgtgctcctgggagcaacccccggggaaggaaggaagcagcattgcaatgcggccaccaaggaggcctcggcagcgccgtggggagctctgagctgggaggggccttcagaattgtttgatttgagacaaggggattggtgggccgttgatcccctctcaccccagtcattagatgtgcaccctgcacccctactctaggcatagccttgggcacggcagctctctttggctaagggcggttccctgagagggactcagctatgagcctctgcagctagagagatttgggtggtgcactacagcacccactctagagagtctggggaagaactctttgcagggaagaagagcaatcttgataggctgcatggtggaagagacattttagttgagacttgatgagtgaacaaggttgtgatatccagggatgggggagcaggaggcggcaggtatgggtgaacaatacgggaaaggcgtatttagagatcggcgaggcaagttaactgggcctgaagtgaagccagtgggatgtcagtctggatgcagtcagggttgggatcctggagcactttgccaggaggccagtggacttcggaattgattccgtgtgccatgttggaaaggagctagccagggattttcgctgtgaagtgacctccggcgaaagctgggctctagggtgagtggtccactagctgtgagtggacggatttcaaaaggcagggagactggctctggagtgacatggagaagacaagaggaacgtgatggaggggcatctccaggccctgggaaccaattagatatgagggatgggacatagggtggagctggtgatggtgagtgagccctgtccctggttgtccaggggccagggaacccaggagactcggaggagagggtggagaggggagcccggtcttgactctgtggatgtgaaggcaacagtgcggcctccaggcagggctgattcaacgggcaggagagaagagaagcctgcctaggaaggagcctgaggctggatggtgcatctgctcctggggatgcccacctcgctgcttttgctcatcgaagctccaccgggcttgtctgtctgttttatttagtgctgagaaagcacataccatgtgcccgatgttatcctaagtgctttgtacaggtgaacccaattaatgctctttcccagcctacttaggtaccattttcatccccattttatagttgagaaaaacagaatatagagttcagatgattccagaggtcactcagcgtatgaatggcttatgacgtgggccctaagcagggcagtggtctttgaagtaagttctccaaggcttcctgctcttgccagccagtgggtcccttggagaagctcctaagcctgctggcagcctctctccttgtcactcctcataaaagaccctactactgtctggtttatgttcacaccgtctctgctttccagatcaccctcaattctgttttctctcccttaagacatgaagggaccatattacccctgttatgcctgcccctggagtccaggttcacccttcctgaaacccaaaccatgggccttgagaccaccaatcacacctagagagcgggagtattggggcctacgagaccaagtagccgaacctctttattttggatgaagcatcagaggaccagaagggtggtgcgatttgcctagggctgcacggtagtttaggagcaaagttgagtcaagaacccagttttgtttttattgtttgaaacaattgaattttcagtaatggaatttttaactaaataatgttatatcctcatatcagactaactttaaaaatgacttagcgctagaggcatgtatgtgggcctttggtattggtacagtatctcccttgggtggacaccttattgaactcattttacataggaggaaagggagtcacagagaataagtagcttggccaaggatagtggtggtgagaggcagagctggattccaacccaggcagtctgggtctagaatcaccacactaaacagagcctaactactttgctataccgcccccttcagtgattttggaaagtttttaaaatttatttttattttatttgtttatttatttttgagatggagtctcactctgtcacccaggctggagtgcagtggcatggtctcagctcactgcaacctccacctcccaggaccaagcgattctcgtgcttcagcctcctgagtagctggattacaggcacacaccatcgcgcccagctaatttttgttatttttagtggagatcgggtttcaccatgttggtcagggtggtctcgaacccctgacctcaagtgatccacccgcctcggcctcccaaattgctgggattacagacatgagccaccgcgcccggcctattttcattttttgagacagggtcttgctctgtcacccaggctggagtgtagtggcgccatcatggctcactgcagcctcgacttcccaggctccagtaatcctcccagctcagcctcctgagtagctgggaccacaggcacgtgctaccacacctggctaatttttgtatttttggtggagatggggtttcaccatcttgcccaggctggtctcaaactcctgagtttaagcaattcacccacctcagcctcccaaaagtattgagataagacgcatgaaccactgtgcctggacagattttggaaaggtattcacaaaaatttatacataaaaagaatctatagtttgattttgtctcattttaaagaggaacatatgcttagaaaacaaatcaacatatggataccaaaatgttgatggtgatgacctctgaatggtgggatgatgggtgatatttatttttgtgtgttttcctgcattatcaaattgtatgtagtgagaaagtattatttttatcactagataacttcataagaagtctctgctcatggcagtgaaatgggtaaagtagtgtttgggggacaatactatagcttgcagtattagttttctctctttctttgctttctttgctttctttctttctttctttctttctttctttctttctttctttcctttctttcctttctttcctttctttcctttctttctttctttttttttgaggcagagtctcattctgtctcccaggctggagtgcagtggcacaatctcggctcactgcaacctctgcctcccaggttcaagggttctcctgcctcagcctcctgagtagctgggatcacaggcacgtgccaccacgcctggctaatttttgtgtttttagtagagacagggtttcaccatgttggccaggccggtctcgaactcctgacctcaagtgatctgcccacctaggcctcccaaagtgctgggattacagttgtgagccactgtgcccggccagttttatttctgattagagcctgtagcagggcattggaagagagagaggtgaccaggcaaattcagcagttacagctcaaatgagacttagaactgcgaaatcaggaagaaacttggaagtcaccaccaggtggcagagggcccctgtctctttacaggctcctgcacctctgtgctttggagtttcaggtaacagtggacatttggggagaaatacctggttggcaacttcagggttccaggagaagagtccagagccccgagacaaagtaggggtgaatgaagaggcaggttggggcagaggatattttagaggatcttgacatctcaacaggaagtccatctccttctggccccagcctcatcaagaagggcccccagcaaaaacaagctctgtggtcatgggatggtggaagggggcaggggccaggaagggagatggatggatatgggagcagaaagcagggtcctgtctggccagggttggggaggagggcgattggctgtctctctttttctccagctctgagcatctccttctgctctgtgaaactcaggttctgccctgtgacattctcaaagtgattttctttgctcttctttcaccagagaccacctgggaacgtcccagcagttctcctgggattccagccagccctggctctcacaggagctctctgcctccaacaggtaatgtccgctgtctgctttggggcaactgggagggccctgatgccacattcagtggagaggctgagatgatgggtcctgggtcttaaacctggctgatgtagcaaacccagggaggggttgggcctgggagagggtcccttaggcctgctgccaagcaggttggtgtctccctggcagtgccagcagcagctctggtggcctcctgcacactcctcctcaggcgcttagtgggaggagatggctgggggaggtgaggtgtcagagctctttcctgtctgtcaggggcaggaagacctgaagtgtggacagaaccaccctatgtggctcttgtggacatcacggagtagaagctaaaaggaggtagatgtttacaaggcagctttcaaataaaacacctgaaacagtgtgagggagaccttttgagggtgtgagttccccatctgcaaaggtaatcaagcagaggcagttgagatggacgttcttttttgtttgtttgtttgtttctcttttgagacagggtctcattctgtcacccaggctggagtgcagtggtgcagtctcggctcactgcaacctccccttctgggttcaatggattcttgttccccagcctcccgagtagctgcgattgcaggtgcgcaccaccacacccggctaatttgtgtatttttagtagagacgggatttcgccatgttggccaggctggtcttgagctcctggtctcaagtgatccacctgttttggcctctcaaagtgctgggattaaaggtgtgagccaccgcgcctggctgaaatggacattcctataataggtgggaggtttgttcaggggcctcttgggagacatctaggtctgagattctggaaggcaggttatgggacccatcagcagggagaacaacatctcctttcatgtggctttttaaaaatgtcacctcctccaagaagccttccctgaccactcaattttgagccctcatgcagtcactttagatctcagccgcatgctattttaatgtccccatcatcctgttcctagttgaccttcactctcccatgctagactgtaagctccctgagggtggggactttgtctgtttcttttgtgatatcctcagtccgcagagcctggcttccgtgttgaactaattcaccaatgtctccaccatcctatggtgtgtggagcacacttgttggttttcgacttcaggagtcaatctggcagcaaagcatgaaagtcaaagttgtggttggggctgggaatttaatcttccaatgccttgagcgtgacatcctcagcttctgtggaagggaggtgagagcctgtgtaaagttttcagaagaaaaagtaatccctggtctaaatagtttacctgaagcagcacagggaaccacaggaaggaccaaaggtaatcacaggactctggaatactggatcggaagagggaggtgggacgcaaagcgagtggccagatcctcacctttcagagcagggagtctttggatattgtctagcattgagacctgaagacatgaaagtgcacattcaaagcatattgcttaggcatatgacagttgccagcagaagagctcaaaactggaaaagatgggaaaatattacctctagaaaatcagctgaggcgtgggagaggtgataggaaggtgggtgttttctatcaaaaattattttaggttttcaaaagcactttatttatatttatattattaaatttttaaaaaaataagaaaggaaccccctgtgtgggagggacatggggcagctgtgacggatttcctagggagacagtgagtgctgccatctcagaccaagtccccagaaatgggcccgttcgtactgtagctgccgtgtgacagcaggcagttctgagcccactggcttctctttcaatgttgttcttgtgtttttttttttttttaaaacaatcaaaatgccagtgcgaatgacgcaaggtgtgtcctttttcctggctggctccaggccagccagacactaaaaaggtaacccagctgtcttttccagccagagtggtcggtgaaggaggacaggacagggaggccggcagagggaggctcggatgtgtagagacagcacgtgtgactcgcagcctgccccgttggtgaggctggtcgagacttgccctttgagtcatggggtcacttctccaaagcctgctctcctgggaccctccacaggcagcatcttgtcctctctgctgttgatgggggctgtcctgcagaagggatgctcacaggagctgcctccggtccctggcttagaggcctgggtttaacaggctcccttctttaccctacaggtgcatcaagagcctctctctgtccagcgctgcactgtgtgctgggcccctaaagggggctgagaaaggtggggagatgggtggagaaggtcagatatagagatgagaattgcccgcatggccaaggctagactgagtgtgttgacaactcctgtccccctctgcccccatccccagggtgctggggtagtatttcctaaggtggaatccttgggatcccagatgtatccgtgctccatgaaggaggatgaagaaggacaggcacattagcattctgaagactgcaggaaggcctgaaatgaagaaacctatttaactcagttcgtttgtgctttgtttctttgtttgaaacataccacatatgtgttaagctttcctccctcttttgggtggttttgcctaccaggggacattcggcaatgtctggagatatttttgactgccagcaccggggggaggggctacaggcatttagtgggtagaggccagggctgctgctgaacatcccacaatgcacaggcaagtcttcacaacaaagaatcacctggccctaaatgtttactagtgccgaggtggggaagctcagttctagagtgacccagagcctcagttcagcgctgctcaagggttcccagaccatggcccattgaagcaagaagcagcagctccctacgtcagcatgaagagtcctgtgtcattgattctgagacatacattttcccctgacatattaatatcttggaagtcagatgcatcttacaatcaatagtatatactagtttattagagacatggtcttgctctgttactcaggctggaatacagtgtcatgatcatagctcactgcagcctcctcctccagggctcaagcagtcctcctgcctcagcctctcaagtagctggaactacaggcgtgtgccaccacaccccgctaattttcttattttattttcttcttcttattattatttttttctgtagaaacagtgttttgccatattgctcagactggttttgaactcctggtctcaagtgatcctcccaaaattacccaaattacagacatgagccactgctggcctcaatcactggcatcctagatttgtgaaattacaaatgttaaactggggccttgggcatgtttctccttgccaggcctcattttccccattcataaacttgagggcctggagagagataaaacgaggccctgcccatccatgcatgcttttggattattttgtttgtttgaggtggggtcttgctctgttgcccaggctggagtgcagtggtgtgatcatggctcactgcagccttgacctcctgggctcgagggattctctcacctcagcctcccgattaattgggactataggcacatgccaccttgcccagctaatttttaaagaatttttcatagagacaagatcccactatattgcccaggctggtttcaaactcagaatccagtgatcctccagcctcagcctcccaaagtgctggggttacaggcatgagccgccatgcccagccagctttacttttgtgttgtagctttgttaacttctagagagagtttgaagggccacccacagagctggttcattcttattagtgcaggtttgttggatactggtaagcagaggcagccaggttgccaactgggaagagagttctagaaacatgcctagagtcctcccccaaccccccccttccccacccccgcacaaactagactccagtctttgaatgttgggtgctacttaggatcagacctgggctggggactttgcctgcattccatcctttaatatcaccagagttatggaagctgtgtttattcagtagctttactagaggtgtttaatgccaggctttctgggtgagacccgcatgagtaagaaataaactttaaaccaaaacagaacacctaagacgccattcagtaactgctgcaaatattgaaagtcctctttgggctgggcttaacgtgcagtgtggaaatactgatttgtagagagaaatagtaacaggcaaagagaaagaaaatgagtgaaaagggagatgctgggagtttcatgtatgagtcattgggtagaatgaagacagtacagggcagtgttgtccagtagaaccctctgtgacagtataagcattctttctctgtgccttccaatatggtagccactagccatgtgtggctcttgagtacttgaatggggctggtatgtccaaggagctgaatttttcattaatttaataccttgttaaaatttggggaacaatttttaatttacagaaaagctataaagacagtaacttcctgtgccttctgtactcagttctcccggttgacatcttacataaccacggtacatttgtcaaaaccatgaaattgacatcgtgcattacgagtaactgaatgttagactttattcagatgtcatgagtttttccattcatgtcctttttctgttcttggatccagtcctggaaatcatattgcatttagattttatttaaatttgatttgtttaaattcaaataggcatctgtggcttttgtgtcaacagtgcaaatgtggaaagtgaatacctttctgagcctctgggcctgggatatgcattgaacttacgtgtttttcttaaggataaaagaaatctattattttttgaggttgtcctggtgggcggttgtgggagtgtttcaggaaacatgggttcaggatctggctttgctcagccttggggcttcagcccactgagggatcatccttaggcctccagtagcctcagggaacctagattaaaggggagagagtgaatgcctttgcagaggctgaagggcaaggaggaccttcctttgagcctgaggagccggccagggatatggttagggaggcagctgtgcttcctctgagcaggggctctctggggagggggctcctgaacccagagcctcaccctcgcccacaccttcttctccagatcaggaagcctgggacagctctcctctcccctgcaggagcaaaggaagaccctcgcttcttgcggaattagccagtctcaggttcaaagcagcttccccagcactctgacttagacctcacccctgactccagggaaggccctgacaccttctgctggaagaagtgcatgttcccctagaaccagtgttcttgctggctgaggctcctgggaccttacaaaggcctgtttaacctctgatgtcctggaaagcagccacaggtgtttcactgttcacaaccatgtgggaaaatcttttatcagtctgtctttgggaacgcagttcacatcttagacaactaggagagacagtgaggaccaggtggccagagagaaatttctggaacagaaaggtatttatgtaaaactgctcccctaaatgggccatggtggacagtggatcctcctgagaaggtgagcatggtgaccaaggaacctgcgaggccttccaggatgtggtgggaggaaggaggctgtaattgtgccctatgtcatcagaccggatgagcacggaactgccccacttcaaaccttgcattctgtggccatgactgtgtgtcccaaagtggatttcacggtagccctgctgtatttccctcaacgggttctgcgtctgtgtgcgcggaaggatgctgcatgctgttgccttgtttgagatttcaagcgcatgtcagcatattctaaaaggcctactgtaaataaactcaatctgaataatggggtgtttgtcctaaattctttggaccgtaacactgaccctttactatcactgcataacacttacaatacacatctggcagaattgctatcctgtttaacacacctggggaaacattaggctgtactatgtttaatatgtgatagatgaggaaggagaacgggtggaaggaaggaaaaaggggggggtgagaaagaaggagggaaggaggatgggtagaaggaagggaggaaggaaaaagaagcccgaagggaagggagggagggaagaagagaggggaagaggaaaagagggaagcgaggatttcaagaaccagggcttcagcactccggggttcctcaactttgttttttttggtttgttttggagacagtttcgcacttgttgcccaggctggagtgcaatgccaggatcttggctcactgcagcctccacctcccgggttcaagcaattctcctgccacagcctcccaagcagctgggattacaggcgtgcgccaccatccctggctaattttttgtattttagtagagatggggtttcaccatgttaggcaggctggtcacgagctcctgacctcaagtgatccgccctcctcagcctcccaaagtgctgggatttcaggcgtgagccaccgctcccagtcaccaggtttcctaactttgaggagtgaaattactatgtttattccagagagaggagaaattaggccagacctacaggaggtataataagagagtgttcatggctgattttcttatgttcttttgggttcctcagggaacaggaacctggagagtagggctctgaggatgcgactttttccctcagggatcggtactgagatatggaagccgagctgcgggtgggggtgagccctgggtggcggagctgctggcgcttctttgttgcttggcctttctcgataacttttcatattcgcctttcttttctgtttctgttgacttctccctacccagacctccctcctcttttctacccaaatatctgtcccctcctctcattagacacctcctaagccctctcaagttgcttaactgcctataagggaaatgaagtgtgtgggtgcctgtgtgtattatttatatttgaagctgctaaggttactaactagatagagcttttagttccctttttaaaaatcttaaaaacagatgagtgtgacatttgctttttttttttccttgtatctccagactgaattatgttccctttatgagcgatccttgaccaatttcatttttcttcccccagaggctggaggccccagaagcacccacttctcgcctcatttgttttgtggctgaccctgggtgagccgggagcccccaggacagggaatagcaatgaggaatgccgtgggtgagggttgccaggatcttgtgggctataactgtctagatctccactgagacgtattctgaatgtgcccgggagacttcaagtgataacgcagccagacagggtgtccgaggagagctgctacgtggggagaaagggtcgaatggaaaactgtgttttctttcctcgtaattgttttgacatgagcagtaattagccatcagctgacagaccagaactgaagtgagaacaagggattggattaggggcaaaatgtctcctctttagacagttcctggcggctgcaagtgtggggaaagactggggcagaggagaggcaggacctgggcatgcatttggagggtctggggagggagggagtcagggtctcctcaggagctgggacaaccttggttcatggggactcagcattatcaaagatagagatttattacctactcagataaaaacttgtgcatttcattttcgaaagcagactaaacatggttcccttgtgtattgtttgattttaagaccagggtcatgttgactttgtaaaatagacctggaagcctgccacatgtttctatgcatggatgtgtctttctggagtgtgtgaatgaatttgcccatcaaaccatctgggtgcagtgccttttgcggggaggtcatttttcaaaggtttgacttctttttggcatctcttgaaacccttttgataatttgaatctcatggaaggtctggtgttgaagatacagaattataagtcatatgttcttgcatttaaaaagtttctactataagtacagcacggtggctcatgccggtaatcccagcactttgggaggctgaggctggcggatcacttgaggtcaggagtttgagaccagcctggtcaacatagtgaaaccccgtctccactaaaaatacacaaattagccgggcatggtggcgggcgcctgtaatcccagctactcgggaggctgaggcaggagaatcacttgaacccgggaggcggaggtcgcagtgagccgagatcgcccactgcactccagcctgggtgatgaagcaagactccgtctcaaaaaaaaaaaaaaaagtttctactatatttgttgtgccattgttttctttctaatccctaattctgagcatttgtgttctctttccctctcaaattaccctggcttatctgctgtttttattgttgtgatgcacacacacagaaccagccatggtttgctaatggtctcccgtttcctgactcgttaatttctgttaccacttttctattccgttctcctgttttcttttggcgtatgttattggcctttaaaattttttccccagatcttaagttgaatgtttagtccatttatttttgttcctttgggtttggtaatgaaataattaaggctgtggattttcctccaggtatacttcagactttatcccatttgttttgatatattcttctttattattttctaaatattgtgtaattacagttttaaattcctttttgatctggcattatttaagagggcagtttcttacatttctaagtgtttaggagttggggggatggggatcttgtatatttattctttcattattaatatctacttttattgctttcctggtcaaagaatgtggcctgtgttttttataccttttgccatttattgatagtttatttgtggcttaaatgtgaccaagtttttacattgttccagggcttcctggcagaagatgttatctttgtttgtaggatatgatgtttactacatctatttcaatcagccttttaaattaaattattcgggtcttctttatcctccttgtttttgtctgttaatcagtcctaaactgaaagcagtgtcctgaggttttcttctgttgtctttaggtttttcagcatctgtgttttattcagatagttctatgctatttgataaaatttctccactctcatgccctcgttgtagggtgtatttatcatcaggctcatgtctttcctggcatagcttgatgccaggcggagtggattctccctggccccctcagcattttccctgatgctgttggaatcctgtcctcgcctcttaagctgccttcatagcgggtggatggtatctgcacttggccagctgcctgagggatgtgggtgtggcccaggcttgtagctggccctgcagggtggatttgttgtttcttgttgcttccctcaagcttctactgtactaggggcctgctgtggatcagcttgctatttccttgggatgtgtgcaaccaccttattctggaacggggggtaaaccctgtagctgggggagaagcccagctgcgcacaggcactcagctgcatgtggccctgcttggccctggagtgttcactgcaagtggtggagaacggggcaccacctgagcaggagacgggttctccgtggaacgggcttcatcatcccattgcccaacgcttgcctccagtcctcgtcgctccaaatgagtaggtgttggtggtaactttcagccatattctcctgtgcttcctgccacgctatagagttttctctagaagaatcatgagttggacatcagtgtgtagatcttcctccagtctgacctgcattgtatatatttattggcaattacttgaagcctgggtcacgggatggcgcatcgtcctggtctcctgagatcacgcaggcttgtggttcctggggactcaattcaggaacaaaagcaaagaccttccccttctggatgcctctgctcccccacttttttgatacagggtgtcacactctgaagtgtgggctggagtgtagtggtacaatcacagttcactgcagcctccacctgccaggctcaagctatcctcccacctcagcctcccgagttactagaactacagacatgagccaccacacccagctaatttaaaaatatatatattttgtagagatgaggtctcacggtgttgtccgggctgatcttaaactcctaggctcaagcagtcctccctctgcctcccaaagtgctgggataacaggcatgagccactgccccctggccattcctccctttttaattttttttaaattttttctatttttaaaaatagagatggggtctcactatgttgcccaggctggtctggaactcctggactcaagcgatcctcccacctccacctcacgaagtactgggattataggcgtgagctaccgcaccctgcctttcatccttcccttttttaaatgaagtgctttatgactacttataacttttgctattatcgctttgttggattctcacaccaacaaagtaggtcaggagaatacgtagaattatccccattttacaggtacagaagctgagggtcactgaggcgaagctgctcgtctaagcttatgtagttatattcctacaagagcggtaccacctgggaaccgagatcacgtgggtcccagtgtgaattcgtgatgtcaggagcgtgcgtgtagcggcgttggggcttgaaactgtccatgctgggagtgtctttggcacagaaatcgacagatactacatatcagggctccccctgttccttggagagcaggtttatcagcaagtgttgggagcatgagtgagtgtcccccaagagacataaagttataagggtagaattttagagcctcagataatgtgttttttttgttttgttttgttttgttttttgatggagttttgctcttgttgcccaggctggagtgcagtggtgcaatctcagctcactgcaacctctgcctcctgggttcaagcgattctcctgcctcagcctcccgagtagctgggattacaggtgcctgccaccacgcctggctaatttttttgtatttttagtagagacagggtttcaccatgttggctaggctggtctcaaactcctgacctcacatgatccgcccacctcggcctcacaaagttctgggattacagacatgagccccagctccaagccagattatgtatttttaattctaggagaacggtgactcaagaatgaagtgcatatgatcacctgactattaattgacagagcctaatttcacggtgaccagtcaatccagtcctctttctagtatattcacactccgctgctctgagtttgagggtggagaagttactaagaaagctgagggaaattgttggaaggtggtggagagccccccgccccgactctacggagggagattggacccgtgactggcatttgtaactacaactgatgtggtatttgtagcaaaggcagctggaccatagtgacctcccctcctgttaggcacattccttttgctctcgggttaaaaaagaaactcagtcccctaagaattcagtaatttgggtgctgaggattagagagatgccttcaacccatttccagctctgcagatacagataagatcagatcctgagggatggtcttcgccacgcaagacctctcagagccaaggaaggaggtgggaaaaggggctgcagtggacgaaaggcgggggtgcccatctgtggcccacacagcatctgagccgtgtctctgtccctgcagtgaatggataccacgcatcagggaccccagcgcaccctccagagactgcccacatgagtgtccgaaaatccaccggtgattcccaggtaaggggtcctgttgagggaggtatagcggtcactgcttctgcaggcctaggaaactgcattacaaagtccatcatgggagtccaggtggctgcagcccagttctgcccccaggtagaaagtggttgctgtgtctgggttgtttcagtgttccctgatggggagagggttggatgattgtggtctgttggttttctagaagtcgagggtggtttggaggaggggctgacggtgatggggttgaaaccattaggacagagagttccattctctggtctggattcctgatacctgaagcctgtgtttctcaccactttaagagtatggatgtgccagacaattttccttttctctaccctacccctcccacggacagattacccagaatggaatttagtaaaatttgatcatctcatttgataaagtagcatagagagagctatgagatggaaggaaatgggagtatgttgtacgatttccaaactgttttctcagtctccatcctacttgatgtttatgcaaacatgtgagttaggcgtcagtaacaactcaaggtatgcatgaggtcaccgaggctccaactggttttgtgacctgtgcaggctcacaggattactcagtggttagactggaccttgatgtcagtgcttacggcttttctagttgcgtgaagctgtgcctaaaaaactgaggactagccttatttagtctacccataaattatcaagaagatgttcttaatgaagcttccaaactccagcagccttttccaggaattaaaatgccagaatcctggaggtgataatgaaaatgatgacaataatgatcattgatgatgatcatgatgataatattgatgatgttgatgatgacagtagctgcatgtgcagtggattctatgtaccagtcactggaagaaggaaatctatacttaacataaggaaaaaatgactggaagaaaaataaaccggaggattgattatggttctgtctgcatctgagaccgtggttcttaatcaagggacatttggcaacatctggagacccattggctgttagtataatcagctgaaatgtgacactcagctttatcatggacaagagtgttaatttgggggaacgttattaagtcgttctgttaggatgctgagtgttgggcttcgattcagttcagttaactctggaaaagaatttgaacctcagtgtatgtcaggacttcttatgttttgatggacttagagtgagctgggcctcttgttaaaatgcagattctaatccaggagatctagggtgggggctgaggttctgggtttccagccagctccgaggtgacgctgatgctgtaggtctgaggaccactcctgagcagtggactagcagtcagtagcacacagctggcctatcggtctccttctctcgtctgctcatgtcacccatcatgaatcaaccctggctttgtatgtttcctgctgagctcccagcttgccttctcaacacagattctgttatcctgtttgaagtgaaacttacttttgtctcctgatttgagactgttttggaagacatcagcctaaattctgatgtggttcagcaacgatgacagaaatctggtgttaccctgggcatcatcaggaagaatatgagaaacagctccccatcctcaaaatcattctttcttccctgataaaacataatcccttctgaaatactgtgaagttgttactcatctattttaaagaatggacactggtataactgatatctcagaagctgatttaacactgtgcattataagccatcgacacagggatgtcttgtctagtgtctgttcttggggtatcttgaggggttctgatttatgtgcaaggctattcactcacacattatttacagcaccataacactagacccagcctaactgtcctgcaacaggggatgggtaaaagggatgatggcgctggaggttagccagtgatactatgcagccattagcaagcatgcttctgaagaaaatgcaataatttgggaaagtactcacaacataaaatagagtaaaaaaaaagtaggacacacattgcatatatagtcagtcttatttggcagaaggaaatctatacttatctatacttaggaagaaggactagaaggaaaactggaaaacgtacggtggctctgtctgcgtctgagatcatggctatcaattgggacttttgacaatgtctggagacgtttggattgtcacgcctggggagggggggtgctactggcaactagtaggtgacaccagggatgacgctgagtatctcgcaaggcatgggacaccacagcaaagaagtgctcaacttgaaaacatgaatcgtgctgaagttgagaacctttggtctaagatcatgggtcattttattttctttacacttgttgttatttttcaaatttcctaaaatgaacacattttacttttatagaaggcagatacaattttttacttaaaaaaaaaaaaaagctacaaagtaggtaccagtatggggaattcaggagaggcgagctctggagatgcaggcccgggtagatagtggctgcctaaagacaggcggattgagtcagactctttttggatggtaaccttgggagctgaggtgtcatcagggtaacaaaaataaatcatgtagtatatggagagggcgaacgtgcgttgttcaccagtcccaggatcaggaggtagaatgttattcttttaggctttgaaagggtaacatttggatataaaagctactacttttttaagttaaaaataattaggaaacagggtgtccctgtgttgcccttgctggaatgcactggctgttcacggaggtgatcgtagatcactgtgacctcagcttggaactgctgggctcaaacaatcctcccgcctcagcctctggagtagctgggactgcaggcgccggccaccacgcccagctagctactactttttgtcctggtttgtgagcctgcaggctggttatccaaaaaggtgccaagagttaaacatacaaataggttaagaaggtttggtgtttacagagagctctaccaacaaagggtccccaggtatagaccccactccagcatgcagacgagtagattcaccatccctgctgtcagttaccactcatgataactacacttaaacatcaataaatgaataaatgagcaaaggaacacttgagatgcggcatgtggggtggataaagtggcatgttcagggttacagtgacgaaacctagactggaaagccccagatctcaaaacccggttgtgatctctttccgccccctgcttagctgcccctccttgagcaagctgatcaggaagattagaattttggggggagggggcggtcgtggtggctcaagcctgtaatcccagcactttgggaggccgaggcaggcagatcaggaggtcaggagatcgagaccatcctggctaacactgtgagaccctgtctctactaaaaatacaaaaaattagccgggcgtggtggcgggcacctgtagtcccagctactcgggaggctgaggcaggagaatggcatgaaccagggaggcggagcttgcagtgagccgagattgcaccactgcactccagcctgggcgacagagcgagactccatctccaaaaaaaaaaaaaaaaaagaattttggggggtgggtgtcgggggatggggaaagggactttccacggacaccagtaacgtgtccccaccatactatgtcatggggaggactgatagtgggtgccccacagttcctgagggtgcctgccccgctccttcactcagcccttggagacctggatgggtgggcacaggaggtggtgatctggtgccacccagtggagggtttcaattctgcagccctggggcagtcggcccaggtactgggtaaatgcagcccacctgattcgggggcagaggcgagggatcaaaggcgaatcatctttttttattttttattttactttaagttctgggatacatgtggagaacgtgcaggtttgttacataggtacacatgtgccatggtggtttgttgcacctatcaacctgtcatctagattttaagccctgcgtgcagtaggtatttgtcctaatgctctccctcctcttatcccccacgccccgataggtcctggtgtgtgatgttcccccaccggtgtccatatggtcccattgttcatctcccacttatgagtgagaacatgcggtgtttagttttctgttcctgtgtttgctgagaatgatggcctccagcttcatccatgtccctacaaaggacatgaactcattcttttttatggctgcatactattccattatgtatatatgccacattttctttatctagtctatcattgatgggcatttgggttggttccaagtctttgctgttgtaaatagtgtagcaataaacacgtgtgcatgtgtctttatagtagaatgacttatattcctttgggtatactcagtaataggattgctgggtcaaatggtatttccggttctagatcaaaggctaatagtcttgctgcctttgcagaatcgcgtcctagtgggtcccttcccttcctgcccaccagtgcctgggcctttttgtgatccacctttcaattgttctggcttctcacgaacttcccaggaagaccctctagacacaggagagaggaaagagaatgggacgaagggcttggaaacttgagggacccattggagcatggagttcaaagtggagaaagaggtgagatgtttaatctccaccacctcctacctacctcaataattcaataacacatgttcttattgagcaatttcggtctttgtcaggcactgagacacaggtgatatctatagccctgcgttgatggagttttatggctggtgtgggagaaacagtagataaataatggtgcaatttcagcagtgacaaaggctggaggaagtggatgctgtgagaacctagcctggtgctggaaatgtcaggaattaaggtaccttaagaaaagatacctattctaagactggaatgatgagcaagggtttcacttggcaaagaggtggggaaagaatagctttccaggggagggaatagcatcgtggatgcctggaggcagcaagggggaaccgtgtttacgcatagagacccagtgtggctgtggcttactaaatcagcaggaatagggagggtgggaaatgaggctggggtagtctgcgcaggcctgccacgaggagctcaggggttatcctaactgcactgggaagccattgaggggttttgtacaggatcccacctgctgaagggatgggacccagattatttgcagggggggaggaaatgggctgagaagacatttggagtcgggggcctgctgaatcacttgtgaatgacccactccagtttaccaagcacttcctgtgtggtatcaccccctgccaggcctcagggtgatgcagagatgcccaggtggggtgtcctgacccctgggcaggcctttacaaaataaatggaagggaagagttctctggaatcacaggcaaaggaaatttaaaacaaatactcttattataggcatttgcaaacctttgcaaaagtagagggaatatataataaggtaccacaaatctgttaagcccaacgattacctgcctttgtccaatcttgttttatttgtgctcccatcccctcccccaatccccttgccctccaccccctagattattttaaaccacatttctgacttactgttttaaatgcaaatatttcagaatgtatcttccaggaagaagacataatgataataccattatcatatttaagaaaacattaattcaataatgccgcctaatatatacactccagattcctcaattgtctcaaaaaatgcctttttttaagaaagaaaaaagagagagatggggtcttgttctgtacctcaggctacagtacagtgacaccattatagctcgtgaattctagaactcctgggctcaagcgatccttccacctcaacctctcaaagcctagggttacaggtgtgcgccaccatacctggcccccaaatcccttttatggctgcttttctccccagtccaggatcccttcaggttcacacacagatacactggttgctgtgtctctgttgtttctctctctctctctcttcccccaccaaaaaactgctttattgagctgtaattcacatacccatacaattcacccatttaaagtgtatacaattcagtgttttttactatatttacaaagttttacaaccatcatcaaatctattttagaacattttcatcaacccaagcagaatcacctgaagacttaggcagcccctaatctttctgtctctatgggtttgcctcttctggacatttcatataaatggtatcatactatctgtggtcttttgtgtctggcctctttcacctggaattccaaggttcattcacatcgcggcatggatgaacactccattcctttttatgacagaagaatattctgtcgtatggatagaacgtttcatccaagttgttgcctgtctcgttgcctctacactcaatcccttacacctttttttctttttttttttttttcatcaccttgacgatttatttttgaggagtccaggtcaggtgtcttatagaataacctgcgttcttggtctgactgttctcttatgcgtaggttcaggttctggagtttgggcaagaatagctggacagggcatgtggggttctttttactgcatttgggggcacaaccacccaggttggcaccctactcatgaggctcagtttgcactctcggttaaggtgctgactgccagatttctcctttgcaggggtacattttccctttctaatttgtcagtcatctgtgaggtgccagtgtaagaccctgtgagtatcctgtgccctggcagtctttccatccactgctttcagcatccttgaggatcatggcctgagtcccctttgaggctggggtttgcaaatggtggtcatccaatttcttgtacattttttattggcattcttctgaaataaatgttctctcccttcccctttggagttagttagttagttgcagtcattcattcatatttgtgctcaaattgtcgcagatttggcctgtggtagccctttaagttgtttatgttcttttgttatctctccattattctctgaatactttcttacctcttggtacaataggatattccaaatacctgcctttgaaattagtaccaaggagcttccggtaatatttggaaaccaatttctagccagtagatgttgtcactgtgatgagatgtcattccttctgggccctttcaatggagaattatgatagtgtgtgtgtcacgtgtgtgtgtgtgtgtgtgtgtgtgtgtataaaatgcacgtgatatgtatatgaagttggagcagtaggcacaggttatcagcagcacaggcagagcctgagattgcctgtgatctaccttggccctcagtggttgaagtaaaacactgctaatagaacagagaccagggaaggtgctgacacctaacacgtggaacacccaacctcaatgccattacttgtattcctatcctagccaagttataaggaggaggtgcgacctctgcgtcaagccttattctacagagatttatacacagtggtcccaaaatatatgtttgtggttgatggaaatcttttttgccttcctgcaaagacacatggaaaacaaaatattgtctcaggtctcaaagtggagagatggcggaagatagaggaaagagttatgcaggcttggattctaatttccactcctctgtttactatagccttgtgaccctggacagttttacttctgcaagccccaatttcatgatctgcaaaatggagttgatgccatttaacttgctggggttgtaaggatgaaatgagattaaatatgtcagatggctaacctggagcctgccgtaataagcaagcactcagtagacagtcgctcttgcactgcttctccccttagccccctcatcaccaacatcatcagcatccataggcagactcgaaggctgttgccaaggctgctggagtgctggttcccctctctggggggctgcagtgggaacgcggtggtgatggtggtaatgtgtccatgacaggaagacagactcctgcagactgcagaatccatcccataggctactctttccccttcctgccatgtatttgcttggctagagtctgtacgtgaatgaacctatggagagagagacttctatccctgtctcttctccttggtgactggtacctcctgccatgtagcctccgtctgcctttctccctgtgcagttttgtcaagtgggaaggtatagggtgggccagctggatgagatgatgcactaaaaatgtctatggaagctgtagttggccataaagttgacgttggccaggagcccgttggggtcactagaggagttgccataagtagaggtacctcagtgaaaccacagtgtagatcagatccatgtatctctgagtgaggtccacagattctgcaaatcagaggtgctggcaccacctgggacctgctggatcaggcccagcagctgagagtgcagctgggactctattttggacactttttcctcagttgattctgatgcacctcaaagcttgaggaccagtgataaccatccatttgacagatggagaaattgaggctcaaagaagtcagattctctggccagggtctcaaggctagtaatcattttcttgtctgtgaaattaatgctctgtaaggttcatttttgctagacaccttaaggatatcagttttcctgagttgactttaattagcaacccaagtaagactgtatgggagtaagggtatgcgaccttagcaggggcatagtcaagctccctggtttgcctaatttgctgacgggtttctgaggcaaaggctcgccctcacctgcagatggtcatttggccaggtgtccagggtcgtgctggcctgaggggcggggtgccccccactccaagccggtggttccttcttgttgaagcccctccatcctttttctggcctttatctataaagtgacagccacttccttacattctaccaaggaagagtaaggccagactggccgcagtggctcatgcctataatcccagcactttgggaggccgagacaggtggatcgcctgaggtcaaaagttcgagaccagcctggccaacatggtgaaaccctgtctctactaaaaatacaaaaattagctgggcgtgctggcgggcacctgtaatcccagctactcaggaggctgaggcaggagaattgcttgaacctgggaggcagaggttgctgtgagccatgatcacgccactgcactccaacctgggtgacagaatgacactccatcttaaaaaaaaaaaaaaagaataaggtcatgcacaagtcctggggcacaagtgtgatggccacctgcggtgccttaggggtaagcctgcttcccaggttgctgtgtggctcaggataggagacatcccaggtcctgcttggggatctctggtattgagcccccaacataattgctaatagaacaacagagacccagaatcaaacattctttggagtcgtaggctcttaggacacgtgtagcattttgcactggcagtccttaattttctctgccagaacgatcccaggactttggcaaactgctgaggaccccaggctcagaggtacttgggactctggttttcttactggcggtggaagacatcaaaaggcaatataaagactgagtggaagctggaagtcggtttggctgagaaatccctcctggctcacggggttgggggagcggggagtcagggaggtgaccgagcagcgccccagtgcacattgtgtgtatttaggtttgacgttttggacccggggggtttcagaataaaatgtcgtgtgctgattcctcagtgccaggaggtggtggccttaactctcttctccccagtggattccgcggcttcaggcagcaagcggcacgcggaacgttcaccagcagagggcagcggaggggttaactccccaaatcacagactgagagaagaggaggggagacctggtttggagcagttctctcagagcctgtgcaggaggcttccttaattcgccttcagcccgagagctgggcgtgggaacagcgtggggtcagggagacccctgcttgccctggcccagaatatggtgacttaggattcagactgagcatccctgattccccagcgcctccaccctcagggaacctgaatggggggaaaaaatgtccaatatggagaacagctttgacgatgtttcttgcctctctccccagaacctgggatcctcatcgccaagcaaaaagcagagcaaggaaaacaccatcacagtaagtggctcccgaggggcgccctcagggtgggctgcgagctggggcatttggctgggctgttgccatggcgatgtggaccgccaagcagaagtgatgcccaacctggaaacggggaagttccaaagctcggatttcactcaagttccccatccacatgcccctcccacctccccttctcctgtcaatttcacatttcacttctctcctggtgaacaagtggaaggaggatggctgggatgatgcagaagccgttttttcagggcaggaggggaaggtatgcgtgcgggagtgggttgaagggggtggactgtgctcagcgcaagtgatgtgacgtgtaaattacagccacggcagggttgcttttgtgcggggtaacttctggaagatgtcaaagtaaaaagcaagagaaagcgtcctaagaatagagttcctaggagtccctgaggggagcaggcagcttctgcctagagtggccagcctgcctcccagggcgcttcgagatgcccaaccccatgtggagatgagggggagcccaccccacccacccccatgcagagatgaaggggagccccacactccacctctgctcctcagccctgtgtttggggcagctggggctggacatcattgccccctgaggggcacaggcctgagaagtgtggtcgcaggtttgctattttggcacaagggcaggagagcagggaacggggtattgctctcttaggctccaactcacacagctctgagccattccgaccacccctgtggagacaaaaccaagagtgggtgcatttccctgcttcgtccaggctgcacatcctgctttgggagaaaaagtgtaggtaaacaattaacaataacaattgctgcaacttttgtgtgcacttattatgcacatgtagtgatccaagtggctcatttaattgtccattagctatatgaagtgtcagtcgtggaatcaatatagtataacgatgatgaacgtggactctgaggccagagtgtcggttatattaatgacagtgcaacagcctggggcaagtttcttgacttcttcccgtctcagtcaataactgtcaagtggggaaatggggggtagtgggtggtctctgccttagggatggtgtagggactaaatgggtccatccatggaaagcacttagaacagagcctgcatatagtaagtgctctgtgcacactcatcaccctgtttacagatgaggaaactgaggcacagagccgcaccttgctcacggtcacccagctgggaagtatcaggatttgaaatctatgtccttaccacagtgccccttctggagctggcttgggttccttgtgtcatgagctcctttggagtgccctgtgctgatggacggtgtctccaagggctgggcagaacgactcagcctgcttggactgtggggtagcagcagcctccctgttaccggtggagttgatggagctggtgggtagggggtgtgggcaggctcaggtgcagagttccagagggtacagtccccatcttcaaattgtcacaaaatgccccagaatgctggggcacagcaggagctctccagagtcttctgaaatacataaaaaggagggggaggagaaagggggggaggtcggagtgggagacatatttgaattctagaagaaaaacaaaaatgcaaagtgaaaagcagagtgttatgtcgtggagggttgccttaaaggcgcttagtgatggtgcccaggccacagggtggggcacctgctggagtccatcttacagccagggcttcgggtgtggccggagggggctgatggcggcccttgttgggcccctgatgggcagcacacctcgcccatccctgccttccctgtcgcttcctgctgagccatatcattgcttctcatgagggagtctgcaaattgtattctcaagcctccaagaccttttttaaaatgcagattcctggatggcaccccagaccttcagttgttttctctggggccagactggaaaatctgcatttgagccagtgttccccagaggttttaagtaaacactcatgccttggagaatttttttgccagagaaactgagcaaaggagcgactggccagaggtcacaaaacaagtgaggagcagagcccaggacttgaacccaggtctcctggctgccggcccaggacacttcccggtgtaccacctggccttggcccacaggtctccaggccttggtgccttttcccttccacacaacaccgctctcccatgcccagcctcttcctctgggttctgatcctccagagttcatggtttcccaagaaggagatgctcagggggaaagggatggctcaggtctcaggaggctggggcgtgaacttccttttctgtggtgtgtagggatgaggtgagccgcttcccgtgccgtctgatcccgcagagcagaaatttccaggcctgggcagcaaagggtggtggatccagagaaagaatggagctggattctgacgctcctttttccccaggctatgggttttcaggggacagacacatgggccccctgacagcaacgggcaggggctggcagccttgctgggtcttgtttccgctgtccctggtgtggggctggcaggtggagtgtgctgtttgattgggagtgacgggtgctcatggcagctcacagcccttggcaggagcatgaacgcgtctgaatctagagggtttcagaaaagatgacagcaaagccacccggccacactctcacctggaaagaggaatttggggacacctgtggtcctcagcttcagggcttcccagcgtagccacagaacccggggtaggggctggaggtgaacccttggggtcctgtctactcttcttctctgttccacagagctccggggctggcttgttcctctcccataccctcccagatcagctttcctctgggagaaaattcagagcctgttggacttgaaccctcagttgtcaaaccattttcccttctctgctgcaggcaaggtggtcaaacaggccgtgcaagaagcctgtggcctctgttccccacaggctcctgctgggccaggacttaggggaggggcatgccttggggcctccgtatgtcagcccccttggtcacacgtgtgttcagtggctctcacacctcagccaggtggttttctggctgctgtgtcccactgcgtacccctcagagagcttctgggaggcagcccatgtgcttctggctgctcctgtgcggaaaagccctgcaggaaccccagctgcacagtggaccccagcagctggggagggatgggggtgtcactccatttacctgagggttggagaaaacagagttggtgcaagagcgaagacgcggctttgttgaggacactggtctcgggggaagtgagggtgggactgcctgctggaacttgccctgagcagtacacacggggaggcgtgcccctctctggctccctcttgagcacccttcctttttgagcccctgcctttggtggggacctggcacatttatacctcagtgtgttggaaaggtagtgtgacagaggctaagagcctagactgaagccggcttgcgtgggttcagagcctgggtccacctattccatgcacaaactgtgtgatcttgcataagtgacttagcctctctgtgcctcagtttccttatctgtaaaatggggataataatagcacctgccttgcagggctgttgtgaggattcaatgagctaatacgtgtaaaacgctgagaactgtggctggcacattatttgcttttgttgaacaaacagaaagtggatctttaggatggcagtgaagctcctgctatgcctgggaggccttgggaggaggatgaggtctttccagaggtgtagctggaccctggtattaaccatcaggaaaatgtaaccggggggaggacaggaatccacatgcggaaagtcctgtcccaccttctcttccctccttgggctttggagcaccgcagggtggagctgtgtggccctctcagcccttctgatccagggacctaggagccttgactttgaggtctggatgtcacagaaggacacagcaaggataaaagtggtggcccaggaattaggaagctggttctggaccctgctctgccacttatagtgaactagaattaaacattctgtgtctcagtttcctcatctgtgcatgaggttgcactagaccattgcaaataaacatcgaggctccagttgcttccaggacatctgcgcgcacacacctctcaccatgcccctctgctgccactgcctccctctctccgaagggactgttcttccatcttccatcccaatggatggaaacatgcttcctctccacccaggtcagtcaactcagggtttctcagcctcagcaccattgatcttttgggttggatagcactttgttgtggggagctgtcccgtgcattgtagatatgtatcaccttccctggcccctaccaaccagaggctaatagcatccaccctcgaccccacacagctgtgacaaccaaaaatgtctccacgttgctagatgtttctggggtgggggaaaaattgtccctggatgggcatcactgaattgacttcatggtgctgtcaagggctacctgtagagtatcccaggcttcttctaatcccctcttgactatgctgctcccagctgctatcatgaccccccaccccccatcccccatcactgcagactgccctgatggccacagtcacgttctccctccagtgcatcctctatgctgtagtgggggtgctcaccccagacaacagcctgattaattgttactctcctgcagggtgcttctgtggcccccgctgtcctgctgccttcaggacagaccttggcacccctgcaagaccccctctcagctcagtcttgtctactccctgactcaggagcagccagaagcacaagggctgcctcccagaagctctctgaggggtacgcagtgggacacagctcagccaaaccgagcaacgcggtccccacctgtagggcatatcctctcatcctgagtcctttcccttcctgcagtacccttctcaccttcccacccctctgtctgcctgggccctactattattacctaaatctaagattcctcccctggaccctcagtccttccagtaacctcagcacctcaggcttactccactggcaggtttatcccaaagaattacagtgacttatttacggaactgttgagagcagagatgatgccttacattcctagcctccggccactgcaccaagaaacatctcctgagcacccactatgtacccaacactgcaccagtcaggagggaaatggcagggaaaagatggtccccatccccttgtagaacaggctgtctggcaaggaggagaaacattaaataaaccatcacgagaaatatcattacaaatgtatgcatgcagcttgctgggaagagctagcgtagcacgtggcactgagcagcctttcaacagatgttcgaatggaaagtgaacgagcaaatagcccatcacatagcttcgtggtcgaggctggagctctgcagtcagctggatctggattcggatacctcgcttctgtgatcctcagtttcctcatatacgatgaggctgttcttcctcccctgtggagttgctgggaagatgaaatgagaatacatgcaaagccctaaagagggtgcctgagtcagggctcccctgcaggagtgaggatttggagaaatcccagtgggcttcctgggagggagaaatcccaaaatgagagaggacagagacagtggcaggcacctcggggctccatctgaggactggtatcctcaaggagtggcagaagcagcagggtgatgagtccttaatgagtcctcacattctactgcctttactcttctgccccaacctgttttctgttcctgcattcgtttgctaaggataatggcttccagctccatccatgtccctgcaaaggacatgatcttattctttgttacagctgcatagtatttcatgttgtatatgtaccacgtttcctttatctagtatatcgttgatgggcatttaagttgattccatgtttttgctattgtgaatagtgctgcaatgaacatatgcgtccatgtgtctttatgtggaaagatttatattcctttgggtatatacccagtaatgggattgctgggtcgaatgatagttctgtttttagttctttgaggaatcaccacattgctttccacatggttgaactaatttatgctccctccaactgtgtataagtgttcccttttctctgcaaccttgccagcacctgttattttttgacctttttaattatagccattctgattggcatgccatgatatctcattgtggttttgatttgcctttctttaatgattagcggtgatgagcatttttgcatatgcttgttggctgcacatatgtcttcttttgaaaagtgtctgggccgggcgcggtgactcacgcctgtaatcccaacactttgggaggccaaggtgggtggatcacctgaaggtcaggagttcgagaccagcctgaccaacatggtgaaaccctgtctctactaaaaatacaaaaattagccgggcatggtggcaggcacctgtaatcccagctactcgcgaggctgaagcaggagaatcgcttgaacccgggaggtggaggttgcagtgagctgagatcatgccattgcactccaaccttggtgacaagagcaaaactttatctcaaaaaaaaaaagaaaaagtgtctgttcatgtcctttgcccacttgccatgtaggatcttaagagcagggctctgtggcttgtttatctgtgtgtcttccattgtggtgggcacaaggtctcccccaggggctgtccctgtccctgctaaatggatcacgaatgctggttctcaaagtgtggtccctggaccttcagcatcacttgagagctcagaccccatccagagctcctgaatcagacagtggggggtgggacccagcaacccatgtcctctaggtgactctgaggcatgttcatcctcgactctgggacaagaaggggactgagtggtacttaggtgggtctcagtcctcctcaggacttccatggccttttaggtggttggcttggagccagccaggatgcatcattgaaggggctgtccttggtaccgtctcctcttccggctagcagtctgtctgcacaggcctgctggggtgcacggtggcatcctcactctgagggtaagtcaactcaggaagattctggggggaacaagactggccaagacccatttctcctcctgcctgccccacgttttggccaagcctcttcctgacatgggaaagtcctttcttcttgttttttttttttttttttttttttttgagacagagttttgctcttgttgcccaggctggaatgatgcaatggcgcaatcttggctcaccgcaaccgccacctcccaggttcaagcgattctcctgcctcagccttcccaagtagctgggattataggcatgcgccaccaagcctggctaattttgtatttttagtagagatggggtttctccatgtgggtcaggctggtctccaactcccgacctcaggtgatccacccatctcggcctcccaaagtgctgggattacaggcatgagccaccgcacctggccaggaaagtcctttctttgtagggaagtgtttccccgacaagagggcaaggccaagagcagtttgagtgaggaaagacgatggaaaggggagagatgcccgcagggcaggccactccagaagcattcagacccgcctctgagtacccacaactctactcgttccatcattcttaatgctcaatttactttaatgtcatagttaatttatcattaaatttgattgaaattttcatggactgcattattcagtaacataaagatggactgtgatgactgtgatttgttgaaataagaataattggaatacaaaataaggaatctgtgcacttttgaaacccgtcccttgttttcatgattgcctgcttggcagtgggttgtggaggcacaggaaggaaggagacttgtctctggacacaccttggggactcggcccgaaaccaaggcttggggctttctgctgctggcctcaagaactggccctcccttctctcactgaggctgctgaggcctgggagaaaactccccagcctcagctgatcttcatctagcctttgtttttttaatccatcacagtgctaattttttagagttcaggaagctgtgcaccttttttttttttgagacacagtctcgccctgtcacccaggctggagtgcaatggcgcgatctcggctcactgcaacctccacctcccgggttcaaacaattctcctgcctcagcctctcgagtagctgggattacaggcgcccaccaccatgcccggctaatttttgtattttcagtagagacagggtttcactatgttggccaggctggtctccaacttctgaccttgtgatccgcacacctgggcctcccagattgctaggattacaggcgtgagccaccacacgctgccacaaggtgccttttaaaaaactatcttgattttccccacttatcattagattcagattaaatatttttgacaggatttttttttaacttaggctaaagtgcagtgatataatcatagctcactgcagcctcaacctcccaggctcaagagatcctcctgcttcagcctcccaagtagctgggactacaagtgtgtgccaccatacctggctagttttgttttttattttttgtagagacaaggttgtgctatgttgcccaggctggtcttgaactcctgagctcaagtgatctgcccgccttggcttcccaaagtcttgggattacagatgtgagccaccatgccctggccaggaatcttacatagataatgttgtattcttagaagttacacattttgaaaaggagaaagaggcccagcacagtggctcatgcctgtaatcccagcactttgggaggccgaggagggtggatcacttggggtcaggagtttgagaccagcctggccaacgtggtgaaatcctgtctctgctaaaaatacaaaaactagccaggtgtggtgacatgcacctgtaatcccagctacccgggagaggctgaggcaggagaatcacttgagccagtgaagcagaggttgcagtgagccgagatcgtgccactgcactccagcctggtgacagagcaagattctgtctaaaaaagaaagggagggagggagggagggcaggagggaaggagggaggggaagagggaaagagggagggaaggagggaggggaggagaggaggagaggaagggaggaggggaggaagggaaggagaaagagaagaagggattatccttggcagaatttggtgcagccctgtcatctccagggtcgtccacgtcattcctgcctctgatccttctgctgagttgtgtttccctctagggtggtggggacctcagccctcaccttaaccacatgtaaggatctgggaggaggaggctccttcttttgttggggacttctccccagactgcgactgaggtctgtgccctggcagctggggagggggtgtgcgctagatttacttctagccacccaggagcttcctgaaccagaggtcacaacgggaggtccatgggcctgactttgctgacagaagagtttgttgggcctacatggtgttattgtgtttattattattgtttttaaccttgaattaattgccaacacttaaaaatggagacactttgcataaaagtccccattttcagcttccctcgagtcatcacataatccgtcagcactggactcctcagaagggcttgacgacacttggcaagagctgagcaggatctgccccttggacgcatctctgcagcctctggcccctgcccaaagagctgagcaggatctgccccttggacgcatctctgcagcctctgacccctgcccaaagcagatgctgtccgccctcctatcccagctgcagtttctgtgacgctgtccgccctcctgtcccagctgcagtttctgtgacgcctgggtacctcactggcttgcacaccccgcctagcattggagtttgtgtcctgggcccaaaacctcagggctgcatcattttttaatgtgtgacattttccacttcagcaggtgcttgggctgcaagaaggggttaaagacttataaggctcaggccttgctcccacagaggaagcaaattagcccgcgtcctaggagaggtgggaatctggggcctgaagccacctccacacaatggggaaaagccaggcagtattgcagatgtgctcgggcagaaaaggctgagatgacctgaaaatttctgtacttcacgctccttagctagggccagccttacacgtgcaacccagatttttttttttttttgagggggagtctcactctgtcacccaggctggagtgcaatggcacaatctcggctcactgcaacctctgcttcttgggttgaagcgattctcctgcctcagcctcctgagtagctgggattacaggcacatgccaccacgcctggctaatttttgtgtttttagtagagaaggggtttcaccatattggtcaggctggtctcgaactcctgacctcatgatccacctgcctcggcctcccaaagtgctgggattacaggcgtgaactgccgtgcccggccccccagattataattttaaggtgtatttgttcgtatgatacacatcgtgacataaaatttgcaaggtaatctctcacccctgaccctcacccacacagttcctttccttggaagcaaacaatgttatcagtttccaggaatattctatatgcaaataaccagatgtgtattatacaggtgacccttgaacaacatgggagctaggggtgccccctcctcacccatagtccaaaattgacatataactttgaactccccagaacttaactactaatagcctcttgttgagtagaagccttactgacatgaacacatattttgcatgtttatgtgtattatacactgtattcttacagtaaagtaagctagagaaaataaaatgttaagacaattataaacaagaaaaatataattactattctttaagtggaagtgggtcatcctcaaggtcttcatcctcaacatcttcacattgaatgggcgaagcaggaggaggaagaggaggggctggtcttgtcttcctttttgaaaaggaactataatactctgcttgctttttttttttttttgtttttaaccttcacctaaccatatatcctggcacattttccttgttaaattttcttttttttttttttgagacatagtttcgttcgtacaatggcatgatctcagctcactgcaaggctggagagcaatggtgccatctcggctcactgcaacctctgcctcccgggtccaagtggttctcctccctcagcctcccgactagctgggattacacgcatgcgccactacgcccagctaattttgtatttttagtagagacggggtttctccctgttggtcaggctggtctcgaactctcaacctcaggtggtccgcctgcctcggcctcccaaagtgctgggattacaggcgtgagccaccgcgcccggccgctttcctaattaaatttaagaacttcatcaccatgtcctttctgatttccatagatgtctatctcatactttgtttaaccattcccccactgatggacattggagttgttttccagcctttaacggccataaatagcgctgtcgtgaaaaagcgtgtgtggatgtcactgcccccatgcaactgtatctgtatgatagactcttgtgcaattgctgggtcaaaggcacctgaagtttgcaattttgatcctagtaaactgccatctagagaggtggtactggttcacagcccatttggggtgggggtgagcacctgttgccgctcatgtgaaatgctggcccctggagcacgggaagatccctgtgcgtgttctgtcaatagggaggctgctccagtgccgtgtcccccaggagccgaagccttcctcgctattccagtctccagcggggtcattctttcttgttctgtgccctacagataaactgtgtgacgttccctcacccagacacgatgccggaacagcagctgctgaaaccaaccgagtggagctactgcgactacttctgggtaagcagcgcctcagtttcccccacagcgtgaccccggtgaccgggagtggacacccaggatgggtaggagggacctggatctcaaagtggaggggcctttctcgttggagcgtgaagggctggtgttagagtttgcatctgtgacaggaacttaggaccctcttggggtccagctcattccatgaatctcaggggttcagcaggacttttgttcacattacagacacttcaaccagaatgtaggtaagcggggggccattttctccgatgctcagtgaaggcaggagactagaatctgcctcaataaatgaacgtgggctccatacctgcttgtcacttacgtgagtgacgttggacaagtgcttcacctccttgggcctcagtgttctcatcagaattgtgaggcagttgggcacaggatcttcagagagctccagcttgggtaatcctgtagttttaaaacgtttgcagatcacttagcgaacacagagttttagttttgcaagattaaagacaattttgcaggtggatggtggtgatggtcgcacaaccatgtgaatgtacttcatgccactgaactgcattcttaaaaatggctaaaatggtccgttgtgtgctagatgtatttttttcaccattcaaataaataaatttgtagaaatgcagagtcctgtacctcagaatatcctgggaatggtcctgggccatttgcatgttaaagtcatagtgactttcagaattagatcacccctttctggaatcagatagtggggatggtcacaaaccctgtgaatgtattgaaaaccactaaattgtacatttcaaaaaaacaagtgtccaaagactccaaggaacaataaataagtaaaaactttgttttcaccactttgcaagaatggattttttgagacagagtctcactctgtctcacccaggctggagtgcagtggtgtgatcttggctcactccagcctccacctcccaggttcaagcgactctcctgtctcagcctcctgagcagctgggactacagatgtgtgccaccacacccaactaattttttgtattttattttatttttttaatagagacaggatttcatcatgttggccaggctggtctcaatctcctgacctcaggtgatccacccaccttggcctcccaaagtgctgggattacaggcatgagccatcgtgcccagccggattatctacacttttttagatttgctaaccgaatactagataaaagtgcttttctctttctacaaaatcgcttgtaccttagaagatatacaaagatccctgttgcctacacctctcaccaaggcacaatttctgtagctccagctgtgctgtgtccagggtagagatctgtgcattggttgaggaaacagtataaaggggcttatctttggcatcagacagacctgggcaggtgagctcagagggcggggtaagcaagcatcggggtaagcaagcatcagagtgcgtaagactttctaggccccagtaagtgagttttattctgcttgtggaaggagggtgttagaaggtcttaagcagcaatatgatgtgatctgattcataggcattgtgcaggtgggggtgggaagttgacgggtgagtggaagagaccaggaaagatggtggtggcggcagagagggagagatgtacctgggtttggaaacatcatctctcaagaggggtgcagtaaatggagggttcaaggagagagtggtttgagccctggaaatgggtatcctagttgctggaggtcagcgtgtggggtctcaagccttggaaagctggtaggaatgtctgatgccgcctgcatccagcagcatccggagggcgacacttgtgagttcttatcttaattcgagctctctggggactctgatacttaatctgcaatccacttatccccctgaccatcaaggccttttccattaatagaaatttctctctcctgacacagtcattaaagcctgtttcttctggctggttttccccagagtgcatagctcagcatatccatcctagaagggaggcagatttgagctcagtatttggataattttccttctgctttttcatcaagatgtagcattcgtagagtgaagcacagagatcttcagtggacattgcttttaaactgcaagaacagcccgactgtgaccccgtaggatggtgatctccctgtcatcagggatgttagcagcgtggccggaggcctttgagttatggcacccgagggaggggtcccacaccgggggaactgggaaggtgtccataaaatccttcatctacttgatgatggtaaatggggttccctgcaggcatcagcaaccccttttctttcccctctcctaaaatgtctgatctggatgggatctgagagatgcaacccacccctatttcaagggggtggtccggggagatactacctaggattggacaccctgcagctgagcagagacaagaacctgggtcctaccagatgctgggacactgttctcaccaatgcacctctctctctgggatatcaaaaacctgttctgaacaccttccattaagtatcaaagtgtttgaccctgggttcctgatagggaaaagctgtaaggaggaggacacttttagacatgcctgggatggccctgggagctggtgctccagcagccacggccgtgcgggcagatgtgtgggtgaatctcaggcaggggaatggcagggaaggggcatttggtatgcttgaagaaatgcaggtaaaataaaataaatcatttaattttgaaattttaagaatatttgtttgcaaaattaattggctgctaagtacttatttcattgacttgcccatcctccccaagtttggacttttatttaaaagtaactaataacagatgccatttattgggtacatagtatgtgctcagcaatgtgctcagatatatacataggtcatttaccctgaaatgaccacatgaaggtggggctgttatttcgtcagttttgcagatgaaaaagcttaggcctggagtgagtgaagaacttggccaaggtcacccagctagtatttcagggcagcctgtcctgttctctcctccggcctcccttcaacccactttctctctatgatttacttttctctcctgtgatcttgtatgaatgtgtggttagagggtgtcactgccctaccagtgtaagaagttggtagaagacaggatggcttaaggctgggggtacctgctcctgagctcacacatagtccagcttggagtcaggatgccaagattcgccgagggccaagccagatctgcagccacctggttggaagtcgtaggccgttaggcatcacagccggtgctcttggacacttgcccttcttcctctcagttcccaggttgggagagttaaggggcttggatgtggggatgcagcaactgtaagagcctgagcatcagaaagcgctgttgggagtgggggcaccaggagagagatccgagttagggcagcagagacagctgctcccgcgtcttgtgctggactgggattgccaggcacatctaggagccgtcctccctctacgccattctccctggctccagactcagacgtgccctaaactcttgtgcttctgcttcctttgtaggctgataagaaggacccccaaggcaacggcaccgtggctgggtttgaactactgctccagaaacagctgaagggcaaacaaatgcagaaggaaatgtcagaattcatccgggaaaggtgaagcctgggcccctcccagccctggggcctggcaccagtgttccccggggccccgtggccggggcggggcgacagcacaggactcagtactgcacactcagcattgggctggttagcgccaggcggcaaactcatggcgcctgggatggatctggtcagcagttgtgtacctttggccgatatagtgtttttaaatattgaaagcaacacttaaaaaaatgggtagatttcatattaaaatctggatatttagcacaccttgaaagagcagaagcattggcaggattgcctccacatccctcacgcgacacttggctggagctgagtagcagctactcttgtagagggggtgtgtgttcccattttgccagtctccaccattccgtactgtcttcccccgcagactccttcactcctttacttatgtacctggccatcatttgaagcacagccctttaccgtaaccagtgggggggatgttacagttcaattcatcgttagccaaaacctgtgtcccagggcaggagatgttgaaccctcctcctaccccatccctgcctcaaggattataacagtgttttgtctaaagagcttgggaacacagatgaagaaacaataaattcagcccaatggaaatggagaaatcgacaaagagaaagagaagttccttctctatctccttcctcctctctctctgtctccaagttctgaggctctgttcagcacacactcacatacccacagctgcacatacccacctatcacccatgtgcacacacacacaaacacacaactttccacctggagttggaaatatagcaaattgcaatatctttttaaaatatttcttttttttttttcttttagacagagtctcgctctgtcatccaggctggagtgtagttgcgcagtcttggctcactgcaacctccatctccggggttcaagcgattctcctgtctcagcctctggagtagctgggattacaggcatgtaccaccacgcccagctaatgttttgtatttttagtagaggtggggtttcaccatgttggccaggctggtctcgaactcctgacctcaggtaatctgcccgcctcagcctctcagagtgctgggattagaggcatgagccactgtgccagaccaaaaatatttcctttttaattataacagcaataatcaagtaataatgcttcggcgttttgaagcacccctttcccttagagggcctattttcatatgagatcggatgtgttcagggtggtatgggcatagacagagggcctattttcaatttgtgtaatcaaatccttattttatgacccattaaactggtgggaaacggagaggttgcacagctcgggtttgagaaaacaatggtataaaataggcaaataggaaaattgctgtaaaagccaaagcttgaacacgcttatggtttatatttccatgacaacgtcttgttagcaaataattggaaactgccatttcaggacattccgggcttcctagagaaaacgcatacaccatccaccttgggatctcatagggaaggccctttagtgccaggagaggtgagagctgaggctcagaattgggagctcgcctggcttgaggacaggtgctggctggtttgctgggatcttggtttagagaagtggggcagaggtagaggtgacgcacgctgtcgtcctggaggtgagacacaggaggcagacagcgtatgcacctcgtgtgtctggtgcatgctgtcggcattgaggagccgggagcgtggcatggatagatctactttctagatatctctcttgaccacagtctggaggtgaaggtagggggatggagaggaagtgacagaggcagatcagttggaatgagactcaggaggacctagagaccagttgaaggtggaggtgaggggaaagcagtgcaagaaggaacgagattgtgagtctcctgatgccaagtcatgcaattattattactcggaatgctgccgccagactttgtcagccgccctctctccatcatcgcaccctttgggtgccagctgcttgagcagctgggaagcaaacgctgtggtcccagcatctctggagcttctctgttcaccgtgtggtggaccaggggctctccgaagcctgggctctggccagctctggttggcataagcatagctcttctgtctcccactgtggcccagaggaccacttaggtggtgaacaatacctctgacaacatgcttaacatggacgtgccagataatacaggacactccctggggagttgccttgcaaatgtgtcaaaggcctgcctgccggaagctacatccaaggcaactttcctctccagggaaatagaatctacctgcagccctgggcactgctaggtttccgtggaagtacttgtacccagcaggcttgacaatcagaggcattgggggtgtgagacagtagggagatgttctgttctgctgctgagggtccgaggccacctgggagttctggggctggaagggagaggggacagcactggggattgctggtagtccatcacgagttgcaaacgttcatttcttccttcattcatttattggttcaggggtcttatgtttcccgttctgtgctaggaactgtgtaaacgacagctctcgtcttcacagctctaggagaccggagaaaatgtcctactttgcagatgaggagatggaggtccagacagttttgttcattcatttatccaacaagtatttattaagcacctactgcatgtcaggtagacagacaagagccatgtggtctcagagcttatggtctagtgggttcctttccacggctgaggtgtgcagggcagcagggcagacccacgatctggcactggagagctgatgtgtgttgggttttctctctttgcaggataaagattgaagaagactatgcgaagaacttagctaagctctctcagaactccttggcttcacaggaggaagggtgagtgggtaggagagaggtgggagtggggaggatggggggtcactgaggaagggaaatcagccactatcactgatcactggcatggccccactttggatggggagctctccataggcctggctcaaggtgggcactcatggctcaggtaggtgctcatgacttgggtgggcacccatgactcaaggtgtgggcatccacactcaaaagggcacttccagccgggcgggtggctcacacccattatcccagcactttgggaggccgaggcgggtggatcacaaggtcaggagttcgagaccagcctggcccacatagtgaaaccccatctctactaaaaatacaagaattagccgggcatggtgatgagtgcctgtagtcccagctacttgggaggctgaggcaggagaatggcgtgaacccaggaggtggagcttgcagtgagctgcgatcgggccactgcactccagcctgggcgacagagcgagactccgtctcaaaaaaaaaaaaaggcacttccacattgtcttctctttagtgaccaagagccacgttccagatgttgaagtatgtcagaatcccctctggtctgacccctggtagctgggcagcagcctctagatgcccactccagcctccctttgtctaggggcaggctgggaggaagctgcgtatgagagggtattgtacctggccgctttgtctggagctctctcctgtgggcttgaggcataggctcccttcccgctaatgctgtgactgtccagacctccttgagtgggacctgggctgggagaagcttaacccaaccctcccagccacagaaggactcctagtgggtaaaaaagtctcagcccttatgcacccctgggggaaatggaatatggtacagccgctgtggaaaacaatctggttgttcctcaaaaagctaaacatagaattaccatgtgacccagcaattccattcctaggcttatacccaaaaaaactgagtacaggcactcaaactaatacatgtatacacatgtacacagcagcaatattcataatagccaaaaggtggaaacaacccacattccacccagggatgactggataaacaaatggtggtgtatgcacaatggatacccatggatagacaatggaatattactcagccatgaaaaggaatggaacactaatacatgctactgtgtggatgagcctcgaaaacattctgctaagttacagaagccaggcacaaaaggtctcatagtgtatgattccatttatgtaaaatgcccagaacaggcaaacccatggaaacagaaagtggattgtcatttgccaggggctgggggaggaggggaatgggttgtgactgcttaaaagttaccgggtttccttttggggtgtgtattcatctgcttgggctgccacaagatgtcccagactgggtggctgaaactacagacatttattttctcgtggctctggaggctgggaagtccaagatcaaggtgccagcagggttggtgcctggtaaggactctcccattgggttgcagatggccgccttctgattgtgtgttcatgcagcctttccttggtgtgtgctcagagagagagagagagggagctctgtgatgtctatttttttttttttttttttttttgagacagagtctcgctctgtcgcccagactggagtggcctgatctcagctcactgcaacctccacctcccaagtagctgggactacaggcatgtgccaccatacctggctaattttttgtatttttagtagagacggggtttcaccatgttggtcaggctggtctagaacccctgaactcaagcagtccaccctccttggcctcccaaagtgctggaattgtaggcgtgatccatcgcgcctggccaatgtctatttttataaggacactaatcctatcagatcagggctgcacccttatgacctcatttaaccttaattacttccttaaaggccccattgccaaatgcagccacattgtgggttagggttttaacctaagaattttggcaggacataaacctttagtccatactagcatgacgaaaatgttttggaactagatagaggtggtagttgcactcacaaaacaggcgtttgatttggtctcgtcctaaatgcgcctggatcgatcacttttcaacggttaattttatgttatatgaatttcacctctgtaaaaaaaaacagaaagactctcaggaggttagagttgaaaaggtccccagaggtcctctccgttctgacctccctctggtgctggtctgtttgaattccttctccaagggggagtgaacccccgaggaaggaagacgttctgttgtgggatggttgtggtcgtcagcgagccatgatgttaaaccagtccaaatctgccttcgtggcttgaaatccttcaggagactgagattttgccaacccaaatgtggctttgattaagccctccacatgggttggctgtgcagccaggcggcctcctttgaatggttctcaccctccctgccagccacagaccgcagggcggcccagcaagaccagcgtcccttccacagatgtaaatgaggttagttcattcctggcctccttctgctccatgcacggggcctgagataggggcaggaagggggcacatagaggagcagctcttgctgcctggcaaggggctttcctaagtatccccgtgccctgcaaccactgtgccactccggagtcttccggcttccatctctccagcctgggctgctgccaaggacactgtgtcctggccaacatgcacagcatatgctcctcacccgagcagtccagctccataagtcaggcccacactaccatactgtacacacatgcccggacaaacacagagacaaacacaacgcaagctcacatacatgcatcagggccactgcctcgtaggtgtacacattactctgtgtgtgcatgcacgcacagcagccccatgcacacactcctgcagcaggcactggaacatgaacacatgagccccctacgtacaacgtgcaaagacactgatttacatttacacacagctttggacatttaaccctatctccttgaagactttcaaagcaaagcaggagtctagaaatttggagcagttgaggaagatgctgctcagggaggctggagaggcttttgcaattcaacttctgtgtccaaattagatttcacaggacatgtgcacattggtaaataaacagaattcggttgtttattctgcctttagtttttctctcctatgtggaaaggaaatgcgattttggttttcctagttggcagtcatgaaaacaacatgcattttgatttggcgtacctgaaactgtatgttggaacagagatgcacctcaggttttgttttgtttttcattaaccgtttatcagatgaaaaatctcttttcaaatgagagaatttgtaagtagctttttaataaatggtgatgtgactccaaagagcctggaatattggagagcagggaggcattcaccaaggatgcactggctcagaggggcccctctgaatgtctggagacatgtcttcccacttagcagtgtctggcctggaggtagagctgaggacgttgtgttgggtgggggaaaaccatggttcttcctttcatcccagttgcccagagatgacattctcaggccaccacgactgtccctgggccatttacctgccatgtgctctgctgacagtagactgacagctctgtggaaagatgcatgtgctcatacaaagtctgggcaccgcctggggcctttttggctctgtgactcttgttcatacctcccacaggctgctgtgtgtggctcagctgcaggggcaaacccctctcacttccctttaatccagttcccattcctcccaggacaaccttggtatgcttcaaatagtgttggctttcaccctagagctaggaggcatcttgagataatttgtgtgtatggtgtgaggtagggccgagattccttttcctcctgtggatgtacggttgtctctgcaccatttgttaaaaagatcatctgtttcccccatggaaacaccctaacctctttgctgcagtcaatcggccctagctgggtgactttgtgttctgttccgctgatctgtgtaactgccaggactactcctgccacccctggacctcctacccacctgttgaatcaggtggggcacccaagccacccagagggggtggagtgccccagtacagcttcctggatctcaggcccttcaggcagagacaattgtcaacagcttggattgccccgtttcatactccagtgcttctctggtggcttcccctgccaggatcactgaggggacctttctttgctgctagactcctagataaaatcaggcagtcatttcccataaacacccacctcggcctgagcctgcgccaccaccacacagggctggccagccatcagagggatctgctgtgcactgttgggcaattcttcgctgctggctgctctgctccagacccagaagcctcaccacatgctgtcttttattcagcttttgccactcgactttaatgaattctctgggggaagtggcttttggatgatattaagtcaacagaacattcagcctggatttactggctgtgttgaagaggctgggagcaagaaagcgggggtatcacttggaagggtcatgcggttaaagagctccaaatcatagagaatgtagcctggggcctgcattggcaagtcttagggacttcaggagatttcttctacgtgaagcctctccttggagtggagaagtgatgctgctaagaggacttggcccttctctagtaagctgtgggcagcatcagggctcacagctagagaagcagtgctagaggagaccgtgcttcctaggatggccgtgggagccttctctgccctgtggctgcatctaggtcactagacccacacagtccatcttccccactcctggaagccaaggagctgggtttttcctataagcagcgctgtgtgatacctgctgtttgaaaagagcttctccggctgggcatggtggcttatgcctgtaatcccagtactttgggaggccgaggtaacccctccctgcagctgctctcagttggtcaggagttcgagaccggcctggccaacatggcaaaaccccgtctctactaaaaatataaaaattagccggatgtggtggcacacgcctgtaatcccagctactcgggaggctgagacaggagaatcgcttgaacccaggaggcagaggttgccatgagccaagatcgcgccattgtactccagcctaggcgacagagcaagactgtctcaaggaacaaactaataaacaaatgaaaagagcttctccctggaatagaacctgttttccttccttgatttattagcagatgcttgcacccctcatcagcaaaccagggaggggtgatgtgaaagctctggggacagtgacggcccaggggtcaaggccctcactgcagctgaggctttggaatgtccccacacctgcttccggcaccttcctgggtcctttcgagcctctggatttctaggaatccccaccccccccacctcttggctgtgcgccacagtctgtttccttagctccagaggtaaggtgagctcacttggaccttggtggctcatctgactctgtgagttgaaacgtgatgctcatgtctggtttctgcctgacttctgcctcatccgcgtccacattctcagctgtcatatacctccccgagacctggggtggagccccaccatcctgcctcaggaagggctttggcttgtgacctgagtctcatggtctttgtgttgcagctccttgggagaggcgtgggcccaggtgaagaagagcctggcggacgaagcagaagttcacctcaagttctctgccaaggtaacccctccctgcagccaccctcagttggtcttacacactggggtactaaaaaatagttaacaactgtctctccagtttgccgtttgccattttccctggtgtaaacttcaggctatcaacatgaagtcacggaatacggagttgggaagagatatctgcccagtggctcaccatgaggtggtgcatttttgtatagacacagtagcacaaataaccatcaatatccaccaagagcatggaaaatagtaaagtgtagttaggaggtggtaagtgctaggtatttattgcctttgttttttatgttttgttatttttaaaaagacaaggtctcactgtgttgcccaggctggagtgcagtgacatgatcatagctcactgcagcctcagcctcctgggctcaaacgattctcccacctcagcctcccaagtagctgggacaacaggtgtatgcaaccatgcctgggtaatttttttatttatttgtagagatggggtctcgctattttccccaggctggtcttgaacctcctggcttcaagcagtcttcctgcctctacctcccaaaatgctgggatcacagacatgagccactatacctggcctattaccttcgtttttaatataatttttattcaattataagttcatatcatttcctttttgataatggccgtgtttaacaaccagcaaacagaattcctgaaaatttaacattcagctcttgggagccactgggagcaggccttagcacacctgcccagtttctcagggcagcccctgagtgacgaagccctgctttctttttgcctggctttcaaagggatggagtaggatgtcctgtctcttcctagtgtcagggaacattaggttatgccaaagggagaattttttttaaatttgtggttgttgcaaaatttcagaacaagtaaagggtccttctttatttatttattcatttatttattgattgatttattgatttattgattttgagacagagtcttgctttgtcgcccaggctggagtgcagtggtgcgatctcagctcactgcaagctccgcctcccgggttcaagtgattctcctgcctcagcctcccgagtagctgggactacaggcgcctgccaccacacccagctaattttttgtatttttagtagagatggggtttcaccgtgttggccaggctggtgttgaactcctcacctcatgatccaccctcctccgcctcccaaagtgctaggattataggcgtgagccaccactcccgaccataaagcatccctctttcatttaattctgaagatactagtgccaggactcgagggcagggtgtttctgtcctattcccatcctcagggctcaggatggtgtcttgcatgtagtagatgcttaataaatattttcttattgagtcatgaatgaacagagccctctgactatctccaccccacccccagtcttttcaggtctgctttctctcaagatttctccatgtttccaagtgactctcccttccccactccctggcacatacctccaggttttctctccgactctcagctaatttttagatgaaaaataaactaaatctctcagtgaagtaatccactctaaagtgtacatgattggtggggctacccattaacaggcttgccttttaaagaaaggggccaggcgtggtggctcacgcctgtaatcccagcactttgagaggctgaggtgggtggatcatgagatcatgagatcgagaccatcctggccaacatggtgaaaccccatctctactaaaaatacaaaaattagctgggcttggtggcgcatgcctgtagtcccagctactcgggaggctgaagcaggagaatctcttgaaccctggaggcagaagttgcagtgagccgagttcacgccactgcactccagcctggcaacagagtgagactctgtctcaaaaaaaaaaaaaaaaaaagcgggggggacctttcagagtgcaccatcccagtgaccctggcctcctcgctcttccctctgtcctcccaccatcactagtcagacacagcagggtaaagtgcctaaacgctgagtctcccttctttaaacacgtgcttgatcatttgaaggtagcatccctcagagatggtcgctccttcctgggacttccacgttcagcactcactggtcctgtctctttcctagtgtcgttcctactgcaattgcaagtccctgctttgggatcccatacgatgtaccccgtggtggtactcggcacacagaaggcagaatgaatgactcagatgactgagacacgtgaaaggactttctaaagagctgggttggaagagggaacagagctgctacagctccccatggcttagtgtgccccaagattgagttgacacccagatgtgagtgagaattcccagccagtgaaggcatgctaactaacctcattacaccaagcgcttcagtagaaaattgctactcaagtcctggcagagaagggaactccgtgaatggatctttttcctgcattgcatccaaaacagcaagttatttttcagctgcagatcatgagtagctttcccctcaaggcctcccttcccctgtcggggcccccagcagctccattctctgctgtggtagaaacttccattgactgggaagatcctgggcgggctgccattgtgatggggtggggctgggagccagagttgcgagctttggaaaggtcacctgctgggtccccgggaatcttggtggcatttactccccatcagcaggacccctgattcttgattgtttagagtgctcaacaggtggcaaaactctctccgacgtggtagtggtgacataagtggtgtggatggctgtgtgcaggatataactcattgccgtcaaccaccacgcgagatagcatacacatttcacagtgagaagaggtggggtgagatcacagcccatggtcacacagccaggtgggttcagtcacagaggaagcaaaggaaaggactgagcgaatgggagacttggtccccagagcttttcttccagcagctcccctgctttggcagaccaatggcattgaaaacacagcctcttcttgagcctgtgcctttccaggggttgccaatgggctactgcagactggccctggacaaccacatgctcagaacattttaagttagtgttcaggacacagggtggacctcaccattcagttgacaggaagctcatgaagacccgtcatgcaaaacagactttgctacgagaggctctcggctgcttccagcctgtcggtcagtgttggtggcctcaagcggtcatcgcagcagcctagtggttttatggcgattccttgagaagaaagtggctccaaggatgtatttgactgccatgaataatatagctccatatgccaaaaaccgtttttaatgtctgctccaaaagacttattgaaattctgctctgaatgctctgtgtcaggggtaaaagctctttaagaaatgcaattttgttgcagcaatttttgtggtttttctggtccattagctcaagccattgctaatagcaacagattgctaaagaaatgagagagccgtatacaaagaaagttatacctggctcctgctgaagaagggagaagagcagaattccttctgctgatagaaaatctcatgcggtagaggctctgcgttccatcagaagatttaggggacaggagtgaggagacatgagttgtatctcagtattgtcactaacaagctctgtgaccttgagcaagtcacttagctcccctggggtttcatttcttcacatatgaaatgaagaattcagaccagatcagtctctttacacttatctgacagtgacttacaatgatgcattttatgtgagcattcagaacctgtctgtaggtatccactccgatatctgcacacagacattcacacacatctgtagctgaaacaaacgtttcataaaacagtatttatcctcctacttaaaatgtactctggtattttctgttcaagtctggtctgttctcaccaaaaagctggtcctggcccattaaatcgatttcacaactctcggccgcacaccgtctgaaaaatatcagactagacagtgtctgaaattcctaccaacttggaacttctcttattctcttctgatgtgtgagatgaaaaggaagcaaagagagcgagagttttggaaagaaaaactgatgggccatgacaggccggcctgagtctgtgaggacactttgaggaaggacttctgattcctggttcaacagagatgcttaaaagttaagaatgggtactaaagataccagcctaaccattttaaaggaaaaaaaaaactgtcttttaaaagtacttaatatcgccgggcacagtggctcacacctgtaatcccagcactttgggaggccgaggcgggcggatcatgaggtcaggagatcaagaccatcctggctaacatggtgaaaccccgtctctactaaaaatacaaaaaaaaattagccaggtttggtggcgggtgcctgtaatcccagctacttgggaggctgaggcaggagaacggcttgaacctgggaggtggagcttgcagtgagccaagattgcgccattgcactccagcctgggagacagagtgagactccgtctcaaaaaaataaataaataaataaaatacttgatgtctgtagcgagatggagatgccaggcatcctcatctgtggaatcaaatcacttgtgatagttagcagcgtcacgcttccagaatgtcatttgaatttggggaaagcttcctggcatattggcaggttcatgggcttttccccagaccacagaacctggggctggggtccaggaaaccttaatgttgaaaactcttcaggtcattcctgggcgtattaaagcctgaaagtcacttgctttccatgtccttagagaccccggagtttctgagtcagcaggctgagctaactctcccagattcccggagtcgtacagctgctcctactcagcaaatgccaaacctatatacgtgggaaaggggtttatttattctcgtaagctctcaagatttttgtagcatcctgcaaactgccgccaggtggggatgttttcctatacagggaaggttccaggggctcaaaaaaaatagtaggacatatttacaactaacacgaggaggagagaggggtgtttggatggccagttctctgttagtctgtgacggtcatccagcgacaaagctgtcttcttgtcacccaggggattgagctctgaagagtttgtcattctctctacaaacacagaaggggcacccacccagccccagcccaggtcagacactgggcacagcagtgctcaacccagatggggcccctgcccgcttggagctcccagccccgtgtaagtcagttgcttagaatagggacacctaagtcctggttgtatccagagaaaaagatattgtacagcaaaaacctgagggagaggagagaagtcacagaaccctcgttgggatatcatctgtccagggaagttgagctgtgctccctagagacacctctaagaccggtggaggcagatttgcggtggtggggtggtcataggttgaagagagttgcctgattccaggcagtggggtgggaggggtgcacagggctagggtgccacctggctttgaccacagcaggtcccgttgatctgttttcttataaatgttatgggctgggcacggtggctcacgcctgtaatcccagcactttgggaggccgaggcgggcggatcacgaggtcaggagatcgagaccatcctgactaacacggtgaaaccccatctctactaaaaatacaaaaaaaaaaaaaaaattagccgggcgtggtggcaggtgcctgtagtcccagctactcgggaggctgagacaggagaatggcgtgaacctggaaggcgaggcttgcagtgagccgagatcgcgtcgctgcactccagcctgggcgacagagcgagactctgtctcaaaaaaataaataaataaataaaaaataaataaatgttatgctcacaaacaaaaggaacaaattttaaggaaaagttcttttaaaggggggtgggatgggaaagagggaaggaataaaagagaagaaaaaagcttaaaaccctgatgccacccagctcttctgacagcataaacccttttctctggcccctgggatacagggcggttccctttgcctgtgctccaggcagcccagcaagctgagaatgtctttatgagcgcaatgcgggacagttgcccttgtgagtttccagcaggtctccaacagttcccaccatcagttcctcgaggtttggaccctgtctagctcacctttgtattctcagcacctgccatggagtagatgttcgataaataggactgacctgagaccttctaattgaatggcattcattcgactgttctttactgaagccgcgtaccccagtcactgtgctgagtgcttggagacacagacgctgatgtggtttctgtccccagaaagctctcagttcggaaaataagggagagagacataagaacaaagccgtgcaagaagctgtgggataaaataagtgtgtgaggtcattgattattattgttttttgtttgtttgttttgttttttttttttgagaccaagtctcactctgtcacccaggctgaagtgcagtggcacaatctcggctcactgcaacctcccaggttcaagtgatttcctgcctcagcctcctgagtagctgggattacaggcacctgccaccactcccagctaatttgtgtgtgtgtgtgtgtgtgtgtgtgtgtgtgtgtgtgtgtgtgtgtgtatgtagtagagatggggtttcaccatgttggccaggctggtctcgaactcctgacctcaggtgatcaacctgccttggcctcccaaagtgctgggattacaggcatgagccaccgtgcccagcccattgattattaacttgatttagccattccacaatatatacatatttcaaaacagcatattataaaccataaatagtaaaaaattctaaaaatttaaaagctgcagaagctcagaaaaaaagtagttaacagatggggaaatcagaaggctctagttgctaaccacttatcctgtagacgtgtgtgggggcctcctgagctaaggtgacctgcctaagctgagacctgataggcagccacgtgtcagggggtgtctctcaccttcctgccaggtcgctaccccagactcatcctcacttgcctggggaagtgggggtgcccctcccatccctcctccctgcactggcttacagctgatgccctgggtcctgagtgtgcgtctctactctcccaacagcttcacagcgaggtggagaagcccctgatgaacttccgtgagaacttcaagaaagacatgaagaagtgcgaccaccacattgccgaccttcgcaagcagctcgccagccgctatgcctcggtggagaaggtgagaggcccaggacgctgggccagggcaggtgcatgggggactgcctggaagaagggggactgggaagccagcagtggctccatacgccaaggctgagtctttgtccccaggtaggggaatagggggatgtccaagcctcgtgcctacgccagagcaccccacccatccaagggcagataggagctgcctccctgtggtgctggaatgaccacccagagggccaggggtgcgaggagaggctgcagctgcagtgggcagtcgagtggctgttggcgaccagttaaaccccgagcctagcagtgctgctgctggttcacgtggggccccgtgtttaagcctcacctggctgagtcgtcctgactcagtcaccgcctccctgctctccttcctgctcagggatgaggctgagtcctgggtggtctcacctccagggaactgatgttcagccttagagggaagagagtgtgccccagggactgattcccagtccccagtgccttagagaggagaagggggctcaaactgctgggacaccctgggcccagccaactgccgccacccaaggaccacagagatgccagtggtggcctggaggaaaggcagtacagtgaggggaacaagagggccgaggcttgtccagctccagaacgggagggctgttgctacatcctattaagtgctgcagggaggtgacacagatggcctttgtggtcccttccaagcagaggggctgtgactttaggactgcctaggtccccagtctttgtacaggctccatcgggaaaaaaacgtggtttgagagattgaggtaggctgagtccagatgtcactggaagaggcaaggacgaaaagagttgggttgtagcctctacctagctgggtggtgccactctggctgctgggcctctctggaccactgtggcatcatccacacaaacaaggggcgaaaggactccaaagggaagctgggctgcgtggcccaggaggcccactggctccgagctgtatgagcagcttctccgtgtccttggaccccaggcccggaaagccctcacagagcggcagagagacctggagatgaagacccagcagctggagatcaagctgagcaacaagacagaggaggacatcaagaaggcgcggagaaagtccacacaggctggtaagtgctgggcacccgcctggcctggtcagtgcacacagaaggagagggcacggggctaggagatgaggtgactggcgagggtgcatctctcctttgcaagactgcagcgaggaaattacttcccttgtttgccaggaggtaccccctcttcccttctctctgacccacacccagagatctcaaagaaagagactttgggggtcagaggaaggacacaggccgggctagttctggggcatggtagaggctggactccttactctctccctggtcgtggctttttttgttttccgcccaagccccagatctctgaccaggaggtggacaaactccttcatgcactgagagctcagggccctgtccctgttcagagcccacagaagcacacagctcacccaagctgcccacttccccaggaagcaatgctctctctgaaggttcacctatggggatgggctcctgccctgggaacagaggctgacactttgtttaaagaaataaccagatttcagtctcttgggaatagtctcccaatgagttggtttctgcttccacctagtggtcaaagttagctaatacacaaagaggaagagaaggcctggtagaaccagtgaaaacctcggtaactagatctaagggaagccacgtttcactgcacgagaggacacgcatgttgcctctggaattagaatgtgtgccgtagtattagagtttggtctgtaggtccctttcacctcaatttctggtgaacctgttacaattccttcattatagaagaaagcagccaccttacatttcaaaataaggtaagatagaaataagtcaataaaaaataatgtaatagaaggataacgtttattatacaaatcttataatgcacaataataaattacaggatcaagaagtagagggcacagtatatttattggtagagagaagggggggcacagaaggggaagagatctgtttaaattattaagttattaaaaaaataacttataggccaggtgcagtggctaacacctgtaatccggcagtctgagaggctgaggcaggaggatcagttgagcccaggagttcgagaccagcctgggcaacatagtacctcatctctacaaaaaaatttgaaaaaattagctaggcatggtggtgcatgcctgtagaatcagctactcaggaggctaaggtggaggatggcttgaacccaggaggttaaggctgcggtgaactatgatcacaccattgcattccagcctgggtgacagagagagactctacctcaaaaaacaattatattgcaaaaacagtattggtacatggcaaaatattttaatcagcagacaagaatataaaatgctattcacagaaataatcaccatctcttcctagtgttttgatttttaaatatttaaatttatatacatttgatcatacaatctatcttctgaacttatttaatatatcttggaaatacctctttttcatttctgtaaatctttttgcccatccattcatgcatatcaaactttttaatggctggccagtgtccagttgtatgattgtacccaaatttgtttcatcattcccttaactgaggtttaggactcttagattgtttcagagtgcttgccagccagtgaagctgtgttattgtacctgcatctttgtgtgtgcctaagaccagatctgcatatagagagaatatagttgctgagtcaaagggtattattcgtcttgatggatatttccaaattgctttccagagagagcacctatcaacagcatctatgaataatgcctgttctctaaatgcttatcaacattgtgtgttatcaagatttgaaattggtagtgagtggggaaaaatgatattttgtttttaatttgcttttctccataacccaggttgagtatgtaaaatatacatataaatcattgttgtactttctgtgaactgattaactcatatcctttccccactgaccatagattctttatctatcagggagatgaatcgtttttcattttaattgcagatatttttcctagattgtcatttgtcttttagttttgttctttgtaattttttttttttgcttgtttgtctattttttcttgctgtttttctgtacagtgatatttcccataagaagcctagatttcggagctgatttagatctttttttttaatcacctagagggttttttcttactttttttttttgtttcaggtgtttatttttgtttttgtttttaaaatagtgaaggccggccgtggtggctcacgcctgtaatcccagcactttgggaggcccaggcgggcagatcacgaggtcaggagttcaagaccagcctggccaacatagtgaaacctcgtctctactaaaaatacaaaacttagctgggtgtggtggtgtgtgcctgtaatccaagctacttgggaggccaaagcaggagaatcgcttgaacccagaaggcagaggttgcagtgagctgagatcgcagcactgcactccagcctgggcaagagagtgagactctgtctcaaaaaacaaaacaaacaaacaaacaaaaaaagacagtgaaatatgtaacccaccagacatttatttttccttacactggtggtctaaccatattccacaggttcttatttgtggtggttttatttctgctattttcattatgttttgctatttgggttttcatttgatcttcgaaccaagaattgtttcaaagaaaatctttatatgtttacaagcaagggctttgttgttgttttctaatcttgctatttttttttacatagttttattgcattgtcatcagataatacggtctctcattcctgtagtttggaattattttgtgacgaaagtgacagtccttagacctaactctgaaaaataccgcctcttctgagcactcgctgtggccagcctccatgctttagagcattgtctcttttgatcagcacagtccccctgcagggaggtatttttataccctttacaaatgagaagactgatggcagagaaaatgagaaccttccatgaggtccacagtggtggagcggcgaagccacaattcagtctcctctcattccagagactctgcttgtcgccattttgctggacagcctgttgctcaggaaatgccacctgttctttccttctgttcctttcctccctcttcctcatcttttccaaggctactagaaggaaagacatcagatcctcagggatcatcatcatcatcatcatcatcatcatcatcttcatcaccaccatagcccatattaatatttggctctctacgcccatctctattctaagtgctttacatattttgacatatttattcctcataacaacttggtaaaggtacaatcgttatctccattttacagatgaagacacggaggcaagcgcaggataaccgacttgtctacgattacatagctaataagtagttgagctgggatgacaacaaaggctttttttttttttttttgagatggagtcttgctctgtcgcccaggctggagtgcagtggtgcgatctctgctcactgcaagctccgcctccctggttcatgccattctcctgcctcagcctcccgagtagctgggactacaggcgcctgccaccacgcctggctaattttttatatttttagtagagacggggtttcaccgtgttagccaggatggtctcgatgtcctgacctcgtgatccacccgcctcggcctcccaaagtgctgggattacaggcgtgaggcaccgcgcctggccaacaaaggcattcttgtcccacaatccatggtcttaaccaatactgttctaaaaagttccaatttcaagctcttgggctgccatagagagaaggtacagcccccttcacctactctgtttcccaatgctgtggaagttcctgaagcaatttctcaaaatcagcattgacacacagggctcagggagtttcacagtgtacagagcagcacgccgccctcctcctcggccaggcaggagctcttgctagaaatgcatttgcatttcggaggctgaggcgggcggatcacaaggtcaggagttcgagactagcctggccgatatggtgaaaccccatctctactaaaaatacaaaaactagccaggggtggtggcgcatgcctgtggtaccagctactcgggaggctgaggcagaagaatcacttgaacccgggaggtggaggttgcagtgagccgagattgcgccactgcactccagcctgggtgacagagccagactccgtctcaaaaaaaaaaaaaaaaagaaaaaaatgcattttacggtgcagcatccactttcttctctccggttcagtgcctcttgggatcaagggtccagtcattggccttggaccaagaacaaaatgaataaatgccttggtgtgggctctgttattcaaggcacactcgcgtctggtgtgtggcatagctaggggtatggttcgcagctaggcctggggcctggagacataaccttccctgttctctttgactttcctatcagagtacctatgagccacaatgatgatactataggagtcactttgactctactcgaattactaaattctactctagcattctgcttctagaattactagagaaaattacttcactttggggttcactcatgagctttttccatcgtgagcaaacaccatgatgccttcctcttgctggagccctgtgaggatgaggaagctacgctgagacaaagccgtgcatgagagctgtgctgctctgcctgccacgtgcacacacattaccagagcgtctcataaacatgcagtctctgattcagtaggtctcggatctgtcctgggtttctgaatttctagccgaccccagggcatacaagtgccactggcccacagactgtgatttgtgtagcaaggttccaaggtgctggtacgcttagtaatgtttgcaattacttcgcagtgtgttttctttctaattacaaaatgttctaaacatacatatgataacaaagtaatagagtagtcctaaagattgaatagttatgtttgcctcggatctttctgtgatgacataaaatgcaatagaaggagctgattcctgcccactcaccctttctctgtttcccaaggtagccactctcctgaagctggggtgtgctcctccagtgcatgttttagactgtgactacagatgcgttcttttgtgtttcagaaggacatcttgcagtgtgttcatgcacacacacacacacacacacttacatgatctgcaaatttatcttccttaattattcttagcaccaaattgtgtgtgacatgttttaaccaatctggactccccagtgtaaaataaaactgccatctttagagagggaagcatttcttgggctcatgataggattgggggtcctaggaataccctagacacacacacacacacacacacacacacacacacacacacacacaaaatgagaaccaccatcctgaatccttggtatctggggtcaggcttcagggggacacctgagctgggttctcatggggctgggttgcccccttccttccctggctctgctttcttcttcttcctactgccatcccttttccagctttccagcggccaccatgaccccagggggaggagaaggcttggctgtggggctcagggtggggcacagagtcatggtgaggataggatgcttcatgatggtgactgtggtctttttccaggagacgacctcatgcgctgtgtggatctctacaaccaggcccagtccaaatggtttgaagagatggtgaccaccacattggtaagcgggcagggatgtgtggacatggcagtacagaggctgacacagagcagcccctggtggttgttggtgggcgcggggatgatggggtggagtgaccctggagatggtcatcaaatctacttcagtgttggggtcgaaacctcaatgtgagccagcttatgtggattcagatctctgctccagcgcttcctagctgtgtggatgtgggcagggttgggttggatatggctacatccttcttgggctgtcccctgagaggtcagggtcaactgaggactctcctcaactaagtggacaagggcctctttaggaaaaatagccaagctataggaagagaggaccgccccacacatgcacacacacgagttgcaggtccttggtaggagatccttgcaaagtggatggatgggtgaggatggagctaggcagtggggtggggggaggcctctcaccaagggtgaacaacaggcggcagggccgatgatgctcttgagtatttcttgtaaaggggcagcatctccttatcagtcagcacctgcctgagtggacagtgaagtgtggctggtacttgggccagatgggacaggaggcatcatgccaggtgctcatcggatcagcccactgcctaaagccacccctgtccatccagcacaggactaaccagctgccttccccaggtgtcagcccaccagagcagattagaggcctccaccagggacagtgacctagttttcctcctggttaatctcctaattaagccccctgctttacccccctttctgattaatcacctgggcagtgacctagttgtatgcagagtaacagccggatcccctagattccaaagacacaaaaccatctagaaaccagaggacaaaccctttccacgctcccctttgacaaaagctgtgccacgtgcagcccagtctgcctccctggcccggtctctattgcggccacagcactaggcataggcagaggaagggaggctgctcagcagaggcccagggacaaggtcccaggaatgtgtggcatggagctcccacatgtgcccccttgttataccccatcagggcaccagggccagggctgcatgggtgcattgccatgagtaacagcctgatggactctggtttaaatcctgttcctcccataattccgtgtcgctttgggtgagctgtgttgttgcctctctaggtgttagttccccagttcccttgcttggagaatggggataataacagaaacgatctcttaaaattgtaacgaggacagttaaggaacgcacgtaaagccctcagcactgtgcgtggcggagcaggcttttcaggaagtaaaacagccgctgctgctgtcatcagcttcaccttcaccttagatatggggcacgctcttcatcagaccccagagagtcagatgggacagaatgtccacagccagtgacttgcgttttgtggtcttggtggggggacccccaagtggaggggacgtgctcagagttctctggcctttgctttctcggcaggagctagagcggctggaggtggagagggtagagatgatccggcagcacctgtgccagtacacgcagctgcggcatgaaacagacatgttcaaccaaagcgtgagtttccagcccagcggggctcccgggcgacacggggcctggggagagccgcctggcgctaggccatggcaggttaagtggctgctgcaagtgaatctgccctaaaggcgggcagtgggcaggtgctctggcctgggggtggcctcgtggactgggcctctcaggattgtcctggacgtctgtgtgattcccaccctggcacatgaagtggacacacacgtgagctgttaccctgaggagaaagaagctcgtaacagttacagtagctgaagacattattaaatttcttaaaaaacaaaaccaaaaaaaacaacttctagaaatattcacaatacctaaagctcaagttttatttgtcctgttcactggtggtaaatgtggggtggaagggatagagacaggttttaaggccctcctggcctctcatccaggcctggggtctgcagggtgagaagcagggtcgggatgcatactgggttccccgttcacagccctcttcatgtgctgtccctcagatgggcctccccctggggccccggagccctctagagaggctgctctcagagacactaaggtgaggacagcatgtctcagaggagacctccctggcttggccgccgtctctaacagtgtcgcattttctctgtctcttgcagacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaagaaaaaaaaaattccttaagccaaatggtgttccaagttggttgctgtgacaacctccaggaagagccacttgttaccctctattctttctagtgctttcagtcagtggcaacacataggccccttggaccgtggggatggcggccctgagattctgtcagtgggaccaccctgggcctcctttctacctccactcagcaccctgttggccaaggagaatttctgcggtgggaggcagtgctctgctagtcaggattgataaacagctgggcacaccgaaacagtgtaccaacgaattcaccaaccaggggtttctttccctaccctttgtgaaaaccaatcaattactagatgagtggatggatgcagaaaaatctgggctgagccaaagtcccttttggaaatacaagccataacattcgaaggacatcagcgaccttggcttgtttaggtgattttacttccagctgcaggtagtcttgacaaggagtgtttaaacagaaggctcaagatgcattccttgtgtaggtcggagagagcacttctaatgttaagtggggtacagatcagctgcccccccacgtagcctggacatcgtcttatccccataatccttgccatccctacaaggcccatcgccaccaccttttcccaggtttattgaggtatgattgacatccagtaaaattcaccctttggaaatatacagctctgtgaattttgacaaatttagtgtcttgtgaccatcaccaagatcaacctgtttttaaccctccaaaaaattcccttctcctgccctctttccctggcaaccctgattgattatctgatcctataattttgccttttctagaatgtcatataaatggagtcacactgatgtcgccttttgagtctggcatctttccctcagcttaatgcttttgagtcattcatgatgtgtgcgtgtggtttgttccttctccttgccgggaagtatttcattgcatgggcgtactactctgcttctttatttttacactgagcctttcgccctggaagttcttggcccagggtcttcaacttgtttgcacgaccacttccagcttgctgcttccttcagttccccaggctcctcctccaaatgccagctgtgcccacaagctgttcttagggctcacactcgccttttggcgcgtggtgggtttttggtagtgcagaaagaatccagggatgggaggggaagggacggatgggtgctcaattgctgctcacgtctgctgcaacctgaagcttgcatctcagccagcagatctgctcccttctgggacccaggcttcagtgtcacacggtccttggctatgtattgggcgttggaggctttgaaaggcgagcagaagcagcatggacaagaaggctggggctggccctggggctcatcatgatgctttcctggatctgttgcttcatctgcaagctgagggtgtttgttctagatgagtgtctcaggccaccggcaactgcatgtacctcctccctttctcatttccaatgatgtaccctgtacacgtgttcatgctgtgtctggctctcatctgcacagtcgtgcatagaattgcctcaagtcctggtgagagagatgccgtggtacttttccatttagattcaaatggagctaaaattaagagttttatgagctgttaagaatgaggtagtttctcctaggaccccccaaagacagtgcaagtaatgaccgtttggatctcattcgccgatctttgatagtatgttctggagtctactccccaggagccaggacaggcgtgaagatggagtccttgtcgcagctggagccttgcctagctggtgatcacacagcctggcctgtacctgcaccccactggatggtggtacatggtggcagggacaggaccacacccagttaaggccagaccaggctgagtgtgacccctgaggtaaacactccactaagctgtgtcttgttcatgccccctgctcagtgaaaggtgagtcccgagaccagttgggtacctctctatgcgaaccagagacatttctggatccaggccaggtgaagattagggccaggaagcctgagcccccggggcctcaaggtagggagccgaagaggctgccaggactctgctgggttgaaatttgccggggaggactcttgtctccccctcaggagtatttttgttgaggctttcctggaggtgaagaagcaattcccattgcagcaggttagagcgagaatcagacagagggcaaaaaccaattcgcttctccccacgttctaaatgctggggcatggctgtcaggagggcttcctgggaggtgtctctgggggtggggtgaggttggggcgatggcctttggagattgcgtgtggtgttcaggactgttccttggtgtttgagggaaactttagtgggattgcagtggaatgtaaggtcagggcacgtgggtgctctctcggggtggggtgactgggagacctagagggaaagcctgctatgcagggggagagcacaggactggccctgctctgcggcctcctttgtcccataacctgaagttaagtcacatcccctgtcgggacctccgtgcactcatctgtcaagtgggggcgcttcccttccagcatcacctgcagcagacgggctctcgggagtcgtgggttccaggcagctgtgtggacccagggacagacattcaaagggacgccagccatccttagtgacaggggccccaacttagcatcccttcccttccgttaggaaggagatgaccggaagcaaccccttcacagacacgagcacatcggcaaaccctatgaaagtggaattttctaacaaaataaacttgcttgtttgatctgttttctgtaacttttgctaaatactttatacatttttcatgttaaagagccgtgtctcccgccagcactcctcaccccggtatgaatgtgtttcctccacattgtatatccttccaccctctggctgcctagatcagtaaataaaattgatgtaatataatttataagtaacactgttgaaaccctgatcccagtggaggctgtaacccacctgcccccgcaccacccccctgacccctgttaccgcatttgtgtgtattaatgctgaagaattaaatgtttaaagagtttaaattttgaaggcgtttgctatatacagttgtcctgcattattataaagagttttcaggaagttaaatcccatctcgttttttttttcttctgctctgtgtgtatcctcgagatgcctagattcatcccatgtaaaataaactgtccagagacactaggtccccctaggcgaccctctttcctggagggctgccacattcttcatgtgacctgtcttggcatccctcctaggctctcgagattggtggtgatttcacctccgatgacttagcgggagacaaagggcatctggacactggcacccaaatggatgctatgctcctggcctcaggcccctccccctggtgacttcctgtctctgtgggttccagccctttgcctccctctcatctctggagctcctggctgtttcttttctcatccatccatccatccgttcatttatatatatatatatagagagagagagagagagagtctcgctctgtcgcccaggctggagtgcagtggcacagtctcagctcactgcaacgtctacctcccaggttcaagcgattctcctgtgtcagcctcccgagtagctgggactacaggcacgccccacctcaactggctaatttttgtatttttagtagagacagggttttgccacgttggccaggctggtctcgaacttctgaccttaggtgatccgtcctcttcggcctcccaaagtgttgggattacaggcatgagtcactacgcccggtcccatccatctattcattcaataattactgagcatctggtatatgccagacactgctctaggttctgggaacacatcagtgtgagaaacagagccctgctctcaggtagcttacattctagcagacaaaaacagtagacctactatgttctgtgatgtgggtgtggatggtgttaagtgttgtggaaaagaaaaccaggacagggtacgttgcaggattcaatagggtcatttgagtggcctcattgagaaggtggtatttgatcaaagacaaggagacctgggagggaccctggaaggtcaccagaggagagtgttccaagcggaagagatgctcgcgtgtctgaggccagcctggctggagtggagggagtgaggagggaagagaagatgaggacgctgggcaaccctctttcctggagggctgtcacattctttgaacgacccgtctcagcgtttcccccaggttcttgggattggtggtgattttacctctgatgacttagcagagagacaaaaggcatccgccccctttcatccgttcttggaggtgccagaggccacttgcgagaaatggtgggatgagggccagtgctgcctgctgcaggcttttggcttggactgggagaagtgggcagccatagtgcatgacctgatttcatggccatggggctcactgtggggctgtaaggggacaagagcagaagcaggaagagctgttaggaggcagcggtgatgctgcctgcacaaggcaggtgcaagggaggcgggaagaacggtctggttctggatgtaccttgaaggtagagtcaagatgatttcttgatagattggagtgggttgtgaccgaaagagaaacactgagaatgatgccaaggacctcaatccaagtcatcaaaaggatggattgtcattttctgcaatggggacagctgtgggaggagggtccttccccattctctgtctcccccgccaccttctccatacccccttttccctctcaatgcggacttctctgcaggtgctggctccaggccagagggcaggagggtcgtcttggccttcagctcatagcaggcaaggtcgagcaatggggaaggggtggcgtctgggtcccagctaatggccaagatggagctcctgcttgaggggacagggccagcttctgggaagcatctttcagtccagcgaggagagcgagaccaaaactgggatcctctgcctggagatgaagccttctcctctagagcagtctttgggttttgggagagtttatggccccagctcagacttaacaaatcgactcacaatacatc

SEQ ID NO: 12538 - DNA, 21000 bp, Human
aactaggaattacatggtaagttgaaagaggaagttaggggtaagatgctgcaccaaatgcaggagattggaaggtttttctggaagaagtgatgtttagggggagtttcagaggtaaatttctggtttggttaacagaagatagtttcactgctcactgagattacagaagaaacaggctggaagagtttggtttcaatatgtcaaatttgatgtgcttataggaaattttatttatttgagacagtttctctctgtcgctcaggctggagtgcagtggtgtgatctcggctcactgaaacctctgcctcctaggttcaagcgattttcccatgtcagcctccccagtagctgggattacaggcgcacggcaccacgcccggctaatttttctattttatggtagaaacgggatatcaccatgttggccaggctggtgtcaaactgctgacctcaaatgatccgccctcctcggcctcccaaagtgctgggattacaggtgtgagccaaggtgcccgacctgatgtgcttgtaagaatttaaatgaagagggtcagtcagcttaggagacgaggttagatgtaaggatttcagacttgtcagtatacaggtggtgattgatgccgtaggaatgactggtattacccagggagctggtgcaaagtaggagccttggggaacatgttaaggggatgtgagagtaagcccacaaagactcagaagtggccagggagtaaggggaaaatgggatagaatagagcaaaagccacgggaggcattccttgaattccttggactcagatatgttaggggacaggaaacacattgaagacaactgaagagacttcagtgtgctgctgagttcttagcagagtagacagctgatttcaccactattccagaccctaaagatttctcctgaaattgcactgttatgcaatttttttccttctctattgccccacctctggggcctacactctttaccttctctgatttatctgacccatccgcatatctctgcaaagtcttaatgtaggtttccaggatttaatgattctttcaatcaactttaaagttcttcaggaagattctccaggtccgtcaacagttttccccttcatgactttgtgacaaagctttcttgttccactatccaggtgttcccaacaagttgctgtaacggtggcccctcataagcttgcctggaaaccctagaaagctcagaaaaattatgaactttgcccagtaagaggctgggaagtcagaaagggttttaaacaaaactgaccccacttgttacatgctcctttcactgtccaaacgtcaaccaaaggaacttttgtgacgctaagacgctcccggcgtcctcacccgttcacagccagagttgatcttagaaggcagggggctcgcaccgagacgctcctagcaagcccctcacgcgagcgaatgactggcgccaggagaaacgcataggacctcccgaagccgccgagagcaaaaggacccatcagagctgtgctgagacccgccgcgggccgggctcgcactcgagattctcgcccgtgggattccagtcctgagctgaacgagagataagtctttgtcaccccccagtctttactgtttcgagaaaccctaagattttttaaaaaaaagcccaagacgtcaagtcggggaactccaacattggggtgtccagaaacactggggtttcaggcgctctgtaaatgcgtccgaggtccgcggttctgcccgcaagcccagaccccggcctcacttccgccccgcgccccgcgccccggcctcacttccgccccgcgccccgcgccccgcgccccgcgcgcctccgcccgcccctgctccggccttgcgcctgcgcacagtgggatgcgcggggaggtggtgcgcggggaggtggagggcgaggggcggggctacctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggtgagtggccggcgggagccgcgcagagtccgaggcgcctgctgcttcggcaggagcgccgagggccggacttgtgtaggagaggggcgtatgtggaggaagccggtcaggccaagccgcgaggagccgcgggatccctggaaccctgcggctcccgcgttccctgacctggtgctacagccccaccctctcctctcccgatgtgcgcactccgtccctcgtgcttggattggctcccggggtagagccatcgcgtggcctgcctctcccattggttggcgtagggaggtgttctcctccggggcccctgattggccggctccgggaggcgccatcggtaatgcctgcggcaggggcggaactgctaggtggtctgagcccggctttgggctggggtcgggctgtcacacaatggctagaagtcgtgacttcgtctccttcgtgccgcatggttttcaacgcccttgacccgccggttccttttgtttgggaagcatggggtcgcatccagtccttcggatttggggaaatagaagggctacagcggcgtccctaggccgttctggaggtcgcctgtccagccctcggctgctgcgagttgtggcacccaccttgacctttgctcagaccagcaggtgtaggaacgtgtgggaggagagggcactgcctcctcgcgtggccttgccaaacagggtcatgaggctcccctgctcgtaggtggttcccgtattacccgcaggcttgtgatgtccacgctctccgcctttctattgtaggttccttcaatggtgccttagctgctgttcctgtccaggacctgggctccactgtcatcaaagaagtcttgaagagggccactgtggctccggaagatgtgtctgaggtcatctttggacatgtcttggcagcaggtaagtctcagtgattccaggagaagtcaggcttattagaaacagcccataaacacacacacacacacacactctcacacactcacacactctctcactcactcaagttcttgcctccttgcttttgctcagagttccctctgttatgattcctcctgttggcccccttcttccagccctgtcagtagcttctatccagcttgagactcagcttcttggccaggcagggtggctcccgcctgtaatcccagcactttgggaggcggaggaggaaggatcacttgagtccagaagtttgagactagcctgggcaacaaagcaagaccccgtctctacaaaaaataaaatagccaggtatgatggcctgtgcctcccagctactggagaggctgaggtgggaggatcacttgagcccaggagtttgagactgcagtgattgtgtcactgcactccgtcatgggtgacagagtgagaccccttctctaaacaaacaaaaagacttagcttcattaatatgctttttgtgaatgaacttagaccactgacctacaccacctacactgccttttcttttccttttttttttttttttttttttttttttgagacggagtctctctctgtggcccaggctggagtgcagtggcgtgatctcggctcactgcaagctccgtctcccggtttcacgccattctcctgcctcagcctcccgagtagctgggactacaggcggcccactgccttttcattcttacgaagcagggccggccgggcccggtggctcacgcctgtaatcccagcactctgggaggccgaggtgggcggatcatgaggtcaggagatcaagaccatcctggctgacacggtgaaaccccgtttctactaaaaatacaaaaaattagccgggtgtggtggcgggcgcctgtattcccagctacttgggaggctgagacaggagaatggcgtgaacccgggaggcggagcttgcagtgagctgagattgtgccactgcactccattcagcctgggcaacagagtgagactccttttaaaaagaagaagaagaagcagcagcagggccagcctgacgcataggaaagtatgcctgctcctccttactacctcaaagtgtcactcattcaacaaaaatgtattcagttcctcctatgtgccccatactgtgcttagtgctgggagtatggttccaacaatacaggtaagttccctgccctcttagggctcagttctgagcttggaaaataggtgccacatcatgccccttgcaaatggggcatatcactccccagaggaatatagctgagtcctgagagtgcccccatcttctgattctttgggtttgaacactcgtaattaattaattaattattattattattatttaaagagacagggtctcactctgttgtccaggctggaatgcagtggtgtaatcaatcgtagcccactataacctcaaactcctgggctccacggtatcctcccacctcagcctctggagtagctgggattacaggagcaggccaccacacctggctaattttttaaatttttttgtagaagtggagtctgtctgttgcctgggcgtgagtgcaatggctgttcacaggcacaatcatggtgcaccatgcccttgaacttctgagctagctgggactaccggtgcatgtctactaagtttaaggcttttaaagcactgtgctaaatgctttcctttcattacctcatttaatcttcctcacaagtctgttatatcctattatcttcattttacaaatgaataaatgagagtttaagaggttaaatgacttaccagggtcacagtttgaagtggagctagcacttgaacttagatctgtcctattccttgagccagataccttctacaatcatgtaacaaatgtttattgagcacctactttgtgccaggcactattttagcagctggagataagcaatgttcatatcagatagaaattctcattctcatgaagctcgtagtatgctaaatgctagcattattaattgtgttagcacctcatttctttctttttctttttttgagatggagtcccactctgttgcccaggctggagtgcagtgacgcaatcttggctcactgcaacctctgcctcccgggttccagtgattcttctgcctcagcctcccaagtgactgggattacaggtgcctgccactgtgcccagctaatttttgtatttttagtagagatggggtttcaacatgttggccaggctggtctcgaacttctgacctcaagttatccacccgcctcggcctcccaaagtgctgggattacaggcatgagccaccatgcccagccctgtacctcatttcttctttttcttttttttgagatggagtctcactctgtcgcccaggctggtggagtgcagccgtacaatctcggctcactgcaacctctgtctcaggttcaagcaattctcctgcctcaacctcctgagtagctgggattacaggcgtgcaccaccatgcccagctaatttttgtatttttagtagagagggggggtttcaccatattgtccaggctggtctcaaactcctgacctcaagtaatgcgcccccctcccccggcctcccaaagtgctgggattacaggtgtgagccactgctcacagcctgaggcaccgcactgggcctgtctttttaatatgtatatgatcctgcatatgttttcagtctcaagtaaccttacccgtttttagtttccagcctaatcccagattgataacattgtgatgaatataatctctaagtttttatcagcgacttatttgctagttcttccccacaaactctccaaggaagggtggtaggtttgagtatatctgaaactgggaatagagtaaccactttataaacatttaccattgactctgataacagacaatggcgattgagaatatttgaaacttttaactccattctcttctgtgctactttaagtaaattatgtatttcttcccaactaaaggaagtcccatagttgaattatgaaaagatatttgtgtttcagtactcagaatgagaaaaaaaggtatttgtgaattctgagtttgtatatattttgttatataaccatttaagcatagtgtaatgaatactaagcaagaacagaactgcttattatcaaaggttttcctttttaagtaaccctttttcttctcaagtgtcttaagccatgatcttgggagcaaatggccctagttagaaacactgataatgcctaggttatatcctgtgtttattagacataggtttgataatgcttatttaagcacccccccgcacttttttttttttgagacggagtttcgcccttgttgcccaggctggagtgtaatggtgtgatctcagctcaccgcaacctccgcttcccaggttcaagcaattctcctgcctcagcctccctagtaactaggattacactcatgcgccaccacgcctagctaattttgtatttttagtacagacagagtttctccatgttggtcaggctggtctcaaactcccgacctcaggtgatctgccctccttggcctcccaaagtgctgggattacaggcatgagccaccgcgcccaactatttaagccatatcaaaagatgaggatgacacttctttcttaatgtattaatgacttatttatggaggagaaagcttatatctatgaaatacctacagagcagcacaaggcagtatatattcaagggctagactgtgacaggtggagagtgtatacaggcctttttgcctccagtgggcacttacttgacctgtaggctttcagaagtggcaggtaacccaactggcaattttccacacactttcactgtgacattttgtctttctccttgattgctaagagtcctctgtgttcctctttctaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggtaaggcctctctgatgaggtggctttcactgacctcacactgagaaactcatgtctatgccagaacagagtaaacagatgcatagcagagctggaaccaaacagtgaacaaataaacagaaatgacaaccttgatccctacttgaatgtgaagtattcttcagtttgggtgggaaatccgggttgataagaagtttatcaaccagtgtgattggaaccgaatatactttttctaaactattaatgaagcatgtaatattttctgaattaaattcatattagttgcttgatgtccttggttttaaatttctttcccattgtgagtaaaaggcaaaaaacagatgttgccacttaccttcctgcacatgacaaggagatcctggggaccagactttttgaccttttcagggtatagaacatgtaaaagaggaccaccaagtggtgcccttctccagtaggtttgccaggcatgatttgtttcaccaagttccatacctcaaactggcatagtggttgaaagaaaaactataccccctgcttcctactgatgcagctcaggggctgaggtgcagattccctagatagaagctgattcagcccagccattgctgaggttcaggaggaggcaggctaaaggtaacaaaaataatcggagtgattttgatgggatgacactgacatctgtgtagtactttaccaggtgcttttgtacatgtgttcacaacagccccatatagggtagatgataccattcccagtttacaggtaaggaaactgaggaccagagccagcattcaaatacaactcttccgactctaagtccaatcaatgactctttccattctaatatacctgctgttgagttggtgagagttaagactggccgctactcagaaatccctccccatcatttagttagcctgattattctcactgtagacattatgtcatccattgaaataggtaacacattgttagctttacttaagcccttagaggatttcttcatttaacagataattaattgcctcgatggaaagaataaatggaattcttaaggaaacaggacacagaatgggtaggtttgagggagaattgaaaatgggtaggtaggagagtaatcgttcccaacaataggaaagatgaagtctgctaattccaggggtctttagaccttggcctggctgaggacctagaactggggagaagggctgcaaaggggcctagatgaagacttaggaaatactagatagttttgagttgtattctggggagaagactaattgcaactaagcctaaatccatttttatttctgacttctaggctcctcacttggcttacttgagaacaggagtaaagataggtgagatgccactgactgacagtatactctgtgatggtcttacagatgcatttcacaactgtcatatgggtattacaggtaaggcagacatggctgaaactgtattagctttaaaaaggttaaaaagaccatatactaatctgcttcttaggtgctttcgtccttatggccagagactgtcttaaggatttttatatctcttctttgattaactgaagtgaagtaagtattctcttctttgtgaactcttgattatcagagaatgttagaagtgggaagtacctcagagttcttctggatcaacccctcattttaccaaatgaagaaacagggcccacaaatagtgcttctgtggcagaggtagtgacagagataaaccagttgtttttttggtacctagctgtactttttgtactacacaattgggttattggtcattcatgctgaagggtcctgtggtctaagtttaatggcaaagcaactgggaaatcaaaagcactcttgtctttagtatacatgtaaaacttaagaaacagaatagacattttagagttaaagaatcaaaccctgagaagttaagcaccttgctcaaatgcatgcagcaatggctctggttttatgtaacacataaatatgtgaaaaaggtaatggggaaaagtacaagattccaagagggaactgtgtgcatgaatgctaggaaggaaggaagggcttagggatatgggaagcaatgagaagctcaaggcatcttgaccacttctcgacttacagccacaacagagaaggctataaaaacacaggcagacaatggaagacactgtgtgaccaactgcctcaaccataactagaggtggtcattaaaaattcagatcccgagccctttccaaggtgtactgtggattgaatggtactcttccagcctccagaactgtaagaaaataaattgctcttctttagaaaaaaagaaaagaaaaaaggctcaggtcatgatggagtaattgacaaagattagatttcctactataaacaagcataaaacttgtgaaaatatataaagccactgttttatgtatgtcaggttttgactaatactcatgtaagactgagatccttgagagaagggaaaaccccactgtcactgtctctacccagggcacttcccaaactgtgttatggagaggcagagcctaagctggaaacagtggtctcagtgatctgaagaagcagagaatttggggcttctgagatggctggagtttgtggggcagaataagggggagaagaaaaaaagagctccagaaatctgcaaaaggttccccttaagtctttgatcaaatactaagcttgtagataacagcttacaaggcctagtagaaaagagctgcaaaggagaggtgaactggagattttatagattactaggagataaaagttctggacaagcgagtggaaaccttactgaactccttggacactccattgacatctcagaaagaccacagtttaggggtagggccaaagccatagagtaaaagctactctagacccaaactaataagcttaaaaacaagcctcaaaaggatcaaggtgatttgccagtattttgactgcttgtggaaacaaaactcaatatattctctaaagataataaaatctctatgtccagttatgtagcaactataatgttcagcatgcaatgagaactttctagatacacaaagaattaggaaaatatagcttacaaccagggtggaaaaaaaccacaacagtcaacagaccctgcaatactagaattatcagatgaggatcttaaaggctctattttacatatgtttaaagatacaaaggaaaatataatcttcatagaggaatagatgtggacatctcaggagtaaaaggaaaaaatataaacaagaaccaaatagaaattctagaacttgcaaagtacacaatctgaaattaagaattcactgggatggggccgggcatggtggctcgcacctgtaatcccagcaccttgggaggctgaggtgggaggatcacttgaggctgggggtttgagactaggctgagcaacatagttagacctcatctctaaaaaaaaagaaaaaaaaattctgaatggccttaacagcatcttggagacagaagaaaaagggtcaggaagtttgaagatagatcatatacacgacctgaagaacacagagaaaaataatgaagaataaatgaacaggccaggcacggtagctcacgcttgtaatcccagcactttgggaggccaagccgggtagatcatctgaggtcaggagttcaagaccagcctggccaacatggggaaaccctgtctctactaaaaatacaaaaatgagctggatgtggtggcccatgcctgtaatcccaactacttgggaggctgaggcagaagaatagcttgaacccaggaggtggaggttgcagcaagctgagatcacaccattgcgctccagcctgggtaacaaacaaaactctgtctcaaaaaattaaattaaattaaattaaattaaaaaataggccaggtgtggtggctcatgcctgtaatcccagcactttgggaggtcaacgcaggcagatcacctgaggtcgggagtttgagacccacatgaccaacatggagaaactccatctctactaaaaatacaaaattagccaggctggtggcgcatgcctgtaatcccagctactcgggaggctgaggcaggagaatcgcttgaacctgggaggcggaggttgcgttgagctgagatcacgccattgcactccagcctgagcaacaagaatgaaactccgtctcaaaaaaataaaatataaatgaacagagccttggtggtctgcaggacaaaataaataggactagcatgcatggaataggaatctcatacataaggaagagagagaatggggcagaaaaaaactgaagaaaatttccacatttggtgtgaaaagaagttcaaagaccaagatagacaagggaaaaattacaccttagcaaattgtagcaaaaagttaaaaaaagatcatgccactgcactccagtctgggcaacagagtgagactctgtctcaaaaaaaaaaaaaacaagagtgaaagtgaagagccatttttagatgaaggaaaatgaattgcctgcacacctacactacaagaaatactaaaggagccaggcatggtggtatgtgcctgtagtcccacctactcaagagctgaggcaagagattgcttgagtccaagagtttgagtctagcctgggcaatgctatcatagtctactatgattgcacctgtgagtatctactgcattccagtctggttaacatagtgacacaacaacaacaacaacaacaaaagaatagcttccagccgggcgcggtggctcacgcctgtaatcctagcactttgggaggccgaggcgggcggatcatgaggtcaggagattgagaccatcctggctaacacggtgaaaccccatctctactaaaactacaaaaaattagccaggtgttgcagcaggtgcctgtagtcccagctactctggaggccaagggaggagacttgcttgaacctaagaggcggaggttgcagtaagctgagatattgcaccattgcactccagcctgggcaacaagaatgaaactccatctctaaataaataaataaatagtgtaaataaatactgtataaaatgcaaagcactcagaatagccaaaacaattttgaagtcagaaaatagcacttacatgctctgattttaacattacctataaagctgttgtaaacaagacaatgtggttttggcataaggacagagaaagagaacagagttcagaaatagacccagacttatgctcgttttcaacaaaggcatcaatggaatgaaatggagaaattaaagtcttttcaacaaatggtgctggaataacagattactcacatgggaaagatgaacctagatccctacctcacaccctatataaaagctaatttgagataaatcatggatttaaaaataaaagcaaaaaatgtaaagcttctagaagtatatataagagaatagcttttacagggtgcagtggcaggtgcctatagtcccagctactagggaggctgtggtgggaggatcacttgaggccagcagtttgaggttgtatagtatactatggttgattttgcctgttagtagctgctgcactccagcctggtcaacatagtgagacatcatccaacaaaaaaaaaaaaaaagaaagaaaaacagcttgataagtaaagacaagacatagaaagcaaagcaataacttttttgtgtgtgtgtgtggagacgggtctcactctggcacccagattggagtgcagtggctcaatcttggctcactgcaacccccacctcagcctcctgagtagctgggaccacaggtactcaccaccatgcctggctaattttttgtattttttgtagaaatggggtttcaccatgttgcccaggctggcctcaaactcctgagctcaagggatcctcccacctcagcctcccaaagtgctgggattacaggtgtgacccaccaaacctggccaattctcacatttgtagaagagagttacaaatacggaaagggagaagaatgtagcttgtggtgttaggttgcattttggagaactcaaaatgcagtatgaactcaaggtgttaccatgagtgtgtgtgtatatgtaaaattataaataatacatatggaagtttctactgaacagacctagaaacaatgacaaaccagtaacaacaagcagtcctgacacccagatcttctaaatacatttatccactaaaaggaactaaggttgtttggagaaatggccctttccaaggctagggaaaaaatgctaaaaaattaaggacatgctcagggacatgttgaaagcacacaggaggcagcctacggggcttccactttcctgtagtggaattttgaacaatttgagcatcagagtcagtaatgatagtaatgggttgtaactgcccaaattttgaacaatttcagcgtgcaaataagttatgatagtaatgggttgtaactgcctaaattttgaacaatttcagcgtgcaaataagtaatgatagtaatgggttataactgcccaagtattgaaaaatttcagcatcaaagtaagtaatgaaagtaatgagttataacttattcaataaaatgaaaatgtatgagtccatcctgatataaataactgaataaatgggagaaaaggaaaaggttttctttatggtaaaatgccaattaatatcttaccaatagaaggaatgttggagttagaaagtcatgaatgaatgctaaaactagtgggtgaaaatatgatggggaagaagatatttggataatccaaaaagaacctctgataaattattgattacttataaatgaaaaaatggtacctttaaaagctagaaacctggtgaataccaaaccattttaaccaagtgatcaaagataacatcacctgggataaactgattgtcatttgtgtcctaataagactcactgagaaaaatcatactatcattcagtggtatacctgccttttggcagaatcttaatctaattctgaggaaacatcagacaaatcaaaattgatgacccttaacaaaagaactcgcccatgttcttcaaaaatatcaagcttaagaagcatagtctgaagaactgttacagacaaaagcaaactagagagattgatagttgtacaatgcatgcttctttattggctcaaataaaggagctagaaggacattactgaaatataggtgaaatttgaatgtggaccaaggattagataatagtgtttgattcatgttaaatttcctgatttttgttttgttttgtgagacagggtcacccaggctggagtgcagaggcacaatcatggctcactgcagccttgaactcctaggctcaagtgatccttctgcctcagcctcccaagcagctaggactactagctacatggcacacacaccatgcccggctaaatttatttttaatggagacagggtctcgctgtgcccaggctggtctcaaactcctgggctcaagtgatcctcccacctcggcctcccaaaatgctgggattacaggtgtgagccgccacacttggcccaatttcttgagttttataactgtgcttatgtaagaaagtggccttgttttggggaagtatacactgaaattaaaatttaagagtaagaaggcattgtatctccaactttctctcagatggttcagaaagaaaatattaaagcaaatggagggaaaatataaatggtgactctgggtgaaggaaatttctgtaagtttacaattatatagaaagggaaggagagaagtatgactcctgagagtcactgcaacatttccaaaccaactgccagtggcaggcagggccaccccacacagagcattgcacaggccaccatgagcctgctagcatatgtggtcagtcagtgcttggtcaaatgtggacgacttgagctatcaaatgccagttcatgaaaatgttagttttttgctgtttttctcctttcccagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaaaaggtgagtatatcatagtggtttaaacatcaacctatttataggtaagagtaacatctaaaagagtaatacataggaatctttagaaattatatcttagttatgtttttcaggttgcaaatatatgtcctggatacatgaatgtggggagggggtatgctgggtttacaggacacggtaacatgggacctatgtcagcactcaagcactcttggttccagagcgtccatgaccactgtgcacacacagcaggtttcatgagaagctggagcactggctcatggttgttaggaggcaccagctgacctgtttcctgtataggctcaacctcctcagaagtggacacccattacttctcgctgtttctgtgtgatctccatttcacatttctaaagggtggatcttttggggtcactcgctattttctaatacagaatgctcccgtcaagctcccttattgataactgatatctcttatgtcctgccagcagtgcacgattggctttgagactgcctgatccactcactcgtaaccagccaagtactatgacccaaactatagcagaatttggcacaaacaggtccctggtagctactttcctcaggaaggcctatggatttggaaaacacaggtgtctcataaggacatactcataaattgttttcatgtacaataattcttgtgtgtactttcctcctgttgtcatcaaagtggtcacatattaaaacttttctgctaaatatgaatcctcatgtttaatggcagagaacccaccattcccagcacacttacttctgtctctggactaatcttgagtaattggttttcctttgcttaggtcttattgaagttaaaacagatgagtttcctcgccatgggagcaacatagaagccatgtccaagctaaagccttactttcttactgatggaacgggaacagtcaccccagccaatgcttcaggttagattttctgaaggacatctgggggaatactatgttctataatgtctaccgagtgaatatttttctctttatttatatacaaaagtactattttttgggacagggactcactctgccagccaggttcgtgtgcagcaatatgatcattgctcacttgcagcctcaaactcctgggctcaagtgagccccctgccttaacctcccaagtagctgggggactacaggcatgagccaccacacccaactcaatatttatgtacaaaattattcttaaaacagtttaaggaaacatgtcatttctctgtatttgatcattgacttaacctatactgaaagaattaatttggtttcttgacatcccaactagacatacaaatgaagaagtaaattagggaacttcagtttatctacctttgtatttttccagtaccagaaactcccaatacctccttgtgaagcccaggcttattcttccatttcctgtcagagatctcccctccccaactgctgtaatcctttttttttctttttgagacggagcctcactctgtcgcccaggctggagtgcagtggtgcaatcttggctcactgcaatctccgcctcccaggttcaagcaattctcctgtctcagcctcctgagtggctgggactacaggcgcacaccaccacaccggctgatttttctattttaagtagagatggctttcaccctattggtcaggctggtctcaaactcctgacctcaggtgattcaccctcctccacctcccaaagtgctgggattacaggcgtgagccaccacgcccagccccgactactgtaatcctaccactttctctagttggaaagttttgtggtcaatatattgccaaacataatttctatgtaaagtctgttgaattatagtaaatgccttagccaacaggtaaaatcatttaactcatgtcttcaggtggtaaagaagccacagatatgtaactgaggttaataagcatggtagaaattaagtcactcatattttacaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgtgagtataaccctattcccttttatgaaatttgtcttcctgttagccttaagtgagcttattcatgtagttagctctagtctttccctaccagaagagtaaccaagagcatttatttctatttttgagataaggtcttgctctgttgtccaggctggagtgcagtggcaccatcatagctcactgcagcctcaaaactcctaggctcaaatattcctcctgccttagcctcccattacctcgaactacaggtgcaccacgccttcttcatttcgtagagacaaggtctatgtcgcccaggctggttttgaactcctgagttcaattgatcctcttgccttaggctccccaagtgttgagatttcaggtgtgagccactacccccagccactgagagcatttggatcacatgctttctaggggaactgattctgttacattagccttaggtacacataacagatgctactggttcaaaattttaagacaatttagaatttctaagggatcttttagatcacacccttaaccttttggatggaatggatgtcactaaggcaaaaatgtgtgagaatgtcactgtattaacctaagaacaaaccaaagtagcagttaccagtatcatgcagcatatatttatgttgacaaagaatggtttaactttagcctttccacccaagtttagacctcttttctatgaatctttcctctaggttacaaaagcaggttggtcactggaagatgttgacatatttgaaatcaatgaagcctttgcagctgtctctgctgcaatagttaaagaacttggattaaacccagagaaggtaaagatgcacaagtaaccctgagagcttaccagtgaatttcacaatccaattttaagatagtatcttctaggtgttggccatgtgggtaatagttaaagaaatactagttactaggactgagttcattacttcccaaggtaaaaaaaaaaaaaaaaaaaaaaagacattggcttacttggcataaaaggaacgaggtaagataggcagggatgaattttcacaaaggtgtaaatttattcctaagcagttaaaatgaaaatttgagtttgaaagggtagcatgctgatacattaagaggaaaaagacaagtttaagattttaaactgtgtccacagaagaataaacaatctaaatcttttctcccccgctaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctggatgtaatttaataagatcatcaattcgaagaatggtgattgcagcttctgttgcaaatttcaaactcttaactttaactatggttggttcaaacacccctgcttgtttgttgtctcgaggtttaccattgctcaaatcaagaccaatcctgcaattaagaaagaattatttaacggccgcttacaatttcattaggtggcctattaactccagcatttcattcaagtattaaggttgatttttaaatcagactagagatcttgtaggtagtctttctaccaaaagaagcagggagagattagcaatcacagttaacgaagacacaccagtgctaataattagtcattatcccttgaattacagtgactgaacaacaaatgcttgctgtgaagtttttcatgttaagtatttgacaagtctgttacttatgtttgctgacatgtaattgactactatcctttttaatgcaacctgttctgcagaggttaacaaagagcgggaaaccatgcttaccattttagatttttacgttctgggttaacctgggcctcattatgaaaagctcttaattttgcaaccagatctgtggagtcctgggcagcattaactgctagtgtattgggaataacaagaagtgatcttgcaaactctgcaatcgcaagctgttcccgagacccctaggaaaagaagaaaattaggtgacttcacaaaagggaaaaaaaaaattgaagtccacagctactgctctcaggcctctaagacaagaaatgactgttcttaccatgctggttgcatagttttcaaggtatatggaaagggctgcttctacagcacccccaccgggaaccacagattttgactccaaaactctcttcactacacaaagtgcatcatgtaaagagcgctccatctcatcacacatgaaatcatttgccccacgtaagataatcgatgcagacgtacgagccttagtactgttcaaaacaaaagtacaattcttgtaatagcatttttaaaaatttttttttgccaagaccatcaatttctcaaaaaaaatggcattttaataaaataagtctacataaagttcccttaagtcctgcctacacaggatatttagatatactatacagaaacaatgtctagtccctgcagaagagatgaaaatggttacttcatctcaatttacagtggcccaatgttattttatcccatgcgtataactgctcgtatcactgtgagactacaagcagcaaataaatgggaagaaaacctacttttacttaacaaaatcggtataactttacaattttagaaagtggctcttactttttgattaagatcagctcatcatcacaaattctctcctgtaccacttcttctgcctgtcccaacattgcagcttcaaaagtttcttcaccttccaaattggccagggttgacagaatagttgctaataagagagttacaaaggatctgtgaatattgctctttcatgattttaatatccttggactcagtagcatttgtggtaaaagtgctatattacaagtttagaatttagttaggcagcacacggtaactccttttatcctaagatggaactgtcattttagaaatgaacaaattcagttcacaaatttccaacaaaatttctccagttacatgaaaaatggctctataaatgtgttggtagcacaaagcattaagagaatataaatgtttttgagctgttttctgtcaatattccaatgtaaaaagacctttgataggatcagggataataaaagtattttatgtgacagccagcacaagacatacctccagaagctttggcaatgcgtttaaggtccctttttaaaactcttctaactgccatagcaccagcctccacaaaatacttcagacacatatcatcaattccaccagtggttagaata

SEQ ID NO: 12539 - DNA, 62728 bp, Human
  misc_feature (1)...(62728): n = A,T,C or G
acctgcctcggcctctcaaggtgctggaattacaggcgtgagacactgtgcccggcttttttttttttttttgagacggagtcttgctctgttgcccaggctggtggcacgatctccgctcactgcaacctctccgcctcctggattcaagcgattctcctccagcctcctgagtagctgggattacaggcacatgccaccatgcccggctaattattatatttttagtagagatgggtttcaccatttggcctggctggtctcaaactcctgacctcaggtaatccgcccaccttggcctcccaaagtgttgggattacaggcgtgagccaccgcatccggtgaaaagtttctaattttttcatgaagtttactctatcaacttcttttgtgaattgtgtttttttggtcagatctaagaactcttccccaagctctagatgtgagaaattctgttttcttctaaaagttgtatagtttcattcatacattttacgcctcagtctgatcattttgtgttagaatttgcatttgcagataacatgatggcccatgtaaaaaatacaaggattttacaacaacaaccgcaaaacaccaaatgaaccctcaaactaatgagttcagcgaggtctcaggataagaaaatcaacatagaattcatcacatttgtgtagaccaacagtgaacacgtggaaaacgtcaaaaacgcagtgttacagttgtttgatgtgaaatactataaacttaaaaggtgcagaatctgtatgctgaaattacaaaatgctggtggaagaaatcaaaagaccgaaataaatggaggggccaccagggacgcagatgaaggaccgagtcagcgatgcccgtgctccccaaacgatctgcagcagttcccatcaaaatcccagaaaacttcgtagactgaagcgtattccaaaatccgcagagatgagcgcaacatcacagaggaccccgaggcgccctccaggccatttccttcctgacagctggaagagcggcctggcggatgagggaaggtggaaagccgttccccagcggcccgcggcccgcgccgtccagctttgccctttttaaaggggaagcaaatagggtccaaagcagcgtcgcctttgatctggcacctgaagcgcgaagggcgccggccgggtggaggtgcggggttggggcggggacccgactagggcgggcggggaagtcacgcccacaccgagctcggccgcgcccatgccgagccccggccacgccacttccgccggaagctcggttcagcttcctgaaagagttggtcctgcagttccggaagttgcgtttctactagggaaaggtccgcaaactcttaaggtcactttctgaaggcggcctcatcacagtcggaggtgagctcgatccggaccctgtgggcagagggtccccggccctagggtggccacttgaagaagaggaggacgttctctgttccggaacgaaagtagcgcgtgcaggctgtttccggggacccgaggccgatgcaccgctcgccccgcccctctcacggccacgtctccgccggagcatccgggccgggcggcctccggggctgccagagcagcagggtgaggggctcggaggccgcggcgcctcggggctcgggctcccgctcccgctcccgctcccgcagtgcatgggcgggggaggctcgaggggcggcggcggggcctgggcgcgtccctgcagcgtggcgggacggccccgttccagtcacccccgcctcgctgcggtggcctcgggcctgggcgcccgccttcagctgcggcggagctggctctgtaaatgccggtgcccgcgagccctcctgaatgcttgtctgcgcccgacgagcgcggcctgtcccgaagctgtccactgccaccactcgggcagtgcttgctttagcctggccctttgcagctgaaaggcgtgacatggtgtcgggtggttcgtgggaagtcggggtttcaggagtccgtgtacttccttgtttgtctttgtcgctggccgacttgtcttcattccaggtggccagagcgagtggggccgggcgttgtcacgggtatgaacccgacgaatgtcagtcgtgtggcgggtcctgggtattgtgggtctgggtcactgcccccgcggagcccacctaggatagggacacccagggtcgccagcgagagggtaccgggcggtggttgggtggggtccgctactctaagtgggagcctggggggcgggcgacttccgtgctaaggcctctatgacgagaagcaagccaggcaaaattgtgagaaaagcgcgcctcaggcagaaagtttgaagaccctgagggcggaggatgtggccacagtgtaatggcaaagggggaaagcgatggcggtaaggatgttggtgtaggcaggtgctggattcttaagaggttggagtttattgtcactgggccagtgtaagccatttacagatgactcatggatttttttttttttttttaagagactgggtgtgttgctgtattgcccaggctggtgtggaactcctggcctcaagcgatcctcccaccccagcctcccaaagtgctggtgttacaggtgtgagcagccacacccgtcgtcgtggattattttgaactgtcttttaaacgacatcaacatagcgctttataaccctttaatatcttttcaggcagtataccttaaatggcaagaaggaaataaatcatctgacatcactcagattgaagaggagctttttttcccccgattgccttaagaagtagcatactttcccaagtgagaatgccttcagttggcttttagcgattttgacaagcaacaactaaagggaaaatcgtgataattactgtcattttattgaggacacgggacagactctgtgccttgttatatttaatcctggcaaaattttgcgttcattttctcattgttttactggtgaggaaacaggctaaatgtgattaagaaatctttagcccaggctctcacaggtaagtggtggagggtcgggagctgaggccggagtcctgacttccaagcctgcccttcacgtctctgcagtgacatgaggcttgcttgcttttggttttcactttgtgtatagatctgtgtttacttttggatactagtgtggcctccaccaggtactcttttcctgaggaaatcgtgtttggtttttggctgtgctctgttgtttctaatacccgataggaacaggtgaaacgaggtggtgtagatggagccgtgaatgtttgtatacagaattcaggtgtgggggaagcagaaagtcctgtaggtgcctgaggtggtggtttctcagtatgaagtcccttgatgttacccagctgtgaacctagggttgtgtgtacctttcgcagttctaagtgacagctttgtcctgtctcttctctctagagacgcaggagtgcgagtgatcataagtgagactgattagactggcctctttatttaaaatagagccatgtttgtagtaccagctttctgtgatgcactggcagttgctcctcctcctcgctgcccggagatcgctttttgtcagtagtctgaggtaatgaggccctgacgactgagtcattccaaattttaactaaaaatcaagcaagactgggaatcgaccgagactgccagcttattgccctacagggagaagtatcactgtcaccaaactccaggcagttagtgaattctctctctggtccggcttcaggaggagctgcctgtaaagaggggccgtctttgtgacttacagtcaccgtcatggggtctctgttctggagaggtgggctgcttggacaccagcaggggaattaagtgagcagaatctgtgattgcactggactcagctcggtgcggttggctgtcaccatgttggcgtgccctctcggtggaacctgagcgtctttggctgtgttccttcttggtcagtgtaaggcccaggcgtcgtcactgtgggcctctgcagcagttctcctctgcagcagttctcctctgcatgttccacctgtaatggctgagtccagtcctgctggtcatcccatccttccttctgttcaggtggtggtgcctgtctgggccgtggccgtgatgctgctcttccagtttcttttttttttttttttttggagaatgagaaaataactttatttcattgtggggagcgggctgatgtccagcctcagaacttctggaactgcttcttggtgctggcagccttggtgacctggagcacgttgaggtgcactgtcttgctcagaggccggcaaggccggcactcgcccactgtgacgatgtcaccgatctggacgtccctgaagcaggggaacaggtgtacagacatgttcttgtggtgcttctcgaagcggttgtacttgcggatgtagtgcaggtagtctcggcggatgacagtggtcctctgcgtcttcatcttggtcaccacgccagagaggatccgccctcgaatggagacatcaccagtgaaggggcatttcttgtcaatgtaggtgccctcagtagcctctttgggtgtcttgaagcccagaccaatgttcttgtagtaccgcaggagcttctccttgccagtttctcccagcaggaccctcttcttgttttgaaagatggtcggctgcttttggtaggcacgctcagtctgaatgtccgccatcttcccggccactgaaaaaaggtgctcttccagtttctaactccctggactccctcattggaactgaagctcacagatgtttcagctggactagtttagactttgctgtattttaaaaggcagtgttgatgctccaggattcaaatacttaatcattttgttttggaaccattagctttgtagcagaggaatgtactcagcagaatcagcagaactgaagatttaattcggcaaattaaacctgtgttggcactttaggagttgggagtgttcaaggtggtgggaggcagacggggaatgagtctctgtcttcaaggatctcgccatgtaatgggcacacacgcaatggcagacatgacgtgctgtggtggaggccacgtgaggtacagtgatggcagagggggtagacgagacactttacctgcggggccaggagggtctgcacgcgcaggcacacaccgtcggttcctttacctgaggggccaggagggtctgcacgcgtaggcacacacggtcggttccatataatcaccccacccccgcaaggcagaagcaaagacatcacaaagcaaaacgcaagttttcttttgctaggaaattttcaagaggaccagatgtacagggtaccagtattcagtggcgcagtcgagtccacattccaccgcgtgtagtcctccgtgccagtttgtaattcatctgtcaaaggggcaagcctgtgataagcagccatcattttgctgatgctcctccccttgttttgtgggtgtcttctccattcccaggtgggcgtggccggctgacccccagttctcttggagtgtgtctgggattgtagctgaggggcaggcttggtggagatcgcagtgtttttcctggaaagtgattttcagagggttctgtgctgtgtgtaaggacaggtgtgtagttcagatccctgcctaggctctaaggcccatttatcacccacccacccggaaaatccagggatgagagatgttactagatgatcatagacgcaaacatgagattgagaattcgttgcacacaggattagcttttgaccagccttggtaacttccttcacttctgtgcttcagacattgctttaatctttaaatatttttatgtgccaggcaccctgagtcaagacatctaggatcctttgtttacagtagtttcttgattagctatgcgagatttatagttactaatgttaggacacatttctattcacagtgctttctggttacaaacccttaatgctagttttacactaatagcatacgtaaccttttaatattctgaacaacactgttatgaactcataactgtctctggcctgtaggatgcaaggtggcagagaggaatggtggattattatagttatgagcagatactcacaggtctgcacgcccttcagtgagtcattgactgtgtcagtggactgggttacacccaccacccataggtttcctcttttacgggtgaccagtctagatggcaggtagagtaaaaacccctagaaagacaggcacgtcctgctgcggggtcagtgacacacatgctctcgaggaccagccacgtgggcttctcttttttttgttgttttttgttttttgagatggagttttgtgcttgtctcccaggctggagtgcagtggcacaattttggctcacgcaacctctgtctcccaggttcaagcgatgttcctgccttagcctcctgagtagctgggattacaggcacgcgctgccatgcctggctaatttttgtatttttagtagagacgaggtttcaccttgttggccaggctggtcttgaaattctgacctcaagtgatccacccaccttgaccccccaaagttatgggattacaggcatgagccatcacacgcagcccttttttttttttagacggagtttccactcttgttgcccaggctggagtgcaatggcgtggtcttggttcagtgcaacctccgcctcccaggttcaagtgattctcctgcctcaggctcccaagtagctgggattacaggcgcctgccaccacgcctggctagttttttgtatttttagtagagatggggtttcaccatgttggccaggctggtctcaaactcctgaccgcaggtgatccgcccgccttggcctcccaaagtgctgggattacaagcatgagccaccgcacccggccccatgtgggcttcttgtctataccttctgtgtgggatttgtaagctagaggcgaaggttgtgtaatgtttctcatgaaaaatgttaaacacagaacataatgtaggttaatatgaaactgattttaaaggaataaatgccaacatttctgcagaatgaatggaagctcatgctagtgtcttacctgttgataaggaaatgagttaataatatcaccagcacatttcagggtggataatcacttgccaaatgttgggcaaagttttgctcccctgaatgtagcccggcagggcaggctgagagagctaacccagctagaggtaaagacgggaacgggccctgccgtgagatgccctttctgtgcccccactccaaggcagctgcctttctggtgtccttgtacaccctgtatacagttaccacatcccatggcacctgctttttaaagttttgtttctctggatctgagttgtccaacctgaaggggtggggctgccggcaggagccgtggccttgggcagagtcactcactagctgagaggggggcctgtgagtctggtattgtaatttttaaattgtttttgagatggggtctccctctgtcacccaggctgcagtgcagtggtgcgatctcagctcactgcaacctccgcctcccggtttcaagtgactctcctgcctcagcctcccgagtagctgggattacaggtgttcaccaccacacccggctattttttgtatttttagtagaggtgggggtttcaccatgttggccaggctggtcttgaactcctgacctcaggtgatctgcctgcctcggcctcccaaagtgctgggattacaggggtgagccaccgcgcctggcccaaattaattttaaataaaatttaaagctcagttgccctgtgtgacacctactccacagattcagagctgcgctgtcccagcagaatgttctttagttggcaccgatacagacattaagctccttcaggaaagggcccagtgtggctgggtcagcatcttagcctcaaaacctaggatgttgtgggtgctccaggattatttgctgaatgaaaaagtttgtatttgtttcttgtacgtatgcaaattgggaaccaaatgctaattttgtaattgatacttgaaatctgacaagtttcataatacattttgtctctctctcctgtcaggtatcatgatattagctggtttgacatcaagtcatttgtgagtcatcagatcttctcctgaaaatgggagacacagtagggcccctcccaggagctcttggctgttgctgatggcagaagccaagcttgtccaaggttcacttgtagcccctcagcgtcagctcagctggtgtcgtcctgaccatggacggcgcgtcggccgagcaagatggcctccaggaggacagatcccacagtggcccctcgtctctccccgaggccccactgaagcccccgggcccactggtgccacctgaccagcaggacaaagtccagtgtaagtcgtgaggttcctctgtgtgctggtcacaggaggacctggtgttgagggaggacgtggtgttgagggaggatgtggcgttgagaccactgtgagcttttcacttaattcaaagttgttttttttttttttttttttgagacggagtctcgctctttcgcccaggctggactgcagtggcgtgatctcggctcgctgcaagctccgcctcccgggttcatgccattctcttgccccagcctcctgagtagctgggattacaggcgcccgccaccgcgcccggctaattttttgtatttttagtagagacggggtttcaccgtgttagccaagatggtctcgatctcctgacttcgtgatccgcccgcctcagcctcagcctcaaagtgctgggattacaggtgtgagccactgtgcccggcccaaagtatgttttagtaactgaatgatgccacctttagatcaggcacattcctgctaaacagaactccattaaacgtgtggggcagcagcagtgtttccctgaagggatctatgggtctttatcatgttccctgcctaaaattctaccttttttttttttcgacgtggagttttgctctgggtgcccgggctggagtgcaatggcgagatctcgtttcactgcaacctccacttcccgggttcaagcaattcttctgcctcagcctcccgagtagctgggattacaggcatgcgctaccacgcccagctattttttgtatttttagtagagatgaggtttctccatgttggtcaggctggccacgaactcccaacctcaggtgatccgcccaccttggcatcccaaagtgctgagattacaggcgtgagccactgcgcccagccattttttttttttttttttttttttttttttgagacagtgtcctgttctgtcgcccaggctggagtgcagtggcaccatctcagctcactgcaacctctgcctcctgggttcaagcgattctcctgcttcagcctcccgagtagctgggactacaggcacctgccaccacacccagctattttttgtatttttagtagagacggggtttcaccatgttggccaggctggtctcgaactcctgatctcaaatgatccacccacctcagccccaaaaagtgctgggattacaggagtgagccactgtgcctggccgaattctgcctttttgattggtcagttgctgaatttgtaatagctagaattcagaagtcgtcccgtagagatctaaggattacggagcacagtgttatgttagccccctgggttattcacgtgtcagagggaaagggtgacttagttattcactcagttctcatgcctcttcctggccaggaggttcagtgctttaaaactgtagactacagatgtgctaatttactagcagaagtcacagtctaattcctgtaaaatgatactcaggcgcttaggatggctttgctggtccttgctacataagcatcaggtgaggcagataacaacttagaggcccaagatcaagagttctgagacccgcggccgtggaacctgctcttagatctgctgctcaggagcaatgtgccctcgagcaagacgctgggttaatctcagcctccgcccctttttctattttaaacattttattactgtttttagagtcagggtgttgctccattgagcaggctgaagtgcagtggtgtaatcatagctcacggcagccatgaactcctgggcttaagtgatcctcctgccttggtctctggggtagcggtgactatcgatgcgtgtcagcacgcctagctgatttttttttttttgagacggagttttgctgttgttgtccaggctgtagtgcaatggtgcgatctcggctcatggcaacctccgcctcccgggttcaagcgatcttctgcctcagcctcctgagtagctgggattacaggcatgtgccaccacgcccagctaattttgtatttttagtagagatggagtttccatgttgatcaggctggttttgaactcccaatctctggtgatccccccaccttggcctcccaaagtgctgggattgcaggcgtgagccaccgcgccctgttgcctggctcattttaaaaactttttgtataaacagtcttgctgttgcccgggctggtcttgaattcctggccttgagttatccttccacctcggcctcccaaagtgctgggattacaggtgtgagccactgcgcccggcctaacccagtaacttttatctgaaatgcaaggttccccctctcccagcagtggagctcacgggtcctttgcatgaaaggcgtctcagtgcgttggtcgggtgcccgtggtctggcttcctgtctggcacccctgcttttattctggtttttctttcgggaggcatgacagtaagtatctgctgttagtttgaactcacatttgcaagtgaaagaaaccttttttttttttgagacggagtctcgctctgttgcccagactggagtgcagtggcacgacctcagctcactgcaagctccacttcgcgggttcacgccattcttctgcctcagcctcccaagtagctgggactataggcgcccgccaccacgcccagctaagtctttgtatttttagtagagacggggtttcgccgtgttagccaggatagtctcgatctcctgacctcgtgatccacctgcctcagcttcccaaagtgctgggattacaggcgtgagccaccgcgcccggctaagaaactcatttttaatttgcttgagcaaaaagcaaatttgctgtcctgcatgcacgtgggatccgaggaatgctgacccctgtgagacacggaggtgttgccgggcctccagagccaccggaaccaggaccagaaccccctgaggaccctccctcccccctcacatgtcttggttctttgactgtgaactggcccacccaccagtcagcagttagggggcagggaaaagactgaaaatcacttcattgaaagaaatctttctttgttccatttgatgaggaaatatgttttagtttgtgttgtgggtaatttgtatataatcattttagtgggtgaactgaggtaacacgtgggtatagaattgtcactggtccaacccaggcctttacccagcaggctgtcatcaagcagaagcgcggttctgggctgtctctgcttcacgggtggtgtgatgacatcatccacctcttcgccttagggtcctcgccttggaggataagctgaggctttgaaatgactccaaaatcagcctttgtaaatgtgaggctgtgactctgattaacactgctgttaccagtgcctgctagaaagattgtcagctgtgttttaagtgtttgtggttttcgcttgttttaaactggcgactttcataagatttcttattggttttacttaaatggaaaggaaacattggctgggtgcggtggctcacgcctgtaatcccagcactgtgggaggccgaggctggtgaatggggaggagtttgagaccagactggccaacatggtgaaaccccatctctactaaaaagaccaaaaattagccaggtgtggtggtgggcacctgtaatcccagctactggggaggctgaagcaggagaatcgcttgaatctggtgagtggagcttgcagtgagctgagcttgtgtgactgaactccagcctgggcagcagaatgagactccgtctcaaaaaagagaagaggaaatgttactgtcgttactacataaattctacagccaagagtgtggaggtgtggagggtgagttcaccttatagtgtagaggtgtggagggcgagttcaccttagagcatggaggagtggagggtgggttcaccttagagcatggaggagtggagggggggttcaccttagagcgtggaggtgtggagggcgggttcacgttagagcgtacaggtgtggagggtgggttcaccttagagcgtggaggagtggagggtgagttcaccttagagtgtggaggtgtgggggggggttcaccttagagcgtggaggagtggagggtgagttcaccttagagtgtggaggtgtggggggggggttcaccttagagcgtggaggtgtggagggtgagttcaccttagagcgtggaggagtggagggcgggttcacgttagagtgtggaggtgtggagtgcgggttcaccttagagcgtggaggagtggagggcgggttcaccttagagcgtggaggtgtggagggtgggttcaccttagagcgtggaggtgtggagggcgggttcaccttagagcgtggaggagtggagggtgagttcaccttagagtgtggaggtgtggggggggggttcaccttagagcgtggaggtgtggagggtgagttcaccttagagcgtggaggagtggagggcgggttcacgttagagtgtggaggtgtggagggtgggttcaccttagagcgtggaggtgtggagtgcgggttcaccttagagcgtggaggagtggagggcgggttcaccttagagcgtggaggtgtggagggcgggttcaccttagagcgtggaggagtggagggcgggttcacgttagagtgtggaggtgtggagggcgggttcaccttagagtgtggaggtgtggagggcgggttcaccttagagcgtggaggtgtggagggcgggttcaccgttagagcgtggaggagtggagggcgggttcacgttagagtgtggaggtgtggagggggggttcagcgttagagcgtggaggtgtggagggcgggttcaccttagagcgtggaggtgtggagggcgggttcaccttagagcgtggaggagtggagggcgggttcacattagagtgtggaggtgtggagggtgagttcacgttagagcgtagaggtgtggagggcgggttcacgttagagtgtggaggtgtggagggcaggttcaccttacaggaaggacgtggacaccagaggggctgtgggccttatcctggccaccccgcctgtgggacggggcccatgggctgctcctctcagagtgaagcctttgtgggatgagaaagtgccgtgctcatgagtctggatcctcttctctcctactccagctgcatgtctgaaaagcgacgtcaccttgttgttaaagccatggtggtccagcgtgctctgtctttccaggtgccgaggtaaacagagcatccacggaaggggaaagcccggatggacctggccagggaggcctctgtcagaacgggccaacgccacccttcccagaccctccgtcgtctctcgatcccaccacaagcccagtgggccctgatgcctctccaggtgtggctggtttccatgacaacctaaggaagtctcagggaactagtgctgagggcagtgttagaaaagaagctttgcagtctctcagactcagtcttcctatgcaagaaacgcaactgtgtaagcatccgttaccccgcttttcccaccctccacgtccgcgtcgctcagccccttgggagcaggtgccctgcgcactcactgtctgagctgttgtgtgcctgtgcctgccgtgtgccatctgagtcccacgtggggctgtgagtttagcaaggagagcttcaagttagagagtgaagatgcaggtggagtcaaggttctgctgtggtctgactggcagcagtgctgacgcttttgcgttaaaggccagcctgcatgtcctgtgtcacccaggtgcttggtaagcagacggtgggcatccagtctgttgttttggttttttttggtttgctttttttttctgagacagagtctcgctctttcgcccaggccggactgcagtggcgctgtctcggctcactgcaatctccgcctcctgggttcatgccattcacctgcctcggcctcccgagtagctgggactacatgcacccgccaccaggcccggctaattttttgtatttttagcaaagacggggtttcaccgtgttagtcaagatggtattgatctcctgacctcatggtctgcctgccttggcctcccaaagtgttgggattacaggcgtgagccaccaggcccagcctgttttgttttttaattagagtcaggatcttgctctgtcgcccaggctggaggccagtggcagagtcagagctcactgcagcctctgcctcccaggttcaagggatcttcctgcctctgctgtcaagtagcttggaccacaggtgcgtgtcaccacacctggctaattttaattttttgtgtgtgtagaaacggggtctcaccatgtttcccaggctggtcttgaactcctgggctcaagtgatcgtcataccttggcctcccaaaatactgggattataggcgtgagccactgtacctggcctgcagtatatttttaaaaatttcttaaaactaaataacaacaacaaaaaaccctaaattactgaaatcagactgcatttcacatgtgtttatttgaaacaattctgaaaactcactgccagcatttaagttgagaagtagcatgtaaaaaagtctagattcctgatttttttcaacttagtttatttactttggggtcctgaagttacagatgtgtgagctctggcccaggtgtctggggcagcagcgctgggtctacgtgcacacctttgcgggatgcccctggtcacctgttcctgctggcgcctggccctgagcctatctcctgcgtcagtgtttggttgaaaccctgcttattttgccgacttatataaatatctgcctggtggccataggcctgaatttgccacttacggtctagccatctggaccactttgccatgtgaaaaggactagagatcttttcagtgataaaatgtataaactaataatggtacatttacagtgaaattcttggtgactgctcagatgttagggattatttaggacagtagctgctcatctcctcagcatctacctgtaaggagggtgtcatgtgtaaagcgttgctgtgtgattatgctttcctactctggtcggcacccaggccgtcgggcggtgtctgctgatggcttaggaaggatgaggccacacactcagtcctgggaagtggagccctgggtttgtaactataacacgttggcacgtaccatgcaactctttcatcacctacaatgaaaggtctgggttttagatattttaaattctggttttggctaaaaagttgtaaattttcccctcctgtcccggagcatgacctcggattggagtcttgtctgtctggaaactgaggtaacccgcccccagccctggagggcggagcctgtgcagcatttaccctgcagtgaggcctggcgccaggcttcagccatttgagtaccgccagagccttatcgtaatgtgacttgttactgcaggagctgagatgagctgtgcgtcagagcggaccccaaatgtaactgagcaaagaaatgcactcggggtctcgtgaccccacgacggctgagctcctgtggctgggtactgcctgtaactccacggtgccggcgtttcaggttctcccagcggggtcacgagaacctgctgtgaagccagggcaagttgcagcgtggtgagagctgagcctgcctcagagtgctcggcacggctccagctttgaacccagttctttctgttgttaaaaggcacttgctgccgggcacggtggctcaggcccataatctcagcactttgagaggccgaggtgggcggatcacctcaggtcgggagttcgagaccagcctgaccaacatggagaaaccctgtctctactaaaaataccaaagtcgtcaggggtcgtgttgcatgcctgtaatcccacctactcaggaggctgtggcaggagaatcgcttgaacccaggaggcagaggttgtggtgagccgagatcgcaccattgcactccagcctgggcaacaagaatgaaactccgtctcaaaaaaaaaaaaaaaaaaggccgggcgcggtggctcacgcctgtaatcccagcactttgggaggccgaggcgggtggatcatgaggtcaggagatcgagaccatcctgactaacatggtgaaaccccgtctctactaaaaatacaaaaaattagccaggcgtggtggcgggcgcctgtattcccagctacttgggaggctgaggcaggagaatggtgtgaacctgggaggcggaggttgctgtgagccgagatcatgccactgcactccattctgggcgacagagtgagactccatctcaaaaaaaaaaaaaaaaaaaaaggcacttgctgccatttcctgttttaccaggggaatgccccaggtggggtgtactcatcatgggatcacagacccagtgcctggccactgtgtctcctgtgaggtagatcccgcctgtggtccgtgtccggggctcacagttctctcttgatctagaaattgtccttccaaacaagatggctgtgcattgtttaggtgtaaagtatatgggtaattaagtacaaaatgaccaagttcttgtgcctgattgttctgcatcctggtattttatgagtttccaaattgcccttttcccactgcaggctctacagattctcccctgcccctggagaaggaggagcaggtccgacttcaggctcggaagtggctggaagagcagctcaaacagtacagggtgaagcgccagcaggagagggtgagtctccctctcccgaacaagctcatggaaagcttcctgtgccagagacaactgttggtcccacataacccggggacctgccattggcttctctgagctgccatgggctcaggggcaacaagcacattttatttctaaatctgccaattgaaaagcaaagaaagcaaacacgggtgacctcagaggtactgtgggttcagttctggaccaccacaaaaatgtaaacattgcaataaagcaagtcctacaatgtttttggtttcctagtgcataaagaagttatgtgtatacgctactgtagtttactaagtgtgcagtagcactgtgtctaaataaaactgatgtacccacattaatttgaaaatgctttattactaaaaaatgctaacgatcatctgagccttcagcaagtcgtaatctctttgctgttggagcatcttgcctcaagtttgatggctgctgactcatcagggtggtggttgctgaaggttgggctgtggtaatttcttaaaaccgcactaaagtttaccatatcttagaaaagatgtctctgtaacatgcggtgctatttgatggcattttacccattcaggttttatcctgagattgcagcaattcagtcacatcttcaggctccacttctagttctagtgcccttgctgtttccaccacatctgcagtcaagttctccacggaagcactgaatccctcaacgctgtccgtgagggtagaaatcagcttcttccacactcctgttaatgttgatattttgacccctccacccatgaatcatgaatgtttttaatggcatctagaatggtgaatcctttccagaaggttttcagtttactttgcccagatccatgagaggaatcactatgactatggcagttgtacccttacagaaggtatttcttaagtaataagacttgaaagtcaaaactagtccttgatccatgggctgcagaagggatgttgtgtctgcaggcaggaaagcgacattcacctccttgtacatctcccatcagagctcttaggtgatctggcgtattgtcaatgagcagttaaaaaaaaaatatatatatatatgtgtgtgtgtgtgtgtgtgtgtgtgtattttgagacagaatctcgctttgtcacccaagcaggtgtgtagtggtgcagtcttggcccactgcaacctccgtctccctagttcaagcaattctccagcctcagcctcccgagtaactgggattaaaagcacgtgccaccatgcccggctactttttttttttaatgtttttttttttttttttttttgagagacggagtctcactctgttgcccaggctggagcgatctcggttcactgcaacctccacctcccaggttccagtgattctctgcctcagcctcctgagtagctgggactacaggcacccaccatcgcgcccagcctatgtcatgtttcaaaaggatctcttcagtagaagaagatcaataaaatgaccagcgtgttcttcttatacctttaaggttatgtttttaaatactttaatctggctgggtgcagtggctcacacctataatcccagcactatgggagggtggggcgggcggattgcttgaggtcaggagtttgagaccagcctggccaacgtggagaaaccccgtctctactaaaaatacaaaaaattagccggatgtgatggcacacccctgtaatcctagctactcaggaggctgagacaggagaatcgcttgaacccaggcggcagaggttgcagtgagccaagattgcaccactgcactccagcctgggtccatctcaaaaaaaaaataaaaatgcaagtatgaaaaatgaagagttatcctagcagttgtaagattagtgggaagtataacatttataacaacaaaaaggataaactgagaaataagttagaatggccgcagagggcctgggttctagatgggggtggggtagctgctctgttgaggggcgtgcatgtagggtccagccccacagggtcagtgggttttctccctgtgtgcggagacgagagagtgtagaaataaagacacaagacaaagagataaaagacagctgggcccgggggaccactaccaccaagacgtggagacaggtagtggccccgaatgtcaggctgtgctgttatttattggatacaaagcaaaaggggcagggtaaagagtgtgagtcatctccaatgataagtaaggtcacgtgggtcacgtgcccactggacagggggccctcccctgcctggcagctgaggtagagagagagggagagagagagacagcttatgccattatttctgcatatcagagacttttagtactttcactaattttgctactgttatctaaaaggcagagccacgtgtacaggatggaacatgaaagcagactaggagtgtgaccactgaagcacagcatcacaggttgatggttaggcctccggataactgtgcgcgggcctgactgatgtcaggccctccacaagaggtggaggagtagagtcttctctaaactctgctaagtagtgggtgtttttccttgacactgatgctaccgctagaccatggtctgcttggcaatgggcgtcttcccagatgctggcgttaccgctagacccaggagccctctggtggccctgtctgggcataacagaaggctcgcacttgtcttctggtcacttctcactgtgtcccctcagctcctatctctgtatggcctggtttttcctaggttatgattgtagagtgaggattattataatattggaataaaaagtaattgctgcaaactaatgattaatgatattcatatataatcatatctaagatctatatctggtataactattcttattttatatactttattatactggaacagttcgcgtcctcagtctcttgcctcggcacctgggtggcttgccgcccacacgtgcaagcagatgtgggcaggcggaggaaattatggatttaaggtggttatagttcaacagaatgttcttcctttttgaagaaatttttttttgttttggagacagggtctcactctgtcacccaggctggagtgcagtggcatgatctcggcttattacgacctccacctcctgggttcaagtgattctcctgcctcatcctcccaagtagctgagattacaggtgtgtgccaccatgcctggctcatttttttgtatttttagtagagacgggggtttcaacatgttggccagcctggtcttgaactccttacctcaaatgatctgcccgcctcagcctcccaaagtgctgggattacaggtgtgaaccaccacgcccggccttgaagaaaatttctatgtttatccaaaaaaataaaataaactggagagtagccaggaaagttctgttgaggaagtctgtgggtggcaagccactcaggcaccgaggcaagagacagaggacacgggctgttccagtataataaaatataaaacaagaatagttacaccagatatagatcttagatatgattatatatgaatatcattaatcattagtttgtagcaattactttttattccaatattatgataatcctcgctctataatcatagcctaggaaaaaccaggccatacagagataggagctgaggggacatagtgaggtgtgaccagaaggcaagagtgcaagccttctgttatgcccagacagggccaccagagggctccttggtctagcggtgaagccagtgtctgggaagacgggaagacgcccgttaccaggcggatcgtggtccagcggtagcaaaaggtgtcaaggaacaacacccactacttagcagaccgggaaccggggggcgggggggcgggggtgggggttggtgtctccctttccccgggggagtttagagaagactctgctcctccacctcttgtggagggcctgactgatgtcaggcctgcccgcagttatccggaggcctaaccatctccctgtgatgctgtgcttcagtggtcacactcctagtctgccttcatgttccatcctgtatacctggctctgccttctagacagcagtagtaaattagtgaaagtactaatagtccctgatatgcagaaataatggcgtaagctgtctttgtgtctcctctccctctctgcctcggctgccaggcagggaagggcccccgtccagtggacacgtgacccacgtgaccttacctatcattggaggtgactcacattctttaccctgccccttctgccttgtatccaataaataacagcgcagcccgacattcagggccactaccggtctccgcgcattggtggtagtggtcccccaggcccagctgccttttctcttgtctctttgtcttgtgtctttatttctacactctcgtcgccgcacacagggggagacccactgaccctgtggggctggtccctacagaagtctgatgaggaggtacttgctgggatgtgttttaaacgtgttgaggtcacagtcactgaagagtgtgctttagaccagaggtggtcatgctggtcactagagtggggccttgcggcagtgagaccaccacggatcggaggcctggccgcaccctgtgtggtgaggggctggggaggtggtgctctctggttgtcagcggagggagtagtgatcggtgccacctttctgaatggcagttttaagtatgctgcttgtggattttaaatgtaatttttgtacttttgttttcttctcagtccagtcaacctgcaaccaaaacgagactttttagcacgcttgatcctgagctcatgttaaacccagaaaacttaccaagggccagtaccctggctatgacaaaagaatattccttcctgcgcaccagtgtccctcgggggcctaaggtgggcagcctggggcttccggcacatcctagggagaaaaaaacttccaaatcaagcaaaatccggtctctggccgattacagaactgaagattcaaatgcggggaattctgggggaaatgtcccggctcccgattctaccaagggttccctgaagcagaacagaagcagtgcggcgtccgttgtgtctgagatcagcctgtcccccgacactgacgaccgtctggagaacacctccctggctggagacagcgtgtctgaggtggatggaaatgacagcgacagctcatcgtacagcagcgcctccacccgagggacctatggcattctgtcgaagacagtgggcacgcaggacaccccctatatggtcaacggccaggagattcctgcggataccctgggccagttcccctccattaaggacgtcctccaggccgcagccgctgagcaccaagaccaggggcaggaggtcaacggggaggtgcggagtcggagagacagcatctgcagcaggtggtggggacagcagaggtgggcggggtgggtggaggtgggtggggccaacagaggggggtgtggggcgggcagaggtgggtggggcggtagcagaggtgggtggggccaacagagggggcggggtgggcagagacgggcagggcaggcagagggcctggcctgagatgttgcttcccgggcccacggctctccgcactggaacaggcgatacacagcttttcttcctgattctatccttagtcttgacatgaacatttaattcataacaagtctgctgctttttaatcagtagaattagatcagcaatggtctgtgttactaaaatatccagtctcccgtttacatagacttgtcactaagctgcacgacgcttgcatgtctcatgtttctgtaacagttcccactgcgtgaggtgccaactgttggcaggaatgttcatccgtgcatcatgcaagcctcagctctctacttaaatctcttacttaattttaaaaaattgggagagagcagcaggggtgtgtggaatttggagaatgtggaggagtgtgaaggaaaatgaggatggctcgcacaggcctgacccgtgcctttgtccccagcgtgtccttggagagctctgcagcagaaacacaggaggagatgctgcaggtgctcaaagagaaaatgcgactcgaaggacagctggaagccttgtcactggaggcgagtcaggtaacggacgttcgactgacatctcagcgtgcggcgaagtcggaaagcatgtgtggctcctctgttgggtacgaggtttcacagatgtggttgggaatcagccgccgcagcatgtgtggcagccgagggttctgcatctttacgttttttgtctacttgtcagccttagaaagagttgtgagttttctgcctcatcgtgcgtgggcgtgtttctccctgcgtctctaccagaatatttcctagatgttaggtgtctcacagtccataagagtcaaattctcttggtgggttgcagctttttctggcatggtgaaccttttttctttgtagtgatttctgctttttctgatactaattgtgctgtatcagagaaagctgcacacgctggcttggttagcatgtgccagaaacatcattttccatcccttatttcagctctcctttgtcattttgtcgtatgcactttatccacagtgaagagctaggtatttatcttctgtcggcagttgagtaaatctgttcagtggggttcagctgtccgcttctggcgtgggagggtgagaatgcacccaggccctgaggtgacacagctgagggagcctcctgtggcctgcgaggccgcagagcagggctggagctgctcacagtgtccggagcttgccttgctaaatgcacgcctcatgtcgaagatggttttctcatacaacatggtccttggacacaaaccaaccagtttgtgacacctaaagctgtgtctacagaagaggtgatttcggctgttttgaggctaattctggttgtacggtcgtcacttctccagtgttacagcgtgagcctccctccgtcggatgcatttcccctcctctgtgtagccactctctcgaacggtggcttgctgtcactgcactttgtcttcttatcctcttaggatcactgattggtccttcggttgcatccacaccaagatcgtgagggttgtttcaggtgtggtggttgctggccccttgctctagggtctcctggagtttgtggagttcctcaattgctttgggtgtttgttgtcttggtgatgtgtgaactggatccctgcccctgtaggcctcagcgtgggggcaggtggtggggcgatttcctctggcgattctctgctgctcctgggaccacacagcactgcggtggccactcaggactgtgctgtgtcccgtggctctggctggagccgcacttaggcagccgcctttccctgcctgtgttttttgcccatttccccccagatctgaatccgcttttaatctctcaggggtccctctacacgtctggcattctgtgtgtgtgcgcatacatgtgcacccgtgtacacgtttggtgttttgaacacgtttccagtgtcctcgcaggagacgggtgcttccccagccctgccctagcgctgccctgtgcaggtgcagttgggcccaaaaccagtgcaggctccctgtgcgtcctgggcctgtttggaaagtcgcctttttctgtgacggctgtgctgggagagcgcctgggggtctcggggtcctctgtcaggccttgggagagcgcctgggggtctcggggtcccctgtcaggccttgggagagcgcctgggggtctcggggtcccctgtcaggccttgggagagcgcctgggggtctcggggtcccctgtcaggccttgggagagcgcctgggggtctcggggtcccctgtcaggccttgggagagcgcctgggggtctcggggtcccctgtcaggccttgggagagcgcctgggggtctcggggcagggtcctctgtcaggccttgggagagcgcctgggggtcttggggtcccctgtcaggccttgggagagcgcctgggggtcttggggtcccctgtcaggccttgggagagcgcctgggggtcttggggtcctctgtcaggccttgggagagcgcctgggggtctcggggtcccctgtcaggccctgactgactcgctggttgtgttcctgttaatacactggatggaagtgactcgttttcttaaaatcattgtggttgttgggatcttttcaggcacttaaagagaaggctgagctgcaggcccagctggccgccctcagcacgaagctgcaggcgcaggtggagtgcagccacagcagccagcagcggcaggattcgctgagctcggaggtggacaccctgaagcagtcgtgctgggacctggagcgagccatgactgacctgcagaacatgctggaggcaaaaaatgccagcctggcgtcgtccaacaacgacttgcaggtggccgaggagcagtaccagaggcttatggccaaggtagaggacatgcagaggagcatgctcagcaaggacaacacaggtgaggctggccctggccacgccctcccctccctgactggtccctgctgctccctcctccttcctcgactggcccccgccacgccctcctccttccctgactggtccttgctgctccctcctccttcctcgactggtccccgctgctccctccttcctcgactggtccccgccacaccctccttccctgactggtccccgccacgccctcctccctggtgctgacagctctgtcggcatgtgactgtgcctgtgagggttgcattggtttatagtttacacataaggaggctgcttttctaaaggaaatacaagttttagttgaacttgtggaattgtgtacatttttgtgtgcacatccaggggaatgaattaggtcttggagattgaccttggaccctggagtatctgcggtgatcctgcctcaaaagtccagtgttatttgggagtatagagctgcccacttattccacagaattgcagattccatttaaaatattcaagaacagctccttgactgtccgtctggcaaccttttctccctggatgcagtgcgtcggtccagctgcctccctatagggctcgcccagagagtacaagtagggcagtggattgcggaagccgcggcgggcttccatgtggcttggcagcacgccttccaccccctcagtccccgcccgggccagtcccagagctcacactccagtgcccagcagacacggagaagactgtggttggcctgctcagagcaagcgtgaacaggagtgggaaggagagggcgaagcagggtgggaagattgaagacaaagcccgaggggtgtagagtgacccgggtccagagtcctcccagggaggccgcttggtgggctcatctctcaggtcttgggatctcctgagccaggggtccctggtgcagccgctgtgagggctgactccatgtgagccggtccgcctatgaggctgtgagactgggtcttggatgacacagaggaaggtgacaagctggcgtcacagaggctacattctaatactaggaaagagaaagccggccgagagacagtagtactcttgtaatcgctttaatattttagtccttgagcatttcgtgatacccaatcccttaggaaaaaccatgaaacccaaaaagttctcaacactaaagtagtttggggccctgtgggttgccacgcttcacttgaccagtgatcggggggtggcaaaaccaacctgaactttgatgaggccgcccagtcctaaccggtgggtttaagttggaattagccacacggatacccttgctgtttgttgatggctggtagacatcgttgggtcgaagacagagcctcggcgtccatgaccattttcacagatttcctaagtgtgaatttgccgacttgattaaatttgtttgaaccacaaactcagtattcatggacacgtgtggagcagcagagtacgtgagtcatcctaggcgcccgctgaggagggcaggatactctgcctgccttggtgctcagccgggctgcaggcaggagttctttccagggccatgtttacatgtttgtgctttggggggtaattttgcagttaaagatggccccaaacactgtctagtgtttttttttgttgttttgttgttgttgttgttttgttttgtttttgagacggagtttcactcttgttgcccaggctggagtgcaatggcgccatcttggctcaccgcaacctctgcctcccaggttcaagcgattctcctgcctcagcctccctagtagctggtattacaggcgtctgccaccgcgcccggctaattttgtatttttattagagacagggtttctccatgttggccaggctggtctcgaactcccaacctcaggtgatccgcccgcctcagcctcccaaagtgctgggattacaggcgtgagccactgtgcccggccaacactgtctagtgtttttaaacacagagaggatgtgaggtgtttcatggagaagatgtacttcatttttttcttttggtttatttttttcaattcatcctgtttctatttttttaaattttctttttgtttttaaaaattcatttgtctttgagatgggttgctctgttgcccacgctggagtgcagcagtgcagttgtggctcactgcagcctcaaactcctgggctcatgggatccgcccgcctcagcctcccaagtggctgggaccacagatgcatgccaccccgcctggctaattttttttttttggtggtgggggatctcgctgtgttgcccaggctggtctggatctcctgggcgtgcacccctgtgccccctgcaccccccatgccccctgcacccccgtgtccggccactgttatttcctagagaatctttgctcaggcttgttggtcaagttgctgttggccgtgagctcggtgtgaatgaatcgacgctatgtattagatcggtgtcgtaaatggaaacactgaacagaggttatgtattgatgagctggtgaaggtgctgtgagcagaggcctgcaggaacctcaccctgcatttctgccaggagcggcatctctcagcgcccactaatgccgtgttcacggcgacttcatggagtcagctatggggaataaccggaactgactcattcttggtctcccctgagagtcccgccttgtgtcccgcacgcgcggagctgcggactcccccgttggccgtcgctggcctgagccgctgtgcttgccccatttcagtgcacgacctgcgacagcagatgacagccttgcagagccagcttcagcaggtgcagctggagcggacgacgctgaccagcaagctgaaggcgtcgcaggcggagatctcgtccctgcagagtgtccggcagtggtaccagcagcagctcgccctggcacaggaggcccgcgtcaggctgcagggtgagatggcccacatccaggtacggcccacatctaccttccagggcaggtcacgcttcttgtcttcatgtagaacggtgctttttcctgagatttttctgtttttagagttcacaggcatgtttttgtttttaacctgctgtccagcccaccccgtgtcccatgtaggacgtgtcgtatgcaggacgtgtcccgtgggcccccccccaaccttctgacatgggagtcccacggcagcctctgccagcattttcagttccaaagcctctcttgctgggcatggtgacacatgccggtgaatcctcatttgcctgggtctcgggaccctcccaccctggcctcctgactcggcacagtgttgcgtgcctgtgaatcctcatctgcctgggtctcaggaccctcccacctcagcctccccactctgctgtgatgtctcacaggcgtgcggtgccagtggggttctcttcccggttggagcttttcctttccctgctgcctgagccctcagtgatacacggggaccacgtcttcccagcaggccttgcattttctacgtcctgttggaaaactctttcctctcccgtccactcgttagcgggcacagcccatgtccagcttggtcccgcatatgtgggagtgtgtgtccgtccaggcctgtgcctcggcccacagcaactgcttcgtgtgctggagacgcccagaccgacaggcgaatggttcgagtgcacctcgatccgagtctcagcacctagactaattaggatgacctcagagatgctgaagagtacctttggtcagcctcagtctttttgtttttggtttttttttgagactgtgtctcactccgtcacccaggctggagagcagtggtgcgatctcagctcactgcagcctcaacctctcagactcaagctattctcctacctcagcctcttaactagctgggatcacagacatttgccaccatgcccggctaagttttgtactttttgtagagacaaggttttgccatgttgcccaggctggcctccaactcctgggctcaagtgatgcctgcctcagcctcccaaagtgttgggattacaggcgtgagccaccgcacctggcctgttattttttaattagctgtggaatttttttttcccagataaaatattataaatttattaaaactttatttctcaagaggggaacgtgaaatactaattccaccaaatgttccttttacatctagagttacaaatatacacaatagaacttttcttcaattttcgttacttttttgtttgttttgagatggagtcttgctctgtctcccaggctggagtacagtgttgtgatctcagctcactgcaacctctgtctcctgggttcaagtgattctcctgcctcagcgtcccgagtagctgggattacaggcgcccgccaccatgcccggctaatttttgtatttttaggagagatggggtttcaccatattggccaagctcgtcttgaactcttgaccttgtgatccgccttcctcagccttccagagtgctgggattacaggtgtgagccaccacactcgactgttacatattttttaagccaaagaacaatacggaaaagcatttgttctacttacaacatagcttggaaacaaatcagtatacaaattaatacacttttttacagctgcagtgcatttatatgaggtatttaaagacgtaggccaagccaggtgtattttagaagtatagtttgggccaggtgcagtagcgcatgcctgtaatcccagcactttgggaggccgaggcgggccgatcacttgaggccaggagttcaagaccagcctggccaacatagcgaaactgcatctctactaaaaatgcaaaagttagccaggtgtggtggtgagtgcctgtagtcccagctacttgggaggctgaggcatgagatgtgcttgaatccaggaggcagaggttgtagtgagccaagattgcgctgctgcactccacacttcagcctgggcaacagagccagactttgtctcaaaaaaaaaaaaccaacaacaaggaagtatggtggtgtagcctggacaacaaaaagagaggaagctttaaagcaatggtggctccagagccctatctgctgttttttcggagacagggtcttgccctgtcacccaggctgctggaattcagtgttaccatcatagctccctgcagccttgacctgttgggctcaaacagtcctcctgcctcagccccccaagtagctgggacataggtgaacaccatcacacctggctaattgtttaaaagttttctgtaaggacagggtctcgctatgttgcctaagcaggttttgaactcctggactcaagcgatcctcccagcgtgctgggattacaggatgagccactgccgggccctcactgctttttccaaatacctttggaacccaggttcagcattccttaatcagagtttttaatacatttttttggtacccaaatgtatcccttcattcccagtaacgttcaggagggaggagaattccaggcagtcagtctgctttcatggtctcgaaacacagtcccagcaaaggctgtcttccctggctccgtgcaccttctcctgaggtcctggagcgtgtggcttctgtcacgtctcgcactgtgcactccaggaagcagcatggagctagaggcgatgcgggcaggtctagcctcaggccccaggctgtcctcacacctccttttcagtgctacttcccttggctgacgccgtcctcctcagggccatggtcctgggctttttcacgagacgcttggccagcgtgggcctgagcacctggaggtctgggccgggccctagctggctggaaaggctgtatccctggaatggcacctgtcgggcgtctggctgagggcaggccctggtgtgtgtctggctggatttgttcagttaagataaggctcctcacctacaggggctcagagatgcccctcctcacccacaggggctcagagatgccttgtcaatggggacttttgggtaggtcctgctacaaaccgcagtctgatgagctacaaacagcatgatgagcgctggctgatggcccgcccgccctcccactcaggcacgcagagcccagacagcgcatattttgagatgggaagacgtgtagtgggtagtggggcttgcgtgggagacactgagggggcagccagtgaccctcaccctggggcctccagggacaggctggtctgcatttcttgcttgaaattgagcaactttttactttgtgggttttttttttaaggttggacagatgacccaggcaggtctcctggagcacctgaaactcgagaatgtgtccctgtcccagcagctgacggaaactcagcacaggtccatgaaggagaaggggcgcatcgcggcacagctgcagggcattgaggtgaggctgcggccggggccgtggaagcttaggagaacagacgcagacatcgataccatgtgtgttttcttacatgttccgtctctctgtgtgtatctcttaaatattctcatggatggcgggcagtgactgctcgttaaggctttgggaccccccccccacccctcatccctcacctgtgggggcttagcatggatggcctgcagtgactgctcgttaaggctttgggaccccccccacccctcatcctcacctgtgggggcttagtgcagtgagcacttgcggctcttttcctgcaagccccgccttgggcctgggcccccggctgtcagtcattgccagtcagggatggcgctgggtacagagtgggtacggaggaaggggccagtgcgtttttgcctgacagcctgtcgaagcctagggatgagaggattttctttgcttactgagcactcagactgcattgccatttaaccctccagcaaccacacgctgtcgaggtcatggccgctgcctgcacagccatctccagaggacagaaatgcagcagccttgatagctgttctcctttagctgtggggcgctggacaatttcttacctctctgagccgcatcttttttttttttgaggtggaattttgctcttgtcgcccagggtggagtgcagtggtgcgatcttggctcactgcaacctctgcctaccaagttcaagcaattctcctgcctcagcctcccgagtagctgggattacaggcactcgtcaccataccctgctaattttttgtatttttagtagagacggggtctcgccatgttggccaggccagtctcaaactcttgacctcaggtgatccgcctgcctcggcctcccaaagtgctgggattacaggcgtgagcctcatctttataaaatggggatagtgtcacctactcgatagccttgtggaaaaattaaagaagaagaaatggtgtaaaaccccaaggcagtgtatggagggaggttctgtgctggatgttgctgggctggtctcgttgccgatcttgccagttgtacagggagctctctgcagcctcacgtggtttctcatctcctgcgactgctcccacctctctgtggcattagctgggctgcccggctgggatgagaagaatcacgttgcgtcagccatagtgcttcaagggcttagtagagaagaactgaaaagaatttcaagtttcaagttaggaatttgtgttttccctaagaagtgtaccccgatgtgaggctgtgttcactgcgggggcctctggtctcttacccggtagcaccaagcaccgctcttgtgagagcatgtccgggtctcactcccgaaaggaggcagctgtcgccacacgagaaagtcggggaggctctgctcaccagtgggtccaagtccttctcatggggttgctggcctgggctgggcctggcctcggtctcctggttggggggcggccaagctgcccatcctgggccctcagtctgcagtcggtagacaggatgaggaggtggatggggcccatgccagggcggtgggtttctctgcagagcacggggccaccggctgctgttcactattaaggtttcctgcctttttaaaaacaagtttcctgggctcaggctgacatgttggatcaggaagcagccttcatgcagattcaggaggcaaagacgatggtggaggaggaccttcagaggaggctggaagagtttgaaggtgagagggagcggctgcagaggatggcggactcggcggcatccctggagcagcagctggagcaggtaagtccctgcagcccttcaggctggacccaggccccaggtgatcccgagcagccaggactgcacacaaggagaccgagcagtcctctgctgtggggccacgtccgctcaggtgggagttgggctgtcggtcagacgctgctgctgctgcagacctgaccctgtgtttgccctgctggttcttctataccaggattgtgcgtgaaaaaaagaccctccatagtgtccatcaaaattacttgaaacccgaacaggaaaagggcatacgctctcggaggagggtcaggcgcagccatgtgggcttcattccttctccaggtgaagttgactttactccagcgagaccagcagcttgaggctttgcagcaggagcacctggacctgatgaaacagctcaccttgactcaggaggctctgcagagcagggagcagtccctcgatgccctgcagacacactacgatgagctgcaggccaggctgggggagctgcagggcgaggccgcctccagggaggacacgatctgcctcctgcagaacgagaagatcatcttggaggcggctttgcaggcggccaagagtggcaaggaggagcttgacagaggagcaagacgcttggaagaaggtaccgaggaaacgtcggaaactttagagaagttaagagaagaattagctatcaaatccggccaggtaatgcattctgctgtgttttgttttgaatcagaaccctccttgcaggaatgatgctgattatttgcttctttctttctttcttttttttttgaaacagtctcgctgtgttgcccaggctggagtgcagtgggatgatctgcgctcactgcaacctccacctcccaggttcaggcaattcttgtgcctcagcctcctgagtagctgggattacaggtgtgcgccaccatgcccagctaatttttgtatttgtagtagagatggggtttcgccatgttggccaggctagtctcaaactcctaacctcaagtgatccacccgcctcggtctcccacagtgctgggattacaggctgaaccaccatgcctggctaatttttgtatttgtagtagagatggggttttgccatgttggccaggctagtctcgaactcctaacctcaagtgatccgcccgcctcagtctcccacagtgctgggattacaggcctgagccattgtgcccagctaacttttgtatttgtagtagagatggagttttgccatgttggccaggctagtctcgaactcctaaacccaagtgatctgcctgcctccgcctcccacagtgctcggattacaggcgtgagccaccgcgcccgaccccttttttctttttttttttttttgagatggagtctcactctgtcgccaggctggagtgtagtgcggtgatctcggctcactgcaacctctgcctccggggttcaagtgattctcctgcctcagtctcccaagtagctaggactacaggtgcatgccaccacacccagctaatttttgtatttttagtagagatggggtttcaccatgttggccaggatggtctgcatctcttgacctcatgatctgctcacctcggcctcccgaagtgttgggattacaggtgtgagccacctattctgtctttaaatcccactctataaggatcaagggcaagaggaaatcatgagcctgttttccctcctttctgaaggaagctgtcactacaaacactgacctgtactaagtgattttctagtaaagaggcactcagacaggtcattactgtttacagtgttgggggagtaaatttagaggaattgtcccaattctgtggatgaatttaaacttgattttactgaccattagctcagtaagaaacagctgatacctggaagactgcgagagagacttttgtggagctatatgttatttctcatattggaattttacctgtgttgtcattactggcagttatttaatccaagttaacctctgggttgggctgttttccccagggcagatgaaggtggtggtagcagtgaccttgtcttggaagctgccttcccagctctgaagtctgttttccacctggggaccatagtcagccgactgggagacggactggcctcctgggcctgcctggtgttggccactctgcctggccttgtcggaatgtgcacacatccccggccatctttttttttttttttttttttaaatagatacggggttttgccatgttgcccaggctggtctcaaactcttaggctcgagtgaactgcccgcctcagcctcccgaagtgctgggattacaggcgtgagccactgcattccctaggcatctagacacagcagtatccacgtgggggctgaggtttctctgaccatggctccctgtttgctgagttccaagtctgttgcccactgtgggagccgctgtgggaccaggggcaggtgacgtgaggatcatcggaacggatgaatgatgcgtgtggaacaaccagcactttgatccttcgcaggggggctcctgagggaccgccctccatattgtagggaaaaaggctcattcttcagtcatgctctagtgataactaggatttgcatgcagtgtgttctgtattcagacagaaaacctaggccctaaacaagctcttccctatttctggagtcggccgccccatgtgtgtgtgcactgagagctgtttgctgaggtagagaagtgtttcacaaacacatggattcctgagtcctccgggaccctccaagtgcaggtcctgtgccgtgggtctgtatggagccctccgagtgcagatcccgtgtggtgggtctgtgtggagccctccgagtgcgggtcccgtgcggtgggtctgtgtggagccctccgagtgcgggtcccgtgcggtgggtctgtgtggagccctccgagtgcgggtcccgtgcggtgggtctgtgtggagccctccgagtgcgggtcccgtgcggtgggtctgtgtggagccctccgagtgcgggtcccgtggggtgggtctgtgtggagccctccgagtgcgggtcccgtgcggtgggtctgtgtggagccctccgagtgcgggtcccgtgcggtctgtctgtgtggagccctccgagttcagatcccgtgtggtgggtctgtgtggagccctccgagtgcaggtcccgtggggtgggtctgtgtggggccctccgagtgcagatcccgtgtggtgggtctgtgtggagccctccgagtgcaggtcccgtgtggtcggtccgtgtggagccctccgagtggagatcccgtggggtgggtccgtgtggagccctccgagtgcaggtcccgtgcggtcagtccgtgtggagccctccgagtgcaggtcccgtgcggtcggtccgtgtggagccctccgagtgcagatcccgtgtggtgggtctgtgtggagccctccgagtgcaggtcccgtgcggtcggtctgtgtggagccctcggagtgcaggtcccgtggggtgggtctgtgtggagccctctgagtgcaggtcctgtgcggtgggtctgtgtggggcccgaggctctgcatttctcacaagctcctgggctgaatgggctgggctccaacagactttgcaggacaaggaccagagcctggggtcagcaccctcagcctgtgggcgcagcccaacaccgggttctgtaaactgtcactgtaacagccctgctcgctcgcctgtgctgcaagagcattgctgagcagctgtgactgacgtgcagcctgtgagctgcagtcttttcccatcaggcatctccaagaaaggcttgccgagccctgggctgcagtgtcccctggcctcatcccctctcccacctccctgccactcactgtgccttcatgctgtcagtggtgaggagggagagcccaggccttaggaaccaccagttcccgtcagaacacaagtgcttcttcctataacatctgtgcagatgtgtgccctcctggagccatcagtgtaatgtctgtgtagttgcatccccctcctggagccctcagtgtaacatctgtgtagatgtgtccccctgctgtagccctcagtgtaatattcatgcacatgcatccccctcttggagccctcagtgtaacatctgtgcagacacattcccctcctatagtcctcagtgtaacaactctgcagatgtgtcctttcctggagccctcagtgtaacatctctgcagatgtgtccccttctggagccctcagtgtaacaactctgcagatgtgtcctttcctggagctctcagtgtaacatcgctgcagatgtggccccttctggagccctcagtgtaacatctctgcagatgtggcccctcctggagccctcagtgtaacatctgtgtagatgtgtccccctgctgtagccctcagtgtaatattcatgcacatgcatccccctcttggagccctcagtgtaacatctgtgcagacacattcccctcctatagtcctcagtgtaacaactctgcagatgtgtcctttcctggagccctcagtgtaacatcgctgcagatgtggccccttctggagccctcagtgtaacatcgctgcagatgtggccccttctggagccctcagtgaaacatctctgcagatgtgtcctttcctggagccctcagtgtaacatctgtgaggatgtgtcccctcctggagctctctgtaacatttgtgcagatgtgttcccctcctggaggcttcagtgtaacatctgtgcagacagattcccctcctggagccgtcagtgtaatgtctgtgcacatgtctcccacaggtggaacacctgcagcaggagactgctgctctgaaaaagcaaatgcaaaaaataaaggaacagtttctccaacaaaaggtaaaaatctgttgttgatttcttcacttgaaacaagcatatgaacagagttttctgtggtttaattgcttagcaattccaatgtcattgaagttgagaagaaggtaacatcttgagttctctttaaattttttttttttttttttttttttttttttttttttggagacggagtctctctctgtcagccaggctggagtgcagtgacgcgatcttggctcactgcaagctctgcctcccgggttcaagctattctcctgcctcagcctcccgagtagctgcgactacaggcgccctccaccacgtccggctaattttttgttttttgtattttgagatggggtttctccgtgttagccaggatggtctcaatctcctgacctcaggtgatccaccctcctcggcctcccaaagtgctgggattacaggtatgagtcaccgcgcccggccctctttaactttttttaaaggtacttaatctgcaaagtcaagacacacttccacagtggggtgggggtcttggcccctcagatctccaggggcggctgtcactggagcgcctgtcagcataccctgttgtgctcactccagggagctgtgtgttgtgcagtgttgttaacacacaggttgggtttgccatttaaaatgtctttgaaaaatgcacatagagttccagcattgaaacaaattttggttatccaaaaagacatggaatataaattttgtgtcagtgaagccagtacctcctgttggattttatgggatctgagcaagggtgaccccgaagctatattgtgagtgctgctgtgttttatttctgagcgagggtgacccctgaagcagcgttgtgagcgctgctgtattttattttattttatttttgagatgaagtctcgctctgtaccccaggctggagggcagtggtgcgatctcggctcactgcaagctccgcctcccaggttcacgccattctcttgcctcagcctcctgagtagctgggactacaggcaccggccaccacgcccgactaatttttttttgcatttttagtagagacggggtttcaccgtgttagccaggatggtctcaatctcctgacctcgtgatccgcccaccttggcctcccaaagtgctgggattacaggcatgagccaccacgcccggcctgtaatttagtttttttgagacagagtctggctgtgtcgcccgggctggagtgcagtagtgctgtctccgctcactgcaacctccaactgccaggttcaaatgattctcatgcctcagcctcgtgagtagctgggactacaagcatgcaccaccacgcctggctagttttttgtatttttagtagagatggggttttcaccttgttggccaggctggttgaactcctgacctcaggtgatcagccagctcgggctcccagagtgctgggattacaagtgtgagccaccgcgcccggcctgctgtattttatttctgagagtgctgggattacaagtgtgagccaccgcgcccggcctgctgtattttatttctgagcaagggcggcccctgaagtggtgtcgtgagtcctgctttgctttattactgagccacaagcaaggggattacctgttggaagcaaagccgtgcaactgaagtcaggagagagccagactccttggaatagaggagacgtctatgaggccggtgtgactgccttgtgcaccacgcagtctctcaacaggcagtgatgtcacctgtggataaacagtggtgtgtctcagtcgatggagtcttagatttgatgaaatgtatctttacctcaaaaaagttatgcccccgataagtggtaaacatttttgttgaagccagcttgacccccaggtacgccccccacgccccgccgcccagcgtccgctcacagcctctgtctttggcaggtgatggtggaggcctaccggcgcgacgccacctccaaagaccagctcatcagtgagctgaaagccaccaggaagaggctggactcggagctgaaggagctgcggcaggagctgatgcaagtgcacggggagaagcggactgccgaggcggagctctcgcgcctgcacagagaggtggcccaggtccgtcagcacatggcggaccttgaagggcatctccagtcggcgcagaaggagcgagacgagatggaaacacacttgcaggtctgtccgtgtcgggttgactcatttgatggggaggattcggccaaagtgcttgtcgggagggtggggcctgtgtctggggcggggcctgtgtctggggcggggtctgtctggggcggggcctgtgtctggggtggggccaaggtgggagaggcttttggaagaacagctgggaacaaggcccacctggagcataggtcccagaggggcagtccggtgaggcctggtaagtccaggtggtgatggtgcatgaagggagggagtgaggaggccccgtgaggcacccagcttctccccattgccatgggctcccgggatctagcatgtgagaggacagcggctgtcatgcagaaagcaagggtgagtgttttgtggagaccccacgtcagggcagggcgtcggggcccggggaccctgggagtccctcgtggctgagtgcggagctgggactgaccagagctagtcatgttcctgtggaagctgagcctgggctggcttctgcacacagtgggtgtccgagatgctggtgacagtttctcggctgcaggtagcagagcaggtgaggggtagaggcgggggacggaggccgcagtccaggatcctgtccagacatccaggctgaggaaccgggaggtgagacgagaaatcaggagagcaacagtaaatttggggagagtcgtctgatggcacgttagaccaagtgctacgttttgcttatgaagtttctgaagttgccggagaggaccgagccaaggtcccagcaggcagattggtcagcatgtctggctcattaggagccaggctgaggcctgtgagtaggcggtgtggccggcaccatcattgttggaaagtgagggctgatggattagcgctggtgccggggtggggaggtgggccaaggggagggccggctctttggactgtaggaggcttggaggactcagcagtgcgggcagagcacgttcggaccccacagctgcaggcctgggctggttgtggggactcgcctcgcacacaggagctggggaaaggctgcgagggcaggagcaggtcggggacgcggccctcagtgttcacagttgatcctgaggagggcatccggggggggtccagggaagggtcctggggtctcaggaagggtcctggggtctcgggaaggggtcccggggtctccggggaggggtcccggggtctccggggaggggtcccggggtctccggggaggggtcccgtggtctccggggaggggtcccgtggtctccggggaggggtcccggggtctccggggaggggtcccggggtctccggggaggggtcccggggtctccggggaggggtcccggggtctccggggaggggtcccggggtctccggggaggggtcccgtggtctccggggaggggtcccggggtctccggggaagggtcccaggggttctggggaggggtcccggggtctcaggaagggtcctgggggctctgggggaggggtctggggactgtggggaggggatccaggggcttgtggggagggttcccgggggctcttggggaggggtcctggggtttcctaggaggggtctggatccttgaggaggggtcctaggccttggggagggttcctggggccctggggaggggtcctgggtcctgggggtttggaggagaggtcctgggtccacaggctttcctatgaaccagtcatgtcctgttgtgcctctgatgctctggacagtgtttggaaatgcttgttggtctcagtaatgagtggtttgtggccgggtgcagtggctcacacctgtaatcccagcactttgggaggccgaggcaggtggatcacgaggtcaggagttcaagactagcctgaccaatatggtgaaaccctgtctctactaaaaatacaaaaattagctgggcatggtggcgggcacctgtagtcccagccactcgggaggctgaggcaggagaatcacttgaacctgggaggcggaggttgcagtgagctgagatcacgcccctgcactccagcctgggtgacagagtgagactccatctcaataaaaaaaaaaaagagtggtttgtaagaaggcagacgtctctctcaggatttttctcaaggcccaagtcctccagggcgagcctgagcagtgcctttggtgggggtgatgggctggagccaggaaggggagacaggctgggggtggcagtgccgctcctcacgccctccttcccttccaaagtcgttgcagttcgataaggagcagatggtcgcggtcacagaggccaatgaggcgctgaagaaacaaatcgaagagttgcagcaagaggcccggaagtaagtctgcatgtgcccgggggaggtgcgggggccaggtgggaggtgcgggggccgggggggaggcgaaccagaatgccagacggtcacatcgggataattcagcttcctcctgtgtctccctcatgacaccccagggccatcacggaacagaagcagaagatgaggcggctgggctcagacttgaccagcgcccagaaggagatgaagaccaaacataaggcctacgagaacgccgtgggcatcctcagccgccgcctgcaggaggcccttgcggccaaggaggctgcggacgcggagctgggccagctccgagcccagggtggcagcagtgacagcagcctggctctacatgtaggtaacaccgtgccatccccggccagggtcaccagcccctcagtgcagggaagggctctccatcagcagttgtcccctaaagcctagcggggccgagctcgcgtgggaggtggcaactctctaaactcccgctcatcttcgaggttaccaggaacccacagtgactgagcattgcctcgcgtctccctcatgaaccccacatggcctgtggcctgtggcgttcacctgattttcctcaagaaatctccttggctcagagaagttcagctgctcccttggggcagagggagggcctgccctggtccgctcgcgttccagctgcctctgcgcctcctcgcatctcaggaggaaaagcagcctccgcactcactgagaagcaggagtgagggcatggggtcagcgattgacagggttcagggagcgtttagaggtagccatgctgcggtggcccagaacaagcgggtgccctttctggagggctctgagcagagccttccgtggaggccgtggccctccgtgctctgtcacctttcgtggtaggcataacattctacctgagtgagttcatccgcattttatttattattctccaattcacgtccttgcactgacaacttagtatttcttcttatatgtggtttgtttctatctcctgtccacttaagaatttatgggtaggaagagactgtatcataacgtggggttttcttgtcaaataaactcggccgggcacggtggctcacacctataatcccagcgctttgggaggctgaggcaggaggatcgcttgagcacaggagtttgagaccagcctgggcaacataattagaccctgtatttacaaataatacaaaaataaaacccaggcatggtagcacgtgcctgtggacacagatgcttgagacactgaggtgggaggatcgcctcagcctgggaggtgaggctgaaactgcagtgagtcatgattttgctgctgcactccagcccgggcgatagagactctgtgtctgaaattcaataaataaatcaagtgcttcctctcacctggttgctttgtaaaatgttggggagattgattcagttgccattttctttgggctcactaagggctggggtggggaggtcgcaaaggccgggcagagctggcccctcgccacgctgttgcagctgaggaatagcacagctgcgagccgatgtcttgtgtccgtccgggcttcacccctcgcaagtggtgacttttggcaaatttctcacctttttgatcctcagcaaaatgaggccaaattgaggtgaatgagaaccttctcatgtaagggttaagttaggtggtactggaacatgcttggcaagggcctggtaccatcgaggcagcaagtgggcggggtgtgagagcacacctgtgcctgcatgtatccgtgcatgtgtgaggtgtgagcatgtgtgtgtgcagcgtgtggagtgtttgtgtgcatggtgtgtgggatgtgagcatatgtgtgcatgcagtgtggggtgtatgtgtgcatgcagtgtgaggtgtgagcacatgtgcatgtgtggtgtggggtgtgaacacgtggggtgtgagcatgtgcgtgtggggtgtgagcacgtgtgtgtgtggtgtgtgggatgtgaacatgtgcacgtggtgtgtgttacatgagtgtgtgtatgtgatgtgtggtgcgtgagcacgtgtgtggtatttattacaactggtgctgcttgcttgccacagatggtgatttatagccattatctgcaggtcagattttcttctgtatttttgaagcattgaactgaagagatgattttgtttgtcccaactatccccgtgtgtcatcgtgtgcatgctgtggtcggttaattcaacttctttaacaaaaaggaaggttgtgagactgtgtcagacagctggtgtctggtgtgtgcagccacacagcctcatgcctgccggcaccacaggaagtgaggggggtcagggcctgtcccatgaccaagcgcccgttccatcttggcccttaggaaaggatccaggccctggaggcggagctgcaggctgtcagtcatagcaagacgctgctggaaaaggaactgcaggaggtcatagcgctgaccagccaggagctggaggagtcccgggagaaggtgctggagctggaggacgaggtgaggcctggccatctgctgtggcggcagcgtggggcaggtcacgtgagccctggacatgccgccacgcgtgagacccgaagaacaaaacttcaccgtgtgcccagcgttgctacttttggtgttgccaccttctgaccgtcggcctctggctctgtggtggggcaggccctgattccagccctctggggaggatcactgtacagcctctttggtggagtggttacagaattcatagtggaacccttctcagttcaaatgctttggttgcaaataagaaacccaacttcgccaggcgagtggctcatgcctgtaatcccagcactttgggaggctgaggtgggcggatcatgaggttaggagctcgagaccagcctggccgacatggtgaaaccccatctctactaaaaatacaaaaattagccgggtgtggtggcgggtgcctgtagtcccagttacttgggtggctgaggcaggtaaaccgcttgaacccaggagcggaggttgcagtgagccaagatcgcgccactgcactccaggctgggcgacagagtgagactccgtctcaaaaaaagaaaaacgtcagatatctcaggttcagagacagttctcgcttcagcgctgctggtggcagctcagtgtcccggcgccccccactccccagcccctccctgtggagctccgtcacagtagggccgcctgttccactctctggctgtgtcctgccctgaagtggttttgctcatgcccaccctgctgagtggcctagccagggctcagtgcctggacagacttctccagaagcccatggccccaggagaaggctgggctcttggccatggggaggaatgagaggggcctggggaagcaactgaccatgaccacgacagccttcagatcatgaagcaagcacggtcctgtggtgtccatcgcagggttgtgtggtgtccattgttctttgtttttgttgtcttgagacagagtctcactctgtcattcaggctggagtgcacaatcttggctcaccacagcctccacttcccaggttcaagtgattctcccgcctcattctcctgagtagctggaactacaggtgatcgccaccacacctggataatttctgtagttttggtagagacagggtttcatcatgttggctaggctggtctcaaacccctgacctcccaaagtgctgggattacaggtgtgagtcactgcgtccagcccattgctgtgttttagttttcgatgtttcttttcttttctttttctttttttttttttttttgagacagagtctcgctgtgttgcccaggctggagtgcaggggcacaatctcagctcactgcaacctccacctcctgggttcaagcgatccttctgcctcagcctcctgagtagctgggactaaaggcatgtgccacgatagtggctaatttttgtattttcagtagggacggggtttcaccatgttggccaggctggtctcaaactcctgacctcaggtgatccccctgcctcggcctcccaatgtgctgtgattacaggcgtgagcctctgcgcctggcctaagttttcgctgtttcttgttgaaaactcacctgtttctggggtatgtgaactccactcaccagtgcaggtaattttacagtgacattggtatgtttcagcttcaagaatccagaggctttaggaagaagataaaacgccttgaggagtcaaacaagaagttggctcttgaattagagcacgagaaagggaagcttacgggcctcggtcagtccaacgcagctctgcgggaacacaacagcatcctagaaacagctttggccaagagggaggcagacctagtccagttgaaccttcaggtattcaaactcgtcaaactcacgccagcaacggtgtgagagttggtggggctgtgcgcactccgagaatctcatccagattcagtcacctgtgctgactcctagcccacccggcctgcagccgagagaacaggctcaggagtccgggtgacccacggccctgggtccccagctgttggtgcagggctgggctctccgaggggaggaacaggctcaggggtctgggtgacccacagccctgagtccccagctgttggtgcagggctgggctctctgaggtgaggctggagcccctgcgtgtgctcagttcacctgtttagttgaggggcagacctgcttagtcggggggcagacctgcttagttggggggcagacctgcttagttgaggggtagaccttccatgtgggtgtggctgagttccagtcccagacggtgacattgtttgtagggggcacttaacaagaggttcacacaattcagaactgggacttgaaccctgacctggttctcactcagctacttagtctccacagcctctctgaattgaggactaggctgggcatttcagggaaatcctgggggccaaatcgagctgctggtgttgactatcccatcttagttccatattttgccctagttcccaccacttctgttctttttgtacccggctgcagcccctgatttgtatgtagtttttgagttcccagccaccatgttccatttttttgttgttgttgttgttagtaatacggagtctcactctgtctctcaggctggagtgcagtggcacgatcgcggctccctgcctcccgggttcaagcgattctcctgcctcagcctctggtatagctgggactacaggcgtgcaccaccgcgcccagctaatttttcatatttttagtagagacaaggtttcactgtgttagccaggatggtctcgattttctgactgtcatccgcctgcctcggcctcccaaagtgctgggattacaggtgtgagccaccgcgcccggcccattcttttttttttgagacagggtctggctcttgcccggagtggagggcagtgcggtggtaccatcatagctcactgcatcctcaacctcctgggctccagcgatcctcctgccctggcctctggagccgtggggcccacaggtgtgccacgttcttgagtgcggccctgtgatcatgctcccgcaacctaggattctgttttgtcacagattcttcagcagtgaagttccctctacctccctggcgtgtgcctgtgatgtggcgtgtgtcacgttgcctgctgtagcagccttgtgtgtttgtaattcgacgtccttccttatctgtcctcctgcaatctgatctaggtgcaggcagttttgcagcgcaaagaagaggaggatcgccagatgaagcatcttgtccaggccctgcaggcctcactagagaaggagagggagaaggtgaacagcctcaaggagcaggtgcgtgccaccttccgtctcacagggcgttccagaggacgctccagtgcctagaaatctatgcagggtccttcacacaccagcctccttccagcagttacacagagcaaaggtgtgttgcagttgttggtgacggaggccgcagagcacctgctctggtccgtagaaggtggcgttagattaaatggcagtgcagctgtgagggcctggggccaatgagctccgcgtgcatgtgtatttatattgtgctgggagtggtgtcctgtatgtcgtgttgcattgcaaaagcaaacttgagaatagcatatgatcccatttgtgttcggcagataagaggggtggttctgtggacccttctctgtgtagagagctgtcttttcgtggctggcccctgccctgcttcaggtgttcactgacacgttggtcacgtcgccagcagaggcccatcctgacccccaggtgccctgtctgggccctgctcctctgttagaacgctgctgcttgctggctacctccgccatacctggcacagagcagctactcctagtacgcttgccgtgtgtgtgcacatggggggtgtgcgtgcacgtgtgcctggggtgtggtgtgtgtgcacgcggggggctgtgcatgcaagtgttgtgatgtctgtacacacgtgtgcctggggtgtgtgcacgcggggggctgtgcgtgcaagtgtgatgtctgcacacacgtgtgcctggggtgtgtgtgtgtatgtgcgcgggggggtgtccgtgcaagggctgtggtgtgtgtgcgcacgtgtgtgcctggggtgtgtgtgcacgcgggctgtgcgtggaagggttgtgatgtctgtatacgcgtgtgtgcctgggttgtgtgcatgcggggggctgtgcgtgcaagagttgtgatgtctgtacacgtgtgtgcctgaggtgtatgtgcgcgggggggtgtccgtgcaagggctgtggtgtgtgtgcacacacgtgtgtgcctggggtgtgtgtatgtgcacggggggggtgtccatgcaagggctgtggtgtgtgtgcgcacgtgtgtgcctgggctgtggtgtgtgtgcatgcatttgatgctgatgtatatgtagaaaatttctaggaggaacacaagaaataactggttgtctctagagaaaggcaggaaagaacacatcacttttcctttaaatcccgtttgaattgaacttgtaaaaaagtaattgcttcacaattcaaacttttcggcctaacagtgaagctgctttcgttcctatgacctggctttgccacaacctttaagaacttttctatgataatgtaattgagatgaaaagaaaaaggttcttgattttttttaaggggtgaaacaacaaagtttctttataaatagaattaattttaagatgtggcaggtggctgggcgcggtggctcatgcctgtaatcccagcactttgggaggctgaggcaggcagatcacctgaggtcgggagttcaagaccaggctgaccaacatggagaaaccctgtctctactatgaatacaaaattagcctggcatggtggcacatgcctgtagtcccagctactcgggaggctgaggcaggagaatcgcttgaaccaggaggcggaggttgtggtgagccagatcacaccattgcactccagcctgggcaacaagtgggaaactccgtctcaaaaaaaaaatgtggctggaatattttaacaggagcagttaacagctttctcttggccccacaggcctcatccgcccggccgtttaaccctggcctggggcctgctgctgggccgtggttcaggctggctcacacggtgccccagctctccagctttcgctccgtgcttagggttcactgaatttttttcggttttttttttttcagacggagtctcactttgtcaccaggctggagtgcagtggcttaatcttggttcactgtaacctctgcctcccgggttcaagtgattctcctgcctcagcctccccagtagctggaactacaggcgtgcaccaccatgcctggctaattttttgtattttagtagagatggggtttcaccatattagccaggatggtctcaatctcctgacctgatgacctgcccgccttggccttccaattaattttatttttattttttaaatgtatttattttattttattatttttatttatttatttgtttatttttttgagattttgagatggagtctcgctctgtcgcccaggccggagtgcagtggcgcgatctcggctcactgcaagctccacctcccgggttcacgccattctcctgcctcagcctcctgagtagctgggactacaggtgcccgccaccacgcctggctaattttttgtatttttagtagagacggggtttccccgtgttagccaggatagtctcgatctgacctcgtgatccacccgcctcggcctcccacagtgctgggattacaggcgtgagccgccacgcctggcctatttatttcatttttgggaccgggtctcactctgtcaccccagctggagtgcagtggcgcgatcacagctcccctgcagcctggaactcctgagctcaagtgatccttccacctcagcctcctgagtacctgggaccaccatgccctgctaatttttttattttttgtggagacagggtcttgctatgttgtccaggctgtgaatacactggaagaagactataaaaactatttagaccgagaaatctcgaataaatgtgttcattcaacagatagcagcagccacataagtgtgcacttgctgcgtgccgagctccgggtcaggtggtttcatctttacaaggaacttgacaggcctgtggagaagcacacgccggcagccaggacatgcatggggccgggagtgcgttcaccccctgcgcccagcacgtcataaagctgtgggtgtcacgcagggcatggacaacgtggcttccttcctcctaggtggctgctgccaaggtggaagccgggcataaccgccgccacttcaaggcggcctccttggagctgagtgaggtgaagaaggagctgcaggccaaggaacacctggtgcagaagctgcaggccgaggccgacgaccttcagtgagtgcctgggccccgccagccctcaaacatggctgtcctggcaatgggcggggtctaattcacaccttcagcacagcgagggtcatctatattttgcaaattgccgagtacttgagtgaatcataggagtagaaggcacccagcctccgtctccagaatcctgagcctcactcactgccccgtgtcctccccccaagagagaaagcgccccagcaggagtacttagcttcaggtcagaggcgggaaggggcggcccggcgcggggctgatgcttggctctgtgggtcccatgcactgtggtctcggggccggcactctctgggatctgtgaggggtgccggcaaagtgagtctctgggatctgtgaggggtgccagtgaagtgtgagtctcaggtgcttcgtgaggactgcccgagtgcacactgtgggcaccaagcatggctgcagcacgcagtgcacagcagagggcctgccaggacgaacgccttccacaggcagcatttcccagcgggagggcacagcacactggaggagcgtggcgattcccttctttcttgtttttttacgctaggattcgggaggggaaacattcccaggagatagcacagttccaagcagagctggccgaggcccgggcacagctccagctcctgcagaagcagctggacgagcagctcagcaaacagcccgtgggaaaccaagaggtgacggttcacgggggctggacttgcagggctggactcacgggtgccctgggtgacttcactccatcctgcttggggagcaacagtgatggttttctgaatatggtattaaaagataaaccaaaacacagctagagccattttccagggcagtaaagccactttaatattcttttggccatgtgactttcccctctttagatggaaaatctcaaatgggaggtggatcagaaagaaagagaaatccagtccttgaagcagcagctggacttgacggagcagcagggcaggaaggaactggaagggctacagcagctgctgcaggtacctgtgtgtgaggcgctgggcacaggcgggagcagcagggaggaaggaactggaggggctacagcagctgctgcgggtacctgtgtgaggcgctgggcacaggcgggagcagcagggaggaaggagctggaggggctacagcagctgctgcaggtacctgtatctgaggcgctgggcacaggcgggagcagcagggcaggaaggagctggaggggctacagcagctgctgcaggtacctgtgtatgaggtgctggacacaggcgggagcaccacttctggggcagcccctggttcctgtgccatgcggcctgcggccaggcagtgctcccggggagctggcgccctcgtccagtggggcgctcgcaaagccacctggtccacgtcatgcggcaggacagaggcaggggcgaagcctgggccggctccgatcccttggccgcgctgtatgtcacggaccaagaacgtgatttcatggactacagcaaatgggagggtgcgtgggaaaagtttgccaatttgcgataaacttctcaacaaagaactcagggttcggtcttgactgctcgggaaaggagtgtaattgctaagttccccttgtaaatgaggggcttgagttacagtgagaatttatttatagacacaggccgacaagcgtccatcatccagaaatccaaaacctggccaggcctggtggctcacacctgtagtcccagcacttaggcagtgagctgtggttggaccactgcactccagcctggatgacagagtgagaccctgtgtctaaaaaaaacaagaacaaaaatccaaaatctgaaactttctgagcatcaacatgataaaggaaatgatcattggaacatttcaaatttttggattgtggatactcagctggtagttgtaacgcaaatattcaaaattccaaaatttgacacacttctggtcctgagcattttggacctggactggcatcatctagatggcgccgaggaggacatgtgtgtgcttaacctatgaaaatacaaactcggatcttggcaggatgtttaagatctgttagcttttaaaaatctgacttcattttccacagaacgtcaagtctgagttggagatggcccaggaagacctgtccatgacccagaaggataaatttatgctccaggcaaaagtgtcggagctgaagaacaacatgaagaccctgctccagcagaaccagcagctcaagctggacctacgccgcggcgcggccaagacggtactcaggcccgcgtccctcccggggtagccgacgtgcgctgtagatgctctcggacaggaggctggcagacgtgttagtcattcagacataaacggatttgttgagcccacactgagcagctgctgtgtagtcagtggtaatggggtgacagatgaaatcatttcattctggtttcattcatccaacagtgttttcctcgttctgtgaattcaaataccactttgttgtaatgtgctttgtaaagcagatgagcggtggtctgtgactcggcagtccctgctgtgtgtgaagggctggggcccgggagctgtgcccaggcgcccggcggttttctgtgctcggtccacatccatgttttccaggaggcaggtgggagggcagcgctcggattgagaggccgtttagcgtcgtgtgcttatctgtggaaaaagtttgaagtcccagaaaagggagcctaagctggaaaacttacttaatttcttaaggaaattccacatcaaggtcttgagtatctgatgggagaagcgtctgggagagctgtagtctgtggctcggccccgtcctgccgcagacccaggacttaggttgtctctgctttgctctggttttgtgccttaggaataaaggtgtttcctcagccagctattctggagctccggggactgtcgtgctgggctgccacggcggccaggacggtccccttcccagaggccccacgtccaccagttggggaggcccgtttgccacaagctgtgctagtgagactgacccgagggaggggacggtgggaaagctgatcatgtgcttttaaaaacagagaaaggagccgaaaggcgaggccagctcttccaaccctgccacgcccatcaagatcccggactgcccagttcccgcctcgctgctggaggagctgctgagaccaccgcccgccgtgagcaaggagcccctcaagaacctgaacagctgcctccagcagctcaagtacgaccgtattccgtgctgcacttcagctagtcttaaagattaatgccctcttacctgggagggcactcctggtgccagtactgagtgcccagcagagtttcagcaggtttatataagggtgggggactcgcatacatagcctctgaggtttatataagggagggacttgcacacacagcctttgaggtttatataaagggggaaggactcagcctctgaggtttatataaagggggagggggactcgcacagcctctgtggtttatataaagggggagggactcacagcctctgcggtttatataaagggggagggggactcgcacagcctctgaggtttatataaagggggagggggactcacacagcctctgcggtttatataaagtgggagggggactcgcacagcctctgaggtttatataaaggtgggggaactcgcacacacagcctgtgaactcataggtggaaactgcctggagttaaactaccctgataggccctgagaagctggaaggccacacatggtgcacctggcagcctgaggctgagcgaagtgtgtagggcggagccaggcggcgccccgagggcaggtaacggagtggaagtcgtgtgtgccaggcctcagtgacagcttccaccctgccgcctggtcaggactggtccttgagcctgtgtcctctgcacagtgtagagaacggtgctgagaacagctgagcttctgtggtctcagttggtttgcggatccccgaaggcgccccggtccactcaggtgctagcgagtgacgctgtccacaggtggcgcgttctgcctggcacttgtgtgatctgggccttcttcctcctccttctgtcccaggcaggagatggacagcctgcagcgccagatggaggagcacgccctgacggtgcacgagtctctgtcctcgtggacgccgctggagccagccactgccagccctgtgcccccggggggtcacgccggcccacgcggcgacccacagagacacagtcagagcagggcttccaaagaagggccgggagagtgactgctgtggactcgcctccgtgcgccgctgccccagaaggctcttatcaatgttatttatttgattgtgtcgtcgatgtttttctaagacatgaaatttaagttttgttttgcctttaacaagaagtaaaatatatagcagaatgagagccaaggactagaaaaacattcgaagatcacaattagcttttcacatggaatgaccaactcttaaaagcctgataggctctcggcgaggagctttgaacgtgtctgaagggttacttgtaggtcgtggcttctgagcggccaccgatgctgctctctgcgggtgacagggagaggctgcgtaactgggagcagctgtgtgacagggtctgcggcaccgcgcctggccaggccggctgcagtttctcacttccctgttccattcagtaagagctttacttttccgcagaaatgaaattttatctgtacctttggctttttacttgtttttttggatagccatcccaccataggatgtgtacatagatattgaatatcataatccaatctttgtttttttttttttttttttttttgagacagagtctcgctttgttgcccaggctggagtgcagtggcacactctccgctcactgcaagctccgcctcccaggttcatgcgattctcctgcctcagcctctcgagtagctgggattacaggcgtgcgccactatgccaggctaatgtttgtatttttagtagcaatggggtttcaccatgttggccaggatggtctcgatctcctgacctcaagtgatctgcccatctcagcctcccaaagtgctgggattacaggcgtgagcccctgcgcccggcctgtcacccagtctttaagaagcatatgctcatgttattgaagaagaacctacttattattgattgccttttgaaaatttgttgggaataatttacctgcaggatttagggatagtcagaaaattctaagaaatataattattttatttaccttctaaagccaaatattcttacacagaaaggtcctctgttgttctggttttactttgttgctgaggatctttccttcctgctggtctcttcctctcaggccactggccctgtgtgattccaccgtggctggccactgggaaggggcagcttggacccttggtcaggcctgacggccatcaggaggcacaaggacactgaggccccatatctgatctgacctttgggggggcacagggagaggccggtggaggaggaggaggagagcagaccaggggctccctgcagcgactcccgcggtttcccctggagtcagccaggtgtaggtcgcaggcggtaacaaacctcacactcctgttccccaagtgaaaatctttaccattgtctgtgggagcgcctgtactcgtgtgtaggagcacctgtacttctgcagtcatcgagaagtcctggatcttttgtggttacaccagcatcatgtggcaagcagaggcgacttccggaagagacaggcaggcaccgtgaggaaggtggctgtgctctcccaggtgtctcagagacagatgccttatttaaaatcagcacgacatgtgtgagatcttctgtttcctaccccaaatcctgaaaccctgcagacactggctgactgggagaggtggggtctgtaagttgtcccctagtttgctaagaaaatctaaaataatatttattatatgagttaggagagagagaatgggtccgcgtggcctcctctgcagatgtactggtctgaaatgaggttctgagtcactggccaggccagatgtgctcatgtcggtgtctggtgtctgttttgtggagaaaacagtatggtgtgttttaagctatttgtgttctgttgtaatatacttttagaaggttaattggtaaggttaaggtagcattaaccacaaagatgtttggtatttaaaaaatattctctagcaaatattggaatttccaaaatatatcatttgtacagggttaattttgaaataatacttgaaaatttcattataaatatatcctactttttatcttaagttgaagatgttatttactaaattgttcttgtaccattagaaaaaaaaatacggcaatttacgttcttatttattttggctgtactacccctttgttttaattttaaaatcaagaaatcgggccgggcgcggtggctcatgcctgtaatcccagcactttgggaggccgaggcgggtggatcacctgaggtcaagaggtccagaccatcctggccaacatggcaaaaccccgtctttactaaacatacaaaaattagccgggtgtcgtagtgcgcacctataatcccagctacttgggaggctgaggcaggagaatcacttgaacccaggaggcggagcttgcagtgagccgagatcgcgccactgccctccagcctgggcaacagagcgagactccgtctcaaaaataaataaatgattttaaaaaatctaaaatcgagaaatcacacattcagtggggagcgacttctccttgcttatgggaagtcctcaagtgagtgatgttcaccatgtatttttttttctcttaggacagactaattctgaaaataccgaaggaaaagtagctctatgttctcaccccggttttcctgcgtgtgtgcccttgggtgcgatgcctcccccagcgctctgtggtcgccggtgccagggccccctctggtttggcagggcctggctgcctttgctccctgcagtgagtcttttggtgttttcatgcacggcttgtgcttctggatctgaggcctctcgtgttcacgcggacacttccttccttaagaagacgcctaaaagaggaagttggaattttttttttttttttgagacagagtctcgctctgtcgcccaggctggagtgcagtggcgtgatctctgctcactgcaagctccgccatctgggttcaagcgattctcctgcctcattctccccagtagctgggattacaggtgcccgccaccacaccagcctaatttttgtatttttagaggggtggagttccaccatgttggccaggctggtcttgaactcttgacctcaggtgatcctgagcctcagcctcccaaagtgctggaattataggcgtgaaccaccgcccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtactgcttacaaaacagggtcaccagtgcattatgtggcgtgttcatccccacgccgtgtgtcacgggctagggcggcgtgttcatccccacaccgtgtgtcacaacaggctagggcacttcacgatgtcactacttgtttttctgacgttccaaaaacaacgtaacttggttttcatgtgtttttccgtggtatatgtgagattgatgctacgggtcttacggactcacacccgttcccactctctgcaatatggatcaggcagtgtttctgataggatgtgaaatggactctcctcgggtgggtccagcaggggccctgcccaccagaacacagtccgtgctgtgctgcgctaaggagctggccctcaactctccttggtgcagggttcccacaaccgagttctagttccctgaggtctttaaaaacaaaaacagaatgttgtacgtgaagattctaggaggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggtaaagattttcatattcattggaagcttcattttaatagttatattttgtcgtttggcagtaactttttaatctcatgttattacacactctgttcaacacgtgctttaaaagagaattctactgtcctgccggtttctggcaggagtgaagcaaacttctgtggcttgtgaccacggcagacgcgcggcaccgcctcctccgtccttggcccacgcttcgctttgcccgttgtcatttgccaggaatacagaaggagggggagcaagcttcccggtgaaccggggaaggatggtgaccgctctgtgctgcgcctcctgaactgggtctcatcatccaggtgctgccctctgctgggcctccccggtgacagtggagtcatgactctcagacctcagcaatgtgacttcccagattctcgtctttttcatccatactttgattttggtcattaagagttaaccaggcgtaagctgggtgtggtggctcacgcctgtaatcccagcactttgggaggctgggagggggtggtcacctgaggtcaggggttcaagaccagcccggccaacatggtgaaactccacctctactaaacaaaaaattagccagggcgtggtggcgggcgcctgtaatccccacttgtcaggaggctgaggcagaagaatcgcttgatcgggcagaggttgcagtgagccgagatcacaccactgcactccagcctgggtgacagagcatgactccgtctaaaaaaaaaaagagttaaccaggtacagagttttcagttagacgttattagaggccaccatggtttaaaaagtacagaaaaggggcaggaagtggtggtcgctgggcttggccctgtgggattaatgcacttcttcctgtgagcgttaccagcttctgtacccagagaattgctacacagagtaaaaattccctgaccaccttctgtggccttaactttctgaaatattaaggatataattttttttggtctatagaacccttaaggggacatgtatgtatctgaactttttccttttctccatggagttgctacgtgtttgcaggcactgcactgacaggtatattttaagctgtgtctgtctcagcagctcgaagctccacgctgcgtcctgctacagagctcagcagtgggtgtcaggagtggttttggcagagatgaatgggtcacttcttcctggcttagagtggcggcaggtactgtcaggaatttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacgcctcccaggttcacgccattctcctgcctcagcctcctgagtagctgggactacaggctcccgccaccacgcccggctaatttctttttgtattttagtagagacggggtttcaccgtgtcggcccggatggtctcgatctcctgacctcatgatccgcccgcctcggcctcccaaagtgctgggattacaggcatgaaggagactcaggatttaaaaattaccaggtcactcagaaatctgagacctcgggtagtattaggaagcaggccaggcacagtg

SEQ ID NO: 12540 - DNA, 44378 bp, Human
  misc_feature (1)...(44378): n = A,T,C or G
agtgcaatggcgcgatctcggctcactgcaacctccgcctcctgggttcaagcgattctcctgcctcagctcctgagtagctggcgcgcgccaccacgcccggctaatttttgtatttttagtagagacggggtttcaccatgatggtcaggctggtctcgaactcctgacctcgtgatccatccgccttggcctcccaaagtgctaggaatacaggcgtaagccaccatccccggcgaccagctgatgttcttatacacatggtgtccccttcaaggcacattccagttcctatcaggaggattcctcctcggacacactgtgcccccaacctgatccttagtgcttccctcgagacctacaaactgcccccttccccggggggttcacaacgccttatgcctctcaggttccgcccccgcccctcgcataagaatacccatctgcctagcttcggaaattcactttcccccgcccgtcccccggagcatcccttgggcccctgtccctttcccggggctcttctaccttaacccagagcagagggtgcaggcctcctgagcccaggggcccagttatctgagaaaccccacggcctgtcccccgtccagaacgtctcagcgagctcacgacgcgcagtcacgtttttttccccccctctacattgcagatgtggctcccaatgttgacgttggccaggacctttgcaaacaagccaggccaaaaagtttcaatatttacactggctgctttaataagggcattgatcttatcctccgtaaaggtcacctcatagtcctgcagaatgagggcagagtagatgcaggcaagctgggagacggaggccatagcgcgggcgagtgtggggctggggctgccggacgcggtgctactcaccggatgaagtgagggtctcaccccaacgcggccttagcttcctcggaaggaccgaacaccttggcggcagccgaggaaaggggttccacagttttaatttatctgtaattcccacgctttactgttgccacggaaaccgctgagcaatagcctctcagaataggaaatcaagacacagtcagaggaagggcgggacagaaagagcctagcatctctcggggctctgggttggccacccagtcctcccctggtgacataaaaagaaagagacggaaaaggaagaattctacctgagttcgccgtaaagcgcccgccctctcgcctctacgcttccagttgcggcttattacgtcacagtaattgctgtaccaaggtcagaatcgccacctgaggcctgaatatcagcgtaagatagtgtccaaagcagtcttaagaagaggtcccattaccccactctttccgccctaatggaggtctccagtttaggtaaataaaaggattgttgggaggtggagggaaagaactactatttccaacatgcattgcggaacgaaaggccttggccacactgttccttggaaactgtagtcttatggagaggaacatccaataccaaagcgggcacaattctcacggaaatccagtggatagattggagacctccgcgggcttatacatgtcaacagtaatggattggagtgttgttatgttctcctatcttgagagcagagactaggccaaaaaaagatacctacaactcctaggaagactacgattcccatccagccccacgagtctcgggcaagtagtcctctaaggtcagtggcctgcggggacgcagtgggcgccgaatttgcctggggaaggggaaatccgctctggcccacatctgcgcactcctagttccgcccctcagcctcaatgtttgttattgttgttcgggttcaggttgcttctgccccgccccatcgacgcaatctccaccaatcaatggcgtggtcgttttgagggacaagtggtgagagccaatcatcttggcgaacactcggagaaacaggggactagttactgtctttatccgccatgttagattcaccccacagggatagcggcagagccggtagcggacggtccttgcattggcctccggcaggcgccccccgggggcgggaagctggtaaggaagcagctgcggttacctaggggtggggtcacgtcacgctaagagggtttggggaagttcaagggaggaatcctgcaaagaagaggggcgactttttccgtgtttcgggacagctaatctttttagtgacaggatgagagagcccttcatgttcagagggaccgagttggcgagaagcgccggagagttggagagtctgtgggtcagaacatccggcttctactgatggaaggccacgactccccagtggaatgagggcctaggcaaagaaaatgagagagccctcggggtagtgacactgtcttgggaacatggagtgctaggaaacgaaaactggaagactaggatgaactctgcaagtaaaaaaatgacactacttacacatccttctcatcccatcctcgttttttcgagaccttaaagagatctccttggttagggaccttcggttttggaaaggcactgtttttcctttttgtcaaacactcagctttcaggccacacttttttgagacagagtcttgctttctcaaagaccaacccaggctgggcttgaactgctgagctcaagcgatcctcgtgccttggcctcccaaagtgctgggattacaggtataagccaccgctcccggcctcaggtcacacattttaaagcctggataacttggcttgtaaaggcctctggtggagacagtaatcaaagctcaggttgccaggtctgtttcattaaagggattttgttgaggctgaaaaaaaaatcgacgtggaggaaaagctaacttgtgccaagcaaaggtgagtcagtggcatggacttacaataatgccagttatgaaagctgaaggcctaagacccagctatctgactctactggctgtagacctaaggggcagatagggttaaccatagctttggtgtttacacacgtttaagattaatgctcctgctgaaagaatttttttacatgtcagccaaagagagttccttatgaagacctggatatggtccagccaagctagaatctcccacttcctgttttctcttagttggcccaccagctggaggagctccagagtatctaaatttccaattgtgtaatttgagaaaaagagaggaagattcatttccttcacaagtagggaagtgtgtttcttgaagttggaaagtgatatttcagaatacccacttttggcggactgagtcacttcatttccttgattttttgcctaaggtcctggggaattgacaaagattctcaaattttaaggaccccaataattacatttcatatgaatgaatactagatgtcagcaggattgttgttaagagactaatattattttggtggtgaacttggttcttggtagaaacaaagaatggagaaaattgggggataattgtcttagggtttcaaaaaagtgcctttaaatgacagtcttaattgtagtattttacagggcagtgcattacattgtggaaaacagtacaggtttatggttctaaagactggtttattattatttatttatttatttgagatggagtcttgctctgtcgcccaggctggagtgcattggcgcgatcttggctcactgcaagctccacctcccaggttcacgccattctcctgcctcagcctcccgagtagctggaactacgggcgcccaccaccacgcctggctaaattttttgtatttttagtagagacggggtttcaccgtgttagccaggatggtctcgatctcctgacctcgtgatccacccacctcggcctcccaaagtgctgggattacaggcgtgagccaccacatccggccctattattttttaaaatgtttaattgaacttaatttttttaaggagacagggtctggctttgttgcccaggctggtcttgaactcctaggctcatgatccttccgcctcagcctcccaaagtgctaagattaccagcatcagccaccacacccgtccagttttttattttattttatttttgagacagagtctcgctctgtcacccaggcgagagtgcagtggcatgatcttggctcactgcaaccttgcctcccaggttcaagcaattctcctgcctcagcctcctgagtagctgggattaaaggcctgcgccactacacgcagctaatttttgtatttttagtagagacgaggtttcaccatgttggctaggctggtctcaaactcgactcaaacgatctgcctgcctctgcttcccaaaatgctggaattacagacatgagccactgtgcttggcctttattatcatattttttatatttgaatgacattttgaaagaacttgcgtacacatttttaatttgatccttatggtaacactgtgagatagtcaaagcagacgtattagacctattttataggttaaagaaccgaagctcaaaagcgaactgacctgctcacagttttatgtctagtaatgggccggaggtatgtctggaagctaagtcttcccagtttgtgtgctcctccgcctcccctctgccccccacccccacccccgcagaccacgctgtaaatccctgggacttaatcttgttcctctcaacctaagctattttttcatatcttgttcctctcaacctaagctattttttcataaagtcataaaaaccagttaaacgtaaccattcatcagtaaacaaaatccttaattaaaaacataatgatcagaatagaaatctgattaaggaattgttaacttgttaggcatgataatgatatctagactgtttttaaaaaattcttatcttttagaggtacatactcaattcttaatggataaaagcatagatgtctgtcaaaataatctagtagggaaagggtattgctgtaaacctttggttacagcaaattggtcctgagttgataattatgaaagaagctagcttatgggtccatagggattcattatattctctctacttttgtatagatttaaattttcccataaaaatattttaaaaaatagtccgggcatggtggctcacgcctgtaatcccagcactttgggaggccgaggtgggtggaatcacgaggtcaggagatcgagaccatcctggctatcacggtgaaaccccgtctctactaaaaatacaaaaaaattagccaggcgtggtggcgggcgcctgtagtcccagctactcgggaggctgaggtgagagaatcgcttgaaaccagaaggtggaggttgcagtgagccaagattgtgccactgcacttgagcctggacgacagaacaagactctatctcaaaataaataaatacaataatataaaataattatattattatagtttggttaaaacattagttgactatggtcagttcattgttggggcagaagtgggagatgcgggggtatatgtgaatgaggatagccttgagttgattgttggtttaactaagtgtttattactctccacttttatatatgtttgaaatcccccatttaaaaaatcagtacaaggccaggtgcggtggctcatgcctgtaatcccagcattttggaaggccaaggcaggcagatcatgagatcaggagatcgagaccattttgcctaacacggtgaaaccccatccctaccaaaaatacaaaaaaaaaaaaaaaaattagccggatgtggtggcgggcaccccagctactcgagaggctgaggcaggagaatggcgtgaacccaggaggtggaggttgcagtgagctgagatcgtgccactgcaccccagcctggggcgatagagcgagactccgtctcaaaaataaataaataaataaaataaaataaaaaatcagtagattgtgaaaaaacatagtaacttggatggagggcattgaatgctacctctgtgtagtttcttggctagtgttttggcctgtaagttcgtaaaactggtagaaaacctaggttctcaagttaggacaaccctccttctgcaagaaaaatgtagaatgtcactctcaagtcatacaagaatacaagttccctgagggcagagaccttatctctcttatccatgttggtatgtcctgctactagtaagtatttgtttagttaaccagtcatcataaagtaccgtaaggattttacaaatgctagatgatttctgggaatgtggtcaaaatttaaatactttcagcatacttctgtttccacatgtttccaacatgtggaagttcctaataacttcaagaataatttttgtgacttaagtacaagtctttatggcatggttttagcctatctttctttcctgaaacaattcctatttaacagtgatggtaagtttcgtaagaacagggacagtgtttcttttgttcattgctgtgtctcccaagcccagcccatattgggtcctcacaagtatttgctgagtgaacttttagtgcaacttatagaaccctttctaatgtgtttttctctctctcccaccaaccttctcaaccctagcctcacagcatggaaccacaggttactctaaatgtgacttttaaaaatgaaattcaaagctttctggtttctgatccagaaaatacaacttgggctgatatcgaagctatggtgagtgttactttattttgtttctccttggtttaagcatggttattttttccaaaggtagctatttttagcagtgttgtttcatagctgtgaagtctgtcatagttaccatttctgggccttttggaaaattgcttttgatagggtttcagtattcatatatgagatgtgccccaataaagggaaccaacacataaatttccttttgaacattttagaaagggaaggtaaaattgtttttagtgagataggatttagaaaacctattaattttagaaccagtatgaggagtgaattggtgtgggctccacccaaccagatcccaaggaaatgttctcttgtgtgaggatatgacttgtgttttgcacaaggatataacttgtgttttgcaagagcctatcaattgtttttattgctaggtcagaggttgagtatctcagagttgagcaggaaaaactttcatacctgcttagacagcagttcacctgttccgtttttttgctaaggcttttcctcctcttggtttgccctttgtactcttctgtttttgttcagtttgcagtggtgaatgttttacttcctgtgttgactgtgtttctctctgaaaccctttggtaaaaatctacgtttacctggttatatctgatgataactaaaaagggaaagaaatggtagatcttaaaagatgatctgaggtagttgtctgccttccagcaaatacctgttcatactgtcctatcagtgacagtgagacccgtctcaaaaaaaaaaaaaagattggattcagaaagaagttagatcttgtttgccaaaagatgtgaaaatcagttatctttcttttcctagtagttaaatgagctgacagcttgccttttttcttccttgtaaattttaaattgtataagtataatacatgcccattttaagaagagaaaccatctcaagcagttaatagccctccattctcccccccctcatctgttactcccaccttctttgggtaaccaatgttaacagccctgtatgtactttaaattttccatgttcatgcagatatcatactaggatcatactataaacattatttggccaggcacagtggcacacgcctagaatcccagcactttgggaggccaagatgggtggaccacttcagctcaggagtttgagaccagactgggcaacatggtaaaaccccatctctaccaaaaaaatacaaaaattagctgggcctggtagcaggcacctgtggttccagctactccggaggttgaggtgggcgaattgcttgagtgctggaggttgaggctgcagtgagccaagatcaagccactataatccagcctgagcgacagagtgagacccatctcaaaaaaaaaaaaaaaaagatatttttcgttttttttttttcttatcttgaaacttcaggagatatccatctatacacataacttatacactgttctacaggataaactctgtcctatacaaatgtgagattaatgggtcacaaagcattttatttgaaattttaatagattctgccaaatgctttgcagaacaattgtagcagcacacagaaatacatgacagtgtcctgaagttttgacaacactggatgttatggctttaaaaaacatttgctgttccctaccccacaccccacccaaaacacacacacacacacacacacacacacacacacacacacacacagtttgggtattctgatgagatgtcatctcattgcttcaatttgcattgttctgacccccagaaagtttgaaagtcttctgatgtatttgttaggtgttctgatttcctcttgtatgaattttatgtatatttttacctgggttgttaattgtatcattagcagttttgctggtactctgggtgtgttgcagatattaaccctttgttatgggttattaaggttgtttgttgtttgtcttttgattttgtgggttttttttactttgacttctgtgtacattataacctgcctttaaatatgtatctcttttataggtaaaagtttcatttgatctgaatactattcaaataaaatacctggatgaggaaaatgaagaggtaaaatatattatggcacttattgctaggtgttcagaatagggatcttatttctccagtgatatgggctttaataattcaaaatagtgtttagcttatttgtgtggtggtttaaatatatttgataactgaatattctaagaagacttgcagcatctgagatggagttgagaaatggagaagcaacactgaagaatatctcagagataactttcacttaaaaaaaaaaaaaggaaacagggtctcactgtgttgctcaggccagtcttgaactcctgggcccaagcagtcctcccacctcagcctcccaaagtgctgggattataggtgtgagacacccaccatgcctggcctggcctgagagaacctttttttttttctttttttttttttgtgagatgaagcctcactccataacctaggctggagtgcagtggtgcgatctctgctcactgcaacctccagctcctgggttcaagtgattctcctgtctcagccttctgagtagctgggattacaggtgtataccaccacgcctggctaatttttgtatttttagtagagacggtatttcaccatgttggccaagctggtctcgaactcctgggctcaagcgatcagcccacctcggactcccaaagtgctgggattacagttgtgagctaccacacctggccaagataacttttaaaattatatagtgaccttaagttcacatatagcacaagctaccacttagtttataataatacaaatataatggctaagctttttttttttttttttttaaagagggtctcactgtgttgcccaggctggtgtgcattggcatagcttgctgcaacctagagctcctgggttcaaggaatcctcccatctcagccttctgggtagctaggacatacctctctgcatctggcaaaattttttaattctttggagggatggaatctcactttgttgctcaggctaatggctaagctttattgagtggttacagtgtgtcagactagccacagtaccatgtattgagtacattattatcatcactattttactcatgaggaaactgaggcacagagaggtgaaaataacttgtccaaatgcacaaaaacttggaagtagtaaagtagccgttcagtccataccctctggctgtagaactcaagctcctaactgttatattgcactgccttttaatgtatctgaaataaaggagggcacagtagataagcaataaaatttcttaagtgttattcatgactagcaagtgatatggaaaagctgaatgcttggcctgagtttttgtctgtcctatggggctggtcctagtaacagaaatgctcaactgatgagacacttataattcactgttgctttttttccttttataggtatccatcaacagtcaaggtgagtccctaagagagtctgttcagccttatttaaaaaccttaatctgctcattgaggcatttctatttatactcaaaccttattgcagtattaattttagagtgacattgcactgatggacattagttacctaggggattttattgtatagcagttttttatatacaggatgatgcctttgaatggaccctaaggacagctttaatgggaggttctcatatttaagatgccagtcctctgaaattaatatgcctcccagttcaacacatataagtattcccatggtgttgcatttgtttctgacttggtatatatgttaatatcaacttataaaacaagtggtattccaaaagtttatttatcagatgttcagagcttggagtgtattttcccataggaaccatgttatagttgaagattagtttcccacgatagcccctaaaatcttaatttaatcaggtgaaatgatagtattaacattgaactctcttgagtcctgagcatcacagtgcgtaaatgtgagggacctgggttgagattttgtaactggaagattcccagtagtgatgaaggagggatttaaggggaagaactgatctacagtagatgctgtttgcaacaaaaagggagtttgtcagcaaaaagatagttgctgttcatatataataagctaagaattctttaaagtcaggattagctgtacatttaacaaatttttattgtatatattgaaggtgcacaacatgatgttatgaaatacatatacagtaatgcatcgcttaatgacagagatttgtactgagaaatgcatcaattaggtgattttgtcattatatggacatcatagagtgtacttacacaaacctagatggtatagcctagtacacacctaggatatatggtataacctattgctcataggctgcgaacctgtagagcatgttactgtgctgtatactatagacagttgaaacacaatggtatttgcatatctaaacatagaaaaggtacagtaaaaatgtggcattataatcttatgggatcaccatcatacacatggttgaccaaaatgttatgtggcaatggttactgtagtgaagcaaattaacatatctatcatctcattatagtggccctgtggtgccctgagccctccccagaaaccagccataatctactcatttagcaaaaatcatgaatataatttacgattatttaactataatatgttcctcatgttgtacagtccatctttaggattggctatccttaatcttatggaatctttggttcttgaatgaatgaatggatgtgtacaaaataaaaataattttaaaataatagaatcttttggggtgtgtgaagaagtatcatggtgtatattttttgtccttttaggagaatatgaagaagcgcttaaggtaatgattatttaatctcatttttaaataatttaaaaaatattattatgggttggttttttttctttttttgagatgaggttgtgctctgtcatccaggctggtgtgcagtggcacaatctggggttgctgcagtcttcacctcccaggcttaagtgatcctcccacctcagcctcccgagtagctggaactacagaaacacgtcaccacgcccggctaactttttatatttttcttagagacagggtttcaccatgtttcccaggctggtctggaactcttgggctcaagcaatctgctggccttggcctcccaagtgctgggattataggcatgagccactgcgtctggcctaaaatatttattgactgaaactcaaacctgaattccattagttatggggagagactagtacgtataaacacagtgaaacctgtttatagggagactgatgaatgggcacgacactcagcaaaaggcaattcataataaaaaggtccttctcagttacagtcccatctctttgctggtctttgtgctactgttctagtgtttaaaaatacaaataactggccaggcgtggtggctcacgcctgtaatccnnnnnnnnnnnnnnnnnnnngccaggcgtggtggctcacgcctgtaatcccagcactttgggaggccgaggtgggtggatcacgaggtcaggagatcaagaccatcctggctaacgtggtgaaaccctgtctctactaaaaatacaaaacagccgggcgtggtggcgggtgcctgtagtccccagctattgggaggctgaggcaggagcaatggcgtgaaccccggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgaggcggcagatcacgaggtcaagagattgagaccatcttggctaacatagtgaaaccccatctctactaaaaatacaaaaattagctgggtgtggtggcgtgcgcctatagtcccagctactcgggaggctgaggcaggagaatcgcttgaacccgggaggtggagtttgcagtgagccgagattgcatcactgcactctagcctggtgacagagcgagactccacctcaaaaaaaagaaaaaaaaaaaacagaaaaatagtaacccagttaaggagaatcttacctaatttgccatcttaaaacctacttttatgggtttttttgtttgtttttgtggaataaagcaacacaatacttttgtggttttaataacaaaaccaagttcatgaccggcctgggtaatgtatgacaaaaaattttttaaattagccaacaggcatagtgacccaaacctatgatactagcactttggaaagccaaggtgggcggagcccgggagttcgagactagcctgggcaacatcatgaaatttcacctctacaaaaatacaaaagttagccaggtatggtggtgcgcacctgtagtcccagttactcaggaggctgaggtgggaggatagttgaactcaggtgtccaagaccagtctgggcaacacagtgagactcctgtctccaaactaaaacaaaaaccttagccaggtgtggtggcatgcgcctgtaatcccagctacccgggaggctgaggtgggaagatcgcttgagcccaagagacaggctgcagtgagccatgcactgcattccaacatgggtgacagagcaaattgccatctcaaaaaaataaaaataaatttctaggctgggcacggtggctcatgcctgtaatctcagcactttgggagggcgaggtgggtggatcacctgaggtcgggagttcgagaccagcctagccaacatagtgaaaccccatctctactacaaatacaaaaattagctgggtgtggtggttggcacctgtatgtaatcccagctacttgggaggcttaggcaggagaatcgtttgaacccaggaggcggaggttgcagtgagccaagaccgtgccattgcactccagcctgggcaacaagagcaaaactccgtctcaaaaataaataaataaataaataaataaataaataaatttctagttaacattcttaccaaagaaatagcaagttgagtgtaaacattacatttgttgttggatttaataaagcaaacacaaatcctagtattttctagcataacttaccacactcttctgttttgatgtctttgaaatgttatttaggagaagataatcacgtcgcatgtttttgtttcataatgtatgctcttagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcaggtatgaagggtatggcccagtctatccaatatcgtttcttttttcttttttaaataaagctgaacaggtttctttattttatttttttattatactttaagttctgagatacatgtgcagaatgtgcaggtttgttatataggtatacatgagccatggtggtttgctgcacccatcaacctatcatctaccttaggtatttctcctaatgctatccctcccctatcaccccaccccctgacaggcccccgtgtgtgatgtacccctccctgtgtccatgtgttctcattgttcaactcccacatatcagtgagaacatgctgtgtttggttttctgttcctgagttagtttgctaagaatgatggtttccagcttcatccatgtccctgcaaaagacatgaactcatccttttttatggctgcgtattattccatggtgtacatgtgccacattttctttatccagtctatcattgataggcatttgggttggttccaagtctttgctattgtgaatagtgctgcaataaacatacgtttgcatgtgtctttatagcagaatgatttataaccctttgggtatatacccggtaatgggatcgctgggtcaaatggtatttctggttctagatccctgaggaatcgccacactgtcttcaacaatggttgaactaatttacactcccaccaacagtgtaaaagcattctatttctccacatcctctccaacatctattatttctttttttttgaaacggagtctcactctgttgcccaggctgtggagtgcagtggcgcgatctcggcttattgcaagctctgcctcccgggttaacaccattctcctgcctcagtctcctgagtagctaggactataggcacctgccactacgcccagctaattttttttatttttagtagagacagggtttcaccgtgttagccaggatggtctcgatctcctgacctcatggtccgcccgccttggcctcccaaagtgctgggattacaggcgtgagccaccgcgcccggcctccaacatctattatttcctgacttttttttttttttttttttttttgagacagagtcttgcaccttcgccctggctggagtacagtggcgtgatcttggctcactgcaacctctgcctcccaggttcacgtgattctcctgcctcagcctcccgagtagctgggattacaggcacacaccaccacacctggctaattttttgtatttttagcagtgacagggtttcagtatgttggtgagactggtctggaactcctgaccttgtgatccgcccacctcggcctcccaaagtgctgggagtacaggtgtgagccaccatgcccagccctgtttcctgactttttaatgattgccattctaactggtgtgagatggtatctcattgcggttttgatttgcatttctcttttttttttttttttttttttgagatggagtctcactctgtcgcccaggctggagtgcagtggtgcaatccgggctcactgcaagctctgtctcccgggttcacgccattctcctgcctcagcctctcgagtagctgggattacaggcgcccactaccacgcctagctatttttttgtatttttagtagagatggggtttcaacatgttagccagaatggtcttgatctcctgacctcgtggtccacccgcctcagcctcccaaagtgctgggattacaggcgtgagccactgcgcccggcctgatttgcatttctctaatgaccagtgatgatgagctttttttcataggtttgttggccgaataaatgtcttcttttgagaattgtctgttcatatcctttacccactttttgatggggttgtttttttcttgtaaatttgtttaagttccttatagattctggatattagccctttgtcagatggatggattgcaaaagttttctctcattgtgtaggttgcccgttcactctgatgatagtttcttttgctgtgcagaagctctttagtttaattagatcccattgtcaattttggcttttgttgccactgcttttggtgttttagtcatgaagtctttgcccctgcctatgtcctaaatggtattgcctaggttttcttctagggtttttatggttttagatcttatgtttaagtctttaatccaccttgagttaatttttgtataaggtgtaaggaaggggtccagtttcagttttctgcatatggctagccagttttcccagcaccgtttattaaatagggaatcctttccccattgcctgtttcagtctatccaatttctagatttatttctcattgtctttgttgtaagatttgcacatttatcagagatttgggaattagtgtgctcctctctctgacttttgaaactggtaatagtttacttctgtagaaggggagcaggctagagactttgttttcctttagtacgccttcatactgtgactttttaaaaaattatatacttgtatgatttcacaaaagaaacctcaaaataatacactccaggaaaagtattttaaatagaaaaagtaacctctaacatctcggcttgtgttttctcccagtcgtttccacttgttccatgtgacacagaccagcctcaagacaagcccccagactggttcacaagctacctggagacggtgagtgttctgtctcgcttgggttttaactgcggtgttggcacaggtggaatgtggaagaaatagaaaactgaacccaggtggctgctgcctctagtaccggtgaagagtggtagcttataatttccaaacttagaacagttccagtcgagaaagctctaacctttgcagtgaagtgtcagaaaaagagggagtctaattctaagcatgtaagggagagggacaactctctgcttgagaaaaagttagaaatttacttatcaaaaggatgttttgatattttcttcgaaccagtttagctgtggaaggaatagaccttttgctatgtttctgtctattcagtagcagttgtttattgtgtttttgtattataccagagacagttaggtttcagatctattgatatcttcacatttttttctgatattggaactgagttttttccctaccttctgctccatattctagttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtaggtaagcagttgcttgggagtagctagctagtgatagaccttacagcttttacctccctggctttctgtgtaggtaaagggaaattaattgtaccctgtttctgagcattagatgttgtagctgtgagttggaagcacaagctactcttcacccacatgctttgtatgttgtaactattcagattgttgtgttcaaatgtgcatttggattagcaaagccaggcaaaattatgttcccctgaacggacaaaattagatcactaagggtagttcctcggttgttccaaatgcctttttttttttttttttggtgacagggtctctgtcacccaggctggagtgcagggtgcaatcatggttcactgcagcctcaccctcccaggctcagacaatcctcccacttcagcctgccaagtagctgggatcacagactgccttttaattatttttttggagatggggtctccctatattgcccaggctagtctcaaactactggactcaaatgatcctcttctccatggcctcccaaagtgctgggattacagacatgagccactgtgcctggccccatgtactttcacatcttaccttcctcccatagattttcatttaaaatggatatgggttaagtgttattatcctcattttattaatgaggaaaattgaggcatggcatagtcagatggcatgctcaggttacctgctagttggtactggagcaaacatagaagtatggtcttatatctccctaccccaggtacttcctattctgccattgtgtattgtgccattctttccccacagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggtaaaaccctctacatggagatgcttattctctgattgacttcttggttctggtgacagggtatgaatcacaaaactacagatagtctccttagttctgctcattttcaattgatgtgcaataatgaagacagttatccaaagttagtgaaatagaaataatagctataaaaagaaattaagaaactaaagtaggctgggcacaatggcccataactgttatctcagcaacttgaggggctaaggtgggaggagtgcttgaagccaaatatttgagaccagcctgggcaacatagcaagatcccgcctctacaaaaaaaatttaaaaattagccaggcgtggtggtgcgtacctatagtttcagctacttgggagtctgaggtgagcagattgcttgagcccaggaatatgaggtggaagggagccatgattagaccactgtactccagcctacatgacagagtgagaccctaattctaaaacaaaaaaagaaattaaactggaagctgacactgatggaaattgcaattggctccacatagcttcagaatttatttgtgactttcttttaagacttgcttttattatctcacaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgtaagcccaggactggggtgggagccaaaactttaggcccagctctctgaaactggaacttcaaccaatttccgtcttatttattggtagcccttaacacctaaatctttaaaactttccattatctggtcttagtattttttgtttgtttgttttttgagacagagtcttgctctgtcacccaggcggtagtgcagtggtgcgatctcggctcactgccagctctgctttcgggttcacgccattctcctgcctcagcctcctgagtagctgggactacaagcacccgccaccacgcctggctaattttttgtatttttagtagagatggggtttcaccgtgttagccaggatggtctcgatctcttgacctcgtgatccgcccgccttggactcccaaagtgttgggattacaggcatgagccacacagcacccggcttttttttttttttttttgagatggagtctcgctctgtcgcccaggctggagtgcagtggcatgatctaggctcactgcaacctctgcctcccgggttcaagtgattctcctgcctcagcctcctgagtagctaggattacaggtgcatgccaccatgcccggctaatttttgtattttttcagtagagatggggtttcatcctgttggtcaggctggtctcgaactcctgacctcatgaatccgcccgccttggcctcccaaaatggtgagataacaggtgtgagccactgcgcctgcctggcgtggtcttagtattattaaagggtggtttggtagttttttgtttgttttgtttttgagacggagtcttggagtctcgcctgttgcccaggctggagtgcagtggcgcgatctcggctcactgcaagctccacctcctgggttcacgccattctcctgcctcagcctcccgagtaactgggactacaggtgcccgccaccacacccagctaattttttgtattttttagtagaaacagggtttcaccgtgttagccaggatggtctcgatctcctgacctcgtgatctatctgccttggcctcccaaagtgctgggatgacaggcgtgagccaccgcgcctggccaagtttcgtagttatttttgacacttgttttgtttccttcttcagaaagatagaaaccactaaagttcaaaatggcggggtccctctcttcattggaggcaatctggaattgaagcaaaaggaacaaatgtgttaaaagcctgactctctaggtgttgtatttataggcccttttaattactcttaccatgacttttttagctcaggagtgagacctatcctctgttttgttttattgttttaagtttgtcagaaaatttattgtttctaatatgtggtcctatactagtaatatcagtattatttttaaggcaaatgggttagcacattttcaagagtcacagtcagactctcaagctagtgtgaggtattcagaagccttcacacccaacagcaagtgactaagcatctgaatttctgttcaggctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaaggtaatttttcccacaaaatgcaaagatgaggtgatttgaagtggcagagtgctcagctgacaagcttgctttctcttcttactgttcttttcagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggtgagcattgactgacaggctttggcctagtatccaaatcttagttagagaggagatggctaaaactaaaagaacccactcatagctggttgttttccagaaaccttgaaaggttagcatctccccccgccccaacacatctctatgctgatatttggcctcttccttagggtgtttgttttagcgtctttagggtcttgctgcatactgaatacttttgtacctctttgtgatgttgcatggtcagcctgttggctgcacaagggaaaaagggactcctggcctgggctggcctgtggaactgctgaactgatagctttactccttaacatccatctctcctgaaataccctgtgtatgttccctaaatactaatgaagtcttgccctggttgctacttagtgaacagttttttaatgcaatttctctgtattagtggggcagagtgtttactgcttaaagttatccaatgttaattttctggttttgactattatagttaatataagttatcgtcattaggggaagctggggaatgtgaattctctctgctgtttttacaactttttctataactgtaaaaatatatcaaaaacattgttttttaaaatatggaggtacagcagcgtttttatttttgggggcattgtcagcctgcctcttcagttctgttgaaggcctaaaatttgtctcaatggtttgtctctataggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggtggaagattcagcactttgaagggcaagggacagagggagagagcacaggagagaaggtggtagagccataggcagtaatcaggaaatcagagatatgcccactttgatctagtcaggtatatttaatgggaaggagatcacccatggaagcaagtttgtaaactagatgtttcctctttgaattgggaactcaatcctgtacttccccacaaactccctttagttgcctcttcaccttggcctagctaattctccttcatacctgctgcattttctctttcctgctattgggttatttcaacatctaattcccatttaactcttcttgttttcacttgtctggggacaggcatgaatttgaacagagttgaatacgaaatgatgtggaaatggtctacaggtcccatcaagacatggctccagcatgcactccaaacagcctaacattgtctttttttataggacctgctgtcctttgagctgttggatataaacattgttcaagagttggagagagtgccccacaacacccctgtgggtaagaatgtcactcatttcatcttgttcgtcttactaataggcacaaaagtaccacagcctagacactggtagtgttttattctgaggaaatggcaaggatttctcccacagtaggatagtaaagcagcaatcatggatccgtttttcttctttcctgtcctttgtcaaaagtaacaacatgctgggcatggtggctcgtgtctataatcccagctctttgggaggccaaggcaggaggatcacttgaggccagggtttgagaccagcctgggcaacatggtgaaacccccatctctacaaaaattacttttaaaaattagctgggtgtggccaggcacggtggctcacgcctgtaatcccagcactttgggaggctgagacgggcagatcacctgaggtcgggagtttgagaccagcctgaccaacatggagaaaccccttctctactaaaaatacaaaattagctgggcatggtggcacatgcctgtaatccgaactactcgggaggctgaggcgggagaattgcttgaacccagaaggcggaggttgtggtgagctgagattgcaccattgcactccagccaggacaacaagagcaaaactccgtctcaaaaaaaaaaaaaaaaaaaattagcttggcatggtggcctgcacctgtggtcccagctaccagggagactgaagtgggagaatctcctgatcccaggaggcagaggctgcagtgagccaggattgtgccattgctctccagcctggatgacagagtgaaacccaatctcaaaaaacaaacaaaaaaaagaggctgggcacggtagctcacgcctgtaatcccagcactttgggaggccaaggctggtggatcacaaggtcagaagttcaagaccagcctggccaagatggtgaaaccccatctctactaaaaatacaaaaattagccaggcatggtggcaggtgcctgtaatcccagctactcgggaggctgaggcagagagttgcttgaacctgggaggcggaggttgcagtgagccgagattgtgccactgcattctagcctgggtgacagagcaagactgcatctcaaaaaaaaaaaaaaaagcaataaaacaagttcgtgcaaggcttttccactataaaggaatcctcttctcttttttccctctagatacttgtgtccttttgttcctttatgttcatggttttgtgtcttggccacagctttccaggctaaataactgtgattcttcctgcattgattgatctgagatattttgcttacttattggtctggagaaattttttgtaacagacctcaaagcatatcttggtttattttagccctgcgggaggcaagaagcctacaaactgctacttctggacactgactgttgatgatatgatgctttctcttgattgatggttctcctgtcttcattctccagatgtgactccctgcatgtctcctctgccacatgacagtcctttaatagagaagccaggcttggggcagatagaggaagagaatgaaggggcaggatttaaagcacttcctggtaagggattaaacatttgtaaagtatttgcatcctccctttccatatcataccctattttacagctatcccctactgaccctaccttagcatgtaaatgggcttgctttctgtagcatctcatgttttgaagtctcctcaccttcacatggcacagatagcagctattccttggtttagttttagcatgggtaatgactggtgaatgttcttcagcactttaaacaccaagtgcagacaaagtttagatagcagctattccttggtttagttttagcatgggtaatgactggtgaatgttcctcagcactttaaacacccagtgcagataaggttcgtgtgtctttcagattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagagtgagtgtccttgcatttcccctacctagcagggtggcacctgaattgtgactgccagacttgactagttagatgtgctcttcttcactgagactgaagggagagtgatcttagttagaagttctgatcttggcggggcgtggtggctcaagcctgtaatcccagcactttgggaggccaaggcaggcggatcacaaggtcaggagatcaagtccatcctggctaacatggtgaaatcccatctctactaaaaatacaaaaaattagcctggcgacgtggcgggtgcctgtagtcccagctactcgggaggctgaggcaggagaatggcatgaacccgggaggcggagcttgcagtgagccaagattgcgccactgcactctagcctgggcgacaaagcgagactccatctcaaaaaaaaaaaaagaaattctgatcttgtttgtgtctttagactctacgtatgctacctgactgttctaattagagcatcaggagtaaagaagccatcatactcatttctccatcttctcaggggcagaattacagctgcattccacagtggaatagcagccagttgtgctgcctggattctgcagtaaggaatcttcctgtaatttgacagagctccttagcagagacccctatgggtagctgagttgtctgctttctccaagggcagcagtcccagaaacagtggatagaagcaggagtaccaacaaagtttctcaaggttaaattctgctgtaataaatacctttataggccgggcacagtggctcacccttgtaatcctagcactttatgaggctgaggcgggtggatcacctgaggttgggagttcgagaccagcctgaccgacatggagaaaccccatctctactaaaaatactaaaaattagccaggtgtggtggctacatgccaaggattacatgcctgtaatcccaggtacttgggaggctgaggcaggagaatcactttaacccgggaggcgaaggctgtggttagccgagatggcgccattgcactccagcctggcaacaagagtgaaactccgtctcaaaaaaaaaaaaaggaataaatacctttataacagaaacttctaggtatcagatagatagaaccaatagcatatattttaagaagtatccaaaaattcaaatatactatgtcaaaataatattggagaatctctttattataatcaaatttgacctatatctttaaatattatttatcttacttttgtttaaagtatacatgtaaggccaggcgcagtggctcacgcctgtaatcccagcactttgtgaggccgaggcggacagatcacaagctcaggagtttgagaccagcctgaccaacatggagaaaccccatttctactaaaaatacaaaaattagctgggcgtggtagcgtgtgcctgtgatccagctactcaagacgctgaggcaggagaactgcttgaacccgggaagccaaggttgcagtgagctgagatcgcaccactgcactccagcctgggtgacagagcgagactccgtctaaaaaaaaaaaataataaagtgtacatgtggccaggtgcggtggctcatacctgtaatcccagcacgttgggaggccgaggtgggcggatcatgaggtcaggagatgaagactatcctggctaacacggtgaaaccccatctctactaaaaatacaaaaaataagctgggtgtggtggcgggcgcacctgtaatcccagctactcgggaggctgaggcaggagaatggcgtgaacctgggaggtgcagcttgcagtgagctgagatcatgctactgcacttcagcctgggcaacagagtgagactccatctcaaatcaatcagtcatgtatatctttatatttttttccacatgtgtgtacaaatacataacaaaaaggtctggaaagacagtaccaaaatgttcacagctgttattctgataggatttatgggtaattttttttttttttttgagataaggtctcactcgcccaggctaaagtgcgagtagcaagtttatggctcattgcagccacaacatcctggggtccccctacctctgtttcccaagcaactgggaccacagccacatgctaccacaatgagctaaatttttttttttttgtagagatgggatttcgccacgttgcccaggctggtcccaaacttctgagctcaagcagtctgcctgccttggcctcccaacgtgctgggattttaggcgtaagccaccacacctggcctgggtagctttttttttttttgggacacagtctctgtcacccaggctggagtgcagcagcgcggtctcggctgactgcaacctccgccttcccaggttcacaccattctcctgcctcagcctcccgagtagctggcactacaggcgcccgccaccatgcccgggtaatttttttgtatttttagtagagatggggtttcaccgtgttagccaggatggccttgatatcctgacctcatgatctgcccacgttggcctcccaaagtgctgggattacaagcgtgagccaccgtgcctggccctgggtagcttttttctatccttttttaccctctcaaacatgattggccagttttctcccatgactgcatcatctttgtaaagaagaggaggagatagacatataatcctgcaatactcatctcctaactttttctctttttatagcactgttagtgtatcagttttggtttaaactctactcagtatattaaccatcacataaaaaggaaaaaagggatggagctgcctccttttatgattcatagagcttcttggaaacctgagtgtttctgcctaccttgtttctgtgagctttgattctattttgttttgcatagtcttcaaacttagaatatggtcatagttccagaaccagcccttccctttagttcttccctctcctctggctttcataattctagcttatgatccacaaggctttaccaagtaaggatagtacttaggcctgcttttagcttccaccttaaaattggttgctttcatcctttagtgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggtaccactcacagccccctcagctggggtgttcttcagaggtgaaataaagagaggaatcgacctgatctcaaaacctgttttttcctcagtatggaaagagactattttccatagcaaagtctgaatttagatgaataaaagttgtatttcccagtatttgtggattctggatttaaagaaatatttgttttagttggccttaaattatctgagtatagtctgtctgcttatattttgattattgagagctggttgtgtttttttttttttttttttgagacagggtctcagtctgttgcccaggctggagtgcagtggcacaatcttggctcactgccacctctgcctctgaggctcaagcaatcttcccacctcagccccctgagtagctgggactataggcatgggccaccacacctagctaatttttgtatttattgtagaagcggggttttgccacgttgtccaggctggtcttgaactcctggccttaagcgatccaactgcctgggtctcccaaaatgctggaattacaggtgtgagccactatgcctggctgagagccagtttttaaacacaaacatccctggaccttccctccttgttttattgactcttcagtaaaggcagcaaaaactcaacccaaacagtcataattaggaagttaaatccattatgggaaaaaacactataaaaccaaactaattatttttaattctctggtgaatctatctgaatcattcttgtctcctaatagtagggaaaatgctggagccttgactataatgtaaaccattctccccaaaagctagacatttccgtttattgacaccacttgatgtaggtggggacatgaccagactgaagccaacatttctagcttgcctgtggctaaagaggaaaatggggtagaatgtagcccttatgatggaaccctaaatccagacatgtgatctggatcagaaatgtgaagcctctgtagagaatttggcactgctgtgctgtgtttactatttctccactgttgccataagtgccttttcaatttactttccatattgtgtctttctgaaaggagctctccttgtgtacatcatcatggttccccaggagtggatttaccagttaccataccagaagtttcttcagtccctgatcagatcagaggaggtaatgatcagcctaagctttttctctttttctctgctcctgtctaatggaaaccaggtataaatagcctctctctcttcgtgattcttggtggttttttgaaacttgcccttcacaggccaggcgtggtggctcacacctgtaatcccaacactttgggaggccaaggcaggcggatcatagggtcaggagttcgagaccagcctggccaacatagtgaaaccctgtctctactaaaaaatagcaaaaattaaccaggcatggtggcgggcacctgtaatcccagctacttgggaggctgaggcaggagaatcacatgaacctgggaggcggaggttggagtgagccgagatcgcaccattgctctccagcccgggcaacagtgcgagactccgtctgaaaaaaaaaaaaaaaaaacttgcccttcactctctccatgctcctcctgcatactctaatttctattctctggctgaatatattgttagacctcatagaggtagtggaaagaacacaggctttggagccaaacaatctaggttccagctccatctccccctttcctgactagcagttcagcaggtttctaatggctgtgagtctgttttcttactacaaaatatatcagtgtgttaggattatagagttgatttttctgattcaataaacaatcatcttgcattgcatttctggacagtttctccttatcacttaaactacccttaaaacttcccaaatactttaaaaaaaaaaaaaaaagacttcaaacactgtgatcagattgccacctgcctcaataatagccttgctgtgagttaggaaacagtaggtgcttatggatgctgcatctaaccaacagctcttttgcttttagagcccagaggctcatcaggacttgtaaacagcagacagaagagctatgaccactcaaggtaacaaccttgtgcagtctcttttttcagaagcaggtggatattcttgtattccttctgcttaaaagagcctctcacagtatgtacccatcttcagagagcagagaaggggagcctttgttccgtcttattcttgtttcttctaaaggctttgagcaacactgaacaaacggctaaagctgatgtttaagagtgttctgtttgggaggccgaggcgggtggatcatgaggtcaggagttcaagatcagcctggccaacatagcgaaaccccatgtctactaaaaatacaaaaattagccaggcatggtggcgggcacctgtaatcccagctactcaggaggctgaggtgggagaattgcttgaacccaggaggcggaggttgcagtgagctgagattgcaccattgcactccagcctggctgacaagtgaaacaacatcaaaaaaaaaaaagagtgttttatgtttcagacaaggaaatagtgtccacaaattacctcactcttagcactggggaaaaggtagaaaggttaagcccagtatacatttaaataattttttcttggacatacctggttctctgcttccactcatattaggccagtgtccagaaaatcacatttcctttgcaaggtgttttctctgagagaataattgagcagacaaactgttgatatccttgtgtgtcctcgatcacattaattttcagctaggagtgagagccatcatggttaccagagtggtgtgtttcctgcagtgcccctatcttgcttgcaccagtagagctgggccctccatcaaaccatgatctgtagctataaagctgataatgaaagcaattgtgttctctttttccatctaattttttctcttaaggaaatcttattccaaggattagagcccagattatcttgtaaaaaggtaatgatttgtgtttgtttggggagataatttggttttcctctgcaggcaccatcatgggagcagcattgctggaggactggtgaagggggctttgtctgttgctgcctctgcatacaaggccctgtttgctgggccaccagtcactgcacaggtcagtgtgtgtgttttattttcctgaatctcaactccatgtcaccagtgaaagtgatggcatctgtctgggttgaagagtaacatggcattgtggaaagggcataggctttagatttagtctttagttaacacacaacacaactctgccacttttttttttttttttgagacgaagtctcgctctgttgcccaggctggggtgcagtggcgcgatctcggctcactgcaagctccacctcctgggttcacaccattctcctgactcagcctcccgagtagctgggactacaggcgcctgccactacacccggctaattttttgtattttttagtagagacgatgtttcaccgtgttagccaggatggtctcaatctcgtgacttcatgatcttcccgcttcagcctcccaaagtgctgggattacaggtgtgagccaccgcacctggccaactctgccactttctaactatatgactttagccaagttacttaagggaagaaaagagaagaatgtattattgatgatctattaatattttctatagagagaagctattccaggtgttggcactatggcatgaataaaacaccagttcttggccgggtatggtggctcttacctgtaatcctagtactttgggaggccaaggtgggaggattgcttgagcccaggagtttgagaccagcctgggcaacatagtgagacccccatctctacaaaaaaatttaaaaattagataagtatggccggtacagtggctcacacctgtaatcccagcactttgggaggccgaggcaggccggatcacaaggtcaggagatcgagaccatcctggccaacatggtgaaaccctgtctctactaaaaatacaaaaattagctgggcgtggtggcaggcacctgtagtcccagctactcgggaggctgaggcaggagaattgcttgatccagggagtcagagcttgcagtgagccgagatggcaccacagcactccagcctggcgacagaacaagactccatcttaaaaaaaaaaaaaaaaaagtatgatggcatgcacctacagtcccagttacttgggaaactaaggtgggaggatcacttgagcaccggaggttgaggctgccgtagtgagccacaatggagccactgcactccagcttgggtgactgagcgagaccctgtctcaaaaaacaacaacaaaaaagacactgagtcttgcccagaaactatgggaaacaagtgaggtgcatggatacttaaagtacatagtaagatactatgctggccgggtgtggtggctcatgcctgtaatcccagcactttggaaggctgaggcgggcggatcgtgaggtcaggagttcgagaccatcctggccaacatgatgaaaccccgtctctactaaaaatacaaaaattagccaggcatggtgatgtgtgcctgtaatcccagctacttgggaggctgaggcaggagaatcacttgaacctgggaggtggaggttgcagtgagctgagattgtgctactgcactccagcctgggcaacagagtgagactccatctcaaaaaaaagaaagatactatgccagtgctatcagacagatgaaacacttcagcctggtgtgcccaagtaaggctttctggtagatgatgcctgaactgagtcctaaaggacggagtaaatgttcatcaggaaagagggagggaaagggtattgtagacagtgtagccagtaaaaaagacttggaaatgtgagcatggagtgtgaatccggtctaagaagaggagtaagacgaaaaaagactggctgggcttggtggctcacacctgtaatcccaacaggttgggaggccaaggctggtcgattatttgcgtccaggagttcaagaccagtttgggcaacagggcaaaaccctgtctctactaaaaacataaaaaattagctgggcatggtggtatacgcctgtggtcccagatactcaagaggccgaggtgggaagatcacttcagcccgggaggcagaggttgcagtgagctgagatcacaccactgaactccaatgtgggtgacagagtgagaccatgtctcaaaaaaaaaaaaaaaaaaaaggctgggtgtggtggctcacgcctgtaatctcaacactttgggaggctgaggcgggtggatcatgaggtcaggagttcgagaccagcctgacccacatggtgaaaccccatctctactaaaaatacaaaaattagctaggcgtggtgacgtgcctgtaatcccagctactcaggaggccgaggcaggagaatcgctttaacctgggaggcggatgttgcagtgagccgagattgcgccactgcacttcagcctgggtgacagagcgagactctgtctcaaaaaaaaaaaaaaagaaaaagaaaaacagaccaaatatgtaggcaggatgctgtgttatgaggtttggattttattttaaggctaattaataggaggagcaattgaagggttttaaggaagtgattgacatgatgagatctgtttttagtaagattaccggctacattgtagaggctggtagagccagtaaagaaatccagttgggcgtggtggctcatgcctgtaatcccagcactttgggaggccgaggcgggcagatcacgaggtcaggagttcaagaccagcctggccaatatggtgaaaccacatctctactaaaaatacaaaaattgccgggcgtggtggcacgtgcctgtagtcctagctactcgggagtctgaggcagaagaattgcttgaacctgggaagcagaggttgcagtgagctgaaatcatgccactgcactccagcctgggtgacagagcgagactccgtctcaaaaaaaaaaaaaggaaatccctaagagaatccatgtattggtggaaaggaagggtagaaaagataattaagagatggaaatggcataactttgagatgatgattaagtggctaaaaagaaggataggctgggcacggtggctcacatctgtaatttcagcactttgggaggccaaggtgggcagatcacttgagttcaggagtttgagaccagcctgggcaacatagtgaaaccttatctctacaaaaaatacaaagaaattagccggacttggtggcgcacacctgtagtcccagctacttggggggcttaggtgggagaatagcttgagccccagaggcagaggctgcagtgagctgaggtcatgccactgcactccagcctgggcaacaaagccagacactatcttggggtggaggggaaaaagtcaaggataaatcccaagtttctggcttagtaccattcattaagagcagaagaagagaactaggtcagttttgctggacagtgttgagtttgtggcatatccaggtaaaggtaaagatatccagagtgcagctggatatatagttgtccctcagtatctatgacggttggctccaggaccccctgtgggatactgaaatccatagatgcttaagtcccttatataaaatagtgtagtatttatatataacctaggcacatcttcttgcttgcttgtttagttttagttttttagatacagggtcttgctctgtcatccaggctggagtgcaataactagattgtagctcactgcagcctagaactcttggattcaagcaatcctctcacctcagcctcttgagtagcagggactacaggtgggcaccaccatgcctagctagttttttaaaaatctttttgaagagatggggtttcactgtgttgcctagggcaactaactcctggcctcaaaacaatcctcccacttcagcctcccaaattgctgggatgagaaacttgagccgctgcacccagcccatctcatatacttcatctctacattacttacaatacccaatacaatgtaaatgctatctgaatagttgttatacggtattcgggaataatgacaaaaaagtttgtacgtgttcctttttttctccccaaatattttcagtcctttggtgactgatccatagatgaggaacccacagataatggcaagccaacggtatccatccagatcacaggggagggatttggcctggtgatacatgcttgagagtcacttgcctacagattatagcagaagccatctgatggaatgagatgatccaggaataatggggaaagcaagaagcaacctttaaggatcagggaaaggaatactctgaaagaaagctgggaactaggaggaaaatgaagagagagagttctatgctggaacttaaggaagggtgttttaataagggggacatggtcaacggtgttagatgctacagagagatatgaactggtggtgaggaatttgagagtagaagtatgccacactttcaaatagacaggctacaacaggcagaagctaggatacataagacaagaggaagcatttttaaagttgggtgagactttagagatgggcaagccagcagtgaaagaggttaatgataaagatgagaagacagattggagatggagaaagatttctgaagtggtgagaggtaataagatacaatgcaaggtacattccattaacctgcaaaggaggatggataatctattctgaaataagaaggtagaatggaacagtggaatcaggtttggagggaaatgcttaacatgtttgcatactgttctcatctttacatactttttcaacaaccctgcaaagtaggaggtatgatatatcttcagttcataaaggaattgatagcacagttggtaagtaaatggaagattagggtttgagtctaagcctatctgcctcccaagttaataatctttctgctgcacagtttcagtatccccagtctgtgaaattgggataataacagaaccagaggccaggcgaggtggctcacatctataatcccagcattttgggagaccaaagttcaaggatcacttgggcccagaagttcaagaccagcctgggcaacatagggaaacctcatctctagtaaaaaatttaaaaatttgccgggcgtggtagcgcagaccagtggtcccagctatttggaaggctgaggcaggaggatcacttgagcccaggaggttgaggctgcaatgagctgtgttcacaccactgcacaccagcctggggaacagagtgacaccctgtctcaaaaaacaaacaaaacaacaacaacaacaaaacaagcgtttaaggatttaggaaggtaatgcttccaccacagggcttgaatgaatgaatgttaacttcctcttacctattcttgtttttttttttttgagatggagtctcgctctgtcacccaggctggagtgcaatggcgcgatctcggctcactgcaagctccacctcctgggttcacgccgttgtcctgcctcagcctcccgagtagctgggactacaggcgcctgccaccacgcctggctaattttttgtatttttagtagagatggggtttcactgtgttagccaggatggtctcaatctcctgacctcatgatccgcccgcctcagcctcccaaagtgctgggattacaggtgtgagccaccgcacccagcccctcttacctattcttttggaggagaaaaaatcaagaagccttcccaggttgtaatttcccaagctgttttttttgtccagctcctctgcatatctgacaaaatttcccatagcatctttcagtaacacttttatcttgctcatacttcccccatcatcacaattacacttatgttcacagggtctctggggcttgctgtcattccttcatctggccaaaaaatgcttcttcctgaaagccccgagtgaagcattctcctggttctaagtacagttcattagctccccggtttcccttttctcctccttcaagtacacagataactaatctaaaatagggccttcccagtccgaaccgttggtatcaagtacacaggagtgccatagccttgaatctaattacctagtactttgaataaatctggaaagactagtatgcttgcaagatgatacaaatgtataaaataaacatttaaattatacagaatttttttttttttttttgctttgcttgtctctacacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgcaagccagccaggccgttcattatttaaaacgttttaatcggggcttccgggtagaaggtggagcggcagggtgtaattgggttgatgggtgggacctgtcttgaccatcggagttttataatcgagggccaggagggcccgggttgctctcctggttatgtatgtacttgtacataaccacctaaagaatggtgaaataaatgttcttggaaattcctacccggactggctagtccttgcggaagcagcgtccgggccctcgggtaacgtttgaagagctggcagcgtctcaggctgctgcgtggcgaaggggcggaccgggggacgggggggtgggcccttaggggctggggcgggacttccctgggcactgagtcaaagcttgaggggagtgttcgctcccgcattttcgattccactctcttccgtttctgtcgctgcagtcgtccgcgggtaaggccctccctagaccctttatacctactttacctttcggaggtcaagacacctcctgttgccgcctcctcgcccaacacacaggcgccccccgcacgggtaccaagcttgactaacggcctctaggggtgtgtggtgggacttgaaatcctcccttaatgaagtcacaccttctccgtccgcttccacccggtcggcccatggcagagcccccatgtagcccaggaatcggcttggcccttcggggaggtcagcgtccttactatccccactctccagtgcggcacattcgttcccctaggactccggccggttgccggccccaggcggtgcttctccccaccaccgcccagctcagctcagcccagcccagcccactctgcccttagaggcccttctccccaaagacgcactccagaagtctcgccctcgtgcggctgaggagcctgggatcccagacctgaacaaggtgagcatccctatattttagcccagaaagatctgtgtggctcacttgccggcctcgttctgtcacacagagtccagatttagccttgagttttcctagtgaaagacagaccctggtatcactatgaccctcctcaggctttcttaccccgcctcagaaagcagtgaggtgtctgctttctcccagggcttctttagataggggtcttaaccacacctgtgaccagtctggcctcctctctccttgattcaaagaatctcttttctgccctatccaacttccttcccttaaactgaatgacagctcagcaacttttccagagaaaaattaaatgctctgacaatcacttatggaagttccttaaagtgaagtaacttctgcttttcttttgttttcccttttgtaggcagattggtctcttttaaaataatgaaaggagtcgaaatgcattgagacttctgagagtcccatgtgaccacccagtttttcacatcctatcttccttaggcttgagcttgcttaaactgtggtgaagctccttgccagtcttgagaacttcaaaccaaaattacatctggcgtcagtgctaacaagcttagcactgaactttggtcttttctcattagtgaaacccccgcccctgaagaatgggtaagacgttttcccagctgggctcttggcgggaggatgagaacaagtcaatcctgtcctccaaaccagccattggcagcaaggctgtcaactactccagcaccggtagcagcaagtctttttgttcctgtgtgccttgtgaaggaactgctgatgccagcttcgtgacttgtcccacctgccagggcagtggcaagattccccaaggtgagtggcccaaggctctggaaatagcctggaatccagggaaagttcttagcctgttggcctggggcagcccctctgagtctccttggatggggttagatctgctcccagctcttgacctcccagtctcaggctggccagggagatacttaactatccttgggttccctgcaaaaacctgccctccttccctggttgtattctccagccccttgtg
